United States Patent 8,343,764 (GENES ENCODING GLUTAMINE SYNTHETASE AND USES FOR PLANT IMPROVEMENT) - sequence listing, part 7

SEQ ID NO: 28960 - protein, 496 aa, Oryza sativa (japonica cultivar-group)
MATCADTLGPLLGTAAANATDYLCNQFADTTSAVDSTYLLFSAYLVFAMQLGFAMLCAGSVRAKNTMNIMLTNVLDAAAGALFYYLFGFAFAFGAPSNGFIGKHFFGLKQVPQVGFDYSFFLFQWAFAIAAAGITSGSIAERTQFVAYLIYSAFLTGFVYPVVSHWIWSADGWASASRTSGSLLFGSGVIDFAGSGVVHMVGGVAGLWGALIEGPRIGRFDHAGRSVALRGHSASLVVLGSFLLWFGWYGFNPGSFLTILKSYGPPGSIHGQWSAVGRTAVTTTLAGSTAALTTLFGKRLQTGHWNVIDVCNGLLGGFAAITAGCSVVDPWAAIICGFVSAWVLIGLNALAARLKFDDPLEAAQLHGGCGAWGVIFTALFARKEYVDQIFGQPGRPYGLFMGGGGRLLGAHIVVILVIAAWVSFTMAPLFLVLNKLGLLRISAEDEMAGMDQTRHGGFAYAYHDDDASGKPDRSVGGFMLKSAHGTQVAAEMGGHV

SEQ ID NO: 28961 - protein, 202 aa, Oryza sativa (japonica cultivar-group)
MAETVFTPSLEGMKHVKSESSVILTKPFLDVCKQILPVLDKFGAAMALVKSDIGGNITRLENKYSSDPSKYEQLYSMVQEEVQNKTAKGSSSCTNGLLWLTRAMDFLVELFRNLLEHQDWTMSQACTDSYTKTLKKWHGWLASSSFTVAMKLAPNREKFMEVISGTGDIKADIEKFCTTFYPFLKENHDFLASVGLDDLKAS

SEQ ID NO: 28962 - protein, 288 aa, Oryza sativa (japonica cultivar-group)
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGTAVIYNKDKAWDDQWIFWVGPLIGAAIAAAYHQYVLRASAAKLGSYRSNA

SEQ ID NO: 28963 - protein, 381 aa, Oryza sativa (japonica cultivar-group)
MAAASSPAAAITCRAAVAWAPGQALVMEEVEVAPPEAMEIRVKVVSTSICRSDVTQWQSTAQTDLFPRIFGHEASGVVESVGEGVTEFEVGDHVLTVFIGECMSCKHCVSGKSNMCQKLGLERRGVMHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 28964 - protein, 255 aa, Oryza sativa (japonica cultivar-group)
MHSDQKTRFSLRGKPVYHYCAVSSFSEYTVVHSGCAVKVGPTVPMDRICLLSCGVSAGLGAAWKVADISKGSSVVIFGLGTVGLSVAQGAKLRGASIIIGVDTNPEKQEKGKAFGVTDFINPEELNEPVQQVVKRLTNGGADYSFECVGDTGVVSTALQSCSDGWGLTVTLGVPKAKPEVSAHYALLLSGRTLKGSLFGGWRPKSDLPLLVDKYANKEIQVDDLVTHDLSFDYINKALELMLENKCLRCVIHMPQ

SEQ ID NO: 28965 - protein, 190 aa, Oryza sativa (japonica cultivar-group)
MQARRHRGFRLGRKLLGLWRWALCHRRRRRGRGYLRLQPCPGAAGGRSPLLAAGSVKKQPPPPQQQIVVHQRGGEKAVLKWGRSLARRMRLLRRRGSERLLEESPGEATTPKGQVAVYVGGGEPGESMRYVVPVVYFNHPLFGELLREAEEEFGFAHPGGITIPCAAARFERAAAVAAAGGGGRKVPTWW

SEQ ID NO: 28966 - protein, 487 aa, Oryza sativa (japonica cultivar-group)
MEEKPQHGSLGGLVAGVREEYESGRTKELEWRKAQLGGLIRMITEEEDAIFDALHDDLGKHRVESFRDEVGVLAKSVRNTLQNLKKWASPEKVDVPLISFPCNARVVPEPIGVVLIFSCWNLPIGLALEPLSGAIAAGNAVVLKPSEFAPSTAAFLAANIPKYLDANAVKVVQGGAEVGEELMEHRWDKVLFTGNARVGRIIMTKAAKHLTPVALELGSKCPCIVDCLDSKRECQVAVNRIIGAKWSTCAGQACVAIDYILVEEQFAPFLIELLKSTLKRFFTEPEYMARILNEKHFHRLTNLLEDDQVKSSIVHGGNADPKTLWIEPTIVLNPPFDSDIMMEEIFGPLLPIITVKKTEDCIAFLKSKPKPLAIYAFTNNEKLKQRIVAETSSGSVLFNDAIVQYGLDSVPFGGIGESGFGQYHGKYTFELFSHRKAVVRRSLLVEFMFRYPPWDEYKMGMLRRVFRFDYVSLVLALLAFWLLGIRR

SEQ ID NO: 28967 - protein, 483 aa, Oryza sativa (japonica cultivar-group)
MGEKPKPAVVLGGMVSGLREVYESGRTKDLEWRQSQLKALIRLLTDKEEEIFAVLHDDLGKHRGESFRDELGILVKSIKYTLQNLKKWAASERAESPLVAFPATAMVVPEPLGVVLVFSCWNLPLGLALEPLSGAIAAGNAVVLKPSELAPSTAAFLAANIPRYLDSRAVKVVLGGPNVGEELMEHRWDKVLFTGSARIGRIIMAKAVKHLTPVALELGSKCPCIVDWLDSKRDRQIAVNRIIGAKWSTCAGQACIAIDHVIVEERFAPILIELLKSTLKRFMAKPGGMARILNAKHFERLSGYLEDNRVAASVVHGGYMDPKKLNIEPTLLLNPPADSDVMTEEVFGPILPIITVKKIEDCIAYLKSKPKPIAMYAFTNNERLKRRIVEETSSGSVTFNDAVVQYALESVPFGGVGHSGFGQYHGKYSFELFSHKKAVFKRSFLIEFMFRYPPWDERKIGTLRHVFSYNYFLLFFNLLGFRR

SEQ ID NO: 28968 - protein, 465 aa, Oryza sativa (japonica cultivar-group)
MGCFGRVRDMIKKRKGKKRPPPHEGPAPPPPPPSALAGSSHSTSTVSSSAVATSQSTEDSSAAAARPAAGWSRSSGSVSSARSIPELYEERGASSLQEFGLRELQAATRDFSRLLKIGEGGFGSVYKGVVRLPGGPAGGTEVAIKKLNPNSRQGHKQWLTEVQFLGVVEHPNLVKLIGYCAAQSERGPQRLLVYEFMSNKTLDDHLFNKAYPVLPWDIRLKIALGAAEGLLYLHEGLEVQVIYRDFKASNVLLDEEFRPKLSDFGLAREGPTADNTHVSTAVMGTYGYAAPDYVETGHLTNKSDVWSFGVVLYEILTGRRSMERNRPKNEQKLLEWVRQYPVETKRFSRIIDIRLRHNYSKQGTREIAKLANSCLAKHAKDRPTMREVVESIKQVMQHNELDGDVEASGESSPPHEVPGKPTADDVAVAAARRRMLHLAALGENANNIARRRFMLMRAAAAPTPT

SEQ ID NO: 28969 - protein, 494 aa, Oryza sativa (japonica cultivar-group)
MAKPPPAPHRANRAPPGLCALPAISYNSHRGLVLGLTFVAYALYHASRKPPSIVKRALSEAWPPFHDPALLGETDVAFLAFYSLGMFVAGHLGDRLDLRLFLAVGMIGSGTAVALFGVGYFLSLHSLAFYLAAQVIAGLLQSTGWPSVVAIVGNWFRGRRRGLIMGIWNAHTSIGNISGSLIAAAVLRYGWGWSFIVPGLLIAFGGVLVFFFLAPYPEDLGFSPTTLPKAVSEASTDEEDSSSSASAAGGAGKEERRDAVGMWKAFAIPGVITFALCLFFAKLVAYTFLYWLPFYLSQTAIGGKEMSVTSAGYLSALFDVGGIIGGILAGFISDHLNARATTAAIFMYLAIPSLYAFHAYGSTSEVANIGLMMISGLFVNGPYALITTAVSADLGTHKSLKGDSRALATVTSIIDGTGSLGAALGPFITGFISKRGWDSVFTMLIFCALAAGVLLSRIVKSEIVHIIQNRRNHTLDMHNRTADSGAQPLLEGDT

SEQ ID NO: 28970 - protein, 229 aa, Oryza sativa (japonica cultivar-group)
MGKRWIPLEANPDVMNQFMWGLGVAEGEAQFCDVYGLDDELLAMVPQPVLAVLFLYPLTSLDDDEEESGAAATSTAGDKDLSKRVYFTKQTVGNACGTVGVIHAIGNAASKLKLVEGSYFDRFYKQTVDMDPVQRAAFLEEDDEMEDAHSVAASAGDTDANVEVNEHFVCFSCVDGELYELDGRKSQPICHGPSSPDTLLQDAAKVIKARIASNPDSMNFNVMALSKVV

SEQ ID NO: 28971 - protein, 371 aa, Oryza sativa (japonica cultivar-group)
MDLSNSSPVITDPVAISQQLLGGLPSNLMQFSVMPGGYSSSGMNVGVSRLKIEEVLVNGLLDAMKSSSPRRRLNVAFGEDNSSEEEDPAYSAWMAKCPSALASFKQIVASAQGKKIAVFLDYDGTLSPIVDDPDKAVMSPVMRAAVRNVAKYFPTAIVSGRSRNKVFEFVKLKELYYAGSHGMDIMAPSANHEHSAEKSKQANLFQPAHDFLPMIDEVTKSLLQVVSGIEGATVENNKFCVSVHYRNVAEKDWKLVARLVNEVLEAFPRLKVTNGRMVLEVRPVIDWDKGKAVEFLLQSLGLNDSENVIPIYIGDDRTDEDAFKVLRQRNCGYGILVSQVPKETEAFYSLRDPSEVMEFLNFLVRWKKHSV

SEQ ID NO: 28972 - protein, 475 aa, Oryza sativa (japonica cultivar-group)
MRTKHLIPHHAAGYTYARAYATTGGGGGDGGDGGGGGDPFEQFPEAVLGLIVSKLPFRSAVAASAISRRWRGVAAAAPALDLDFAAAFPAAPRRRAAFAAAATAALSRPHHPLRRLRLGLDGLFDQAFAASAADHLASWLAAAAARGVEQLELHLPRSRLALLPPSLIACTNLTSLTLRLDHYAHPLPSLCSLTRLSRLHLASIPLAGDDFFADLFSHCKQLRYLILEQCRIGALCLAGTTQLCSLAITDCSWTPQSSVAFSDMPALRTLHYLGAMATRHIIDNVDSLEEVVLAIKKPQVKLQEPNLRELLSLVGNVQSLMLSPWCIEQFARPEEWSKVRLNKVRQLSCIIERREEGASSIAPLLANCQNVEELSVSVVPSQCKRRWGSDDGANHWVMGGKGVVLRHLRAVRMVYIDESKSGLDLVKLLLKNTPMLEMMTIVPSMDGLEQAKFRRRVLKLRKASRDADIQFSATG

SEQ ID NO: 28973 - protein, 422 aa, Oryza sativa (japonica cultivar-group)
MGAFLLFVCVLAPFLLVCAVRGRRRQAGSSEAAACGLPLPPGSMGWPYVGETFQLYSSKNPNVFFNKKRNKYGPIFKTHILGCPCVMVSSPEAARFVLVTQAHLFKPTFPASKERMLGPQAIFFQQGDYHAHLRRIVSRAFSPESIRASVPAIEAIALRSLHSWDGQFVNTFQEMKTYALNVALLSIFGEEEMRYIEELKQCYLTLEKGYNSMPVNLPGTLFHKAMKARKRLGAIVAHIISARRERQRGNDLLGSFVDGREALTDAQIADNVIGVIFAARDTTASVLTWMVKFLGDHPAVLKAVTEEQLQIAKEKEASGEPLSWADTRRMKMTSRVIQETMRVASILSFTFREAVEDVEYQGYLIPKGWKVLPLFRNIHHNPDHFPCPEKFDPSRFEVSITNPLFRVFVPFPPFPFPVRPTS

SEQ ID NO: 28974 - protein, 479 aa, Oryza sativa (japonica cultivar-group)
MGRAFEYVILGGGVAAGYAALEFVRRNGGASSQELCIISDEHFAPYERPALSKGYLLPQDAPRLPAFHTCVGSKDELLTEEWYNEHGIVLVLGTRVISADVRQKTLLTSSGETISYKTLIVATGARAVKLEEFGVSGSDARNVCYLRNVEDADKLVGVMRSCPGGNAVVVGGGYIGMECAAALVTNNIKVTMVFPKKHCMGRLFTPKIAEFYESYYASRGVTFVKEAAVTSMQISAGKVTAVNLGNGRRLPADMVVVGVGARANTGLFDGQLVMENGGIKVNGRMQASDASVYAVGDVAAFPVKLFGGDVRRLEHVDCARRTARHAVAAMLEGTGSVGHIDYLPFFYSRVFSLSWQFYGDNAGEAVHFGDLAPPGDGDGAAPKFGAYWVRDGRVAGAFLEGGSRQEYEAVAAAVRRGAAVADVAELERRGLAFATQATGGGGKPTCAWHATVGVAAAVSIAAFACWYGWQAPYVLKRDF

SEQ ID NO: 28975 - protein, 476 aa, Oryza sativa (japonica cultivar-group)
MGRAFVHVILGGGVAAGYAALEFARRGGYSRGELCIISEETVAPYERPALSKGYLLPEGAARLPGFHTCVGANDELLTAKWYKENGIELVLGTKVITADVRMKTLLTATGETISYKNLIIATGARALKLEEFGISGSDASNICYLRNLDDADKLVNVMKSCPGGNAVVIGGGYIGMECAAALVTNRIKVTMVFPESHCMARLFTPKIAEYYENYYTSKGVTFVKGTVLTSFEKDSTGKVTSVILKDGKHLPADMVVVGIGIRASTGLFEGQLLMEQGGIKVNGQMLTSDGSVYAVGDVAAFPIKLFDGVIRRLEHVDSARRTARHAVAAILEPSKTKDIDYLPFFYSRVFTLSWQFYGNNTGEVVHFGDFTNSSPRFGAYWVDKSRIRGAFLEGGSREEYEAISNVVRRKAKVINIAELEKQGLMFAIQESQKDLPDGGLALGEKPTYVWHATAGVIAAASIAAFGYWYGRKRRRW

SEQ ID NO: 28976 - protein, 357 aa, Oryza sativa (japonica cultivar-group)
MVVPDESTIWDEVLEEADELAYVHKVPPSISFLSAGTGKRRKGEHRLKFSIRGSSSVSLNVKTENPYIGEQEVSSVMPTNRAPETMMAEQLENIKEETEDLPSEFACSTKKANVSISELLDSLQDRSASSAGTPFLLHQHTRPKEEKPKVPTSVKRTLALLGQRNLETENPLEHVIGETSSEEEDDAQNNLALINKDVKGQTMADIFQQVFNATSMDCFTLPVRSYGSGYYGRMQQILQMEKDRHAEFLRQYNREQDYLGDPKGVTVQILSRSLEGKLTICRCLFMEKSNLATTGEVSTDLDMDNSSVKRTIIFSPKICDNVDLLAGNIIHIFPPWKEVKVKEETVILCTYFSHRGV

SEQ ID NO: 28977 - protein, 446 aa, Oryza sativa (japonica cultivar-group)
MSNYHEDHIEEMEDDYDMDDTADDMGEENYERGMRDSDSEDEEHGQSNDKIPDTSSVDARKGKDIQGIPWEKLAITRDKYRQTRLDQYKNYENMPNSGEAAAKECKPTEKGGMYYEFRRNTRSVKSTILHFQLRNLVWATSKHDVYLMSHFSVLHWSALSGLDTELMNVQGHVAPREKHPGSLLEGFSGTQVSTLSVKDNLLVAGGFQGELICKHLDREGISFCCRTTYDENAITNAVEIFNTTSGAVHFMASNNDSGVRDYDMERFQLYKHFQFEWPVNHTALSPDRKLAVIVGDDPNGLLIDANSGKTLHSLKGHFDYSFASAWSPDGRTFATGNQDKTCRIWDARNLSKSLHVLRGNLGAIRSIRFTSDGQFMSMAEPADFVHVFDVGSDYTRRQELDFFGEISGMSFSPDTDMLFVGVWDRTYGSLLQFGRLYNHSYLDSLC

SEQ ID NO: 28978 - protein, 421 aa, Oryza sativa (japonica cultivar-group)
MQERCRVLLRFADLIEQHADEIAALETWDGGKTLEQTTGTEVPMVARYMRYYGGWADKIHGLVVPADGPHHVQVLHEPIGVAGQIIPWNFPLLMFAWKVGPALACGNAVVLKTAEQTPLSALFVASLLHEAGLPDGVLNVVSGFGPTAGAALSSHMGVDKLAFTGSTGTGKIVLELAARSNLKPVTLELGGKSPFIVMDDADVDQAVELAHRALFFNQGQCCCAGSRTFVHERVYDEFVEKARARALQRVVGDPFRTGVEQGPQIDGEQFKKILQYVKSGVDSGATLVAGGDRAGSRGFYIQPTVFADVEDEMKIAQEEIFGPVQSILKFSTVEEVVRRANATPYGLAAGVFTQRLDAANTLARALRVGTVWVNTYDVFDAAVPFGGYKMSGVGREKGVYSLRNYLQTKAVVTPIKDAAWL

SEQ ID NO: 28979 - protein, 485 aa, Oryza sativa (japonica cultivar-group)
MTSSSGQLKRLKPLYQLAVNNILAVVAVPLAAAVVLKAAELGHEEILARARALPPAHLFLAAFVPAAAAVVYLMLRPRAVYMVDYACFRTSPNCRVPFATFLEHSRVWPGFEERSVRFMTRLLERSGLGEETCLPYAQHYIPPSRDLESSRAEAELIIFSAIDDLLAKTGISPQDIDILVVNCSLFAPTPSFTDMIINRYKLRKDVRNVHLSGMGCSAGLISVGLARNLLQVAPKGAHALVVSTETITPNYYMGQERAMLLPNCLFRMGGAAVLLSTNGAKARFRLARVVRTLTGAQDGAYHCVYQEEDGRGNVGINLSKDLMSIAGDALKANITTMGPLVLPASEQLLFALSFMARKVLSGRIKPYIPDFRTAFEHFCIHAGGRAVIDELQRSLTLSDEQVEASRMTLHRFGNTSSSSLWYELAYVEAKGRMRKGDRVWMIGFGSGFKCNSAAWECIRPAANADGPWATCIHRYPVDIPDVLKH

SEQ ID NO: 28980 - protein, 452 aa, Oryza sativa (japonica cultivar-group)
MTRARARARAVRLAVSEIPLAVRRSARQQQQPPEPAADVPDHFLCPISLDMMRDPVTAPTGITYDRDGVEVWLERGRPTCPVTGRPLRPEELVPNHATRRMIQEWCVANRALGVERVPTPRVPVSAADAREILEGVAAAARRGDAAACGRMVARARALGKESERNRRCLASAGAERALALAFSRLAAASTDQQAEARACALEEILAALVVFFPLDEESRRCIASPPSLDALVSILSHGEQVTRVSAVVVLREIASSCDNQCLEAMSKANAMYDALVNLVAKPVSPQATKAALVTAYYLVKNDIEHAASRLVDLGTVELLVELLADADKGTTEKALAVLDTVLVAAKARDRAYAHALAVPVLAKKTMHVSDMATEFAVSALWRLCKNSPADGGCKAEALQVGAFQKLLLLLQLGCDGVTKERASELLRLLNASRDSTECIETADFKGLKRPFI

SEQ ID NO: 28981 - protein, 181 aa, Oryza sativa (japonica cultivar-group)
MEGGGEEFAIGVLISVKTTLGEEFEGQIVSFDRPTNLLVIQEGVGRAERGERRNVRVLKANYIREFSVVGKADDPLDPAGCVLDLAAIHAREEAALRQAEIEAERIGVGVTPEAQSIFDALSKTLPVQWDKTDIVVMKEVRVCNPYLPENVSGGTSAANERVKKVLDFERKRLHVRVPGQF

SEQ ID NO: 28982 - protein, 493 aa, Oryza sativa (japonica cultivar-group)
MAGGGGGGRASAQRRAALAALITLLLLASLAFLLSATGTASAPNSAPFRLAAIRRHAEDHAAVLAAYAAQARKLSAASASQTESFLSISGHLSSLSSRISLSTVALLEKETRGQIKRARSLAGAAKEAFDTQSKIQKLSDTVFAVDQQLLRARRAGLLNSRIAAGSTPKSLHCLVMRLLEARLANASAIPDDPPVPPPQFTDPALYHYAIFSDNVLAVSVVVASAARAAAEPARHVFHVVTAPMYLPAFRVWFARRPPPLGTHVQLLAVSDFPFLNASASPVIRQIEDGNRDVPLLDYLRFYLPEMFPALRRVVLLEDDVVVQRDLAGLWRVDLGGKVNAALETCFGGFRRYGKHINFSDPAVQERFNPRACAWSYGLNVFDLQAWRRDQCTQRFHQLMEMNENGTLWDPASVLPAGLMTFYGNTRPLDKSWHVMGLGYNPHIRPEDIKGAAVIHFNGNMKPWLDVAFNQYKHLWTKYVDTEMEFLTLCNFGL

SEQ ID NO: 28983 - protein, 399 aa, Oryza sativa (japonica cultivar-group)
MGAAMLLAPMPLLLLASTPLAAVHLPTRCRLRLQLLSRAAPEAASATTTTTTAPDNHFSVEEYLISNCNLTQPQAHKASKSIAHLKSRSNPDAVLAFLADFGLSPKEVAAIVASNPRILCARIDRSLAPICSELRAVGLSPSQIARLAQITGRYFLCRSFVSKVRFWLPLFGSSERLLQASDWNYWLLTSDLEKVVEPNVSFLKECGLSARDISKLLVAAPRLVTMHPDYVKDAVRRAIQLGVAPGSQMFRHALSTAGCIGQDKIDAKVAVLKESLGWSQEEVNLAVSKAPRILVASEERLRRNAEFLIDEVGLQPQYVARRSVLLMYSLERRLVPRHLVVKLLKERGLIEQDRCFFNAVAPTEEKFLEKFVVPFEGCVPGLADAYESACAGKTPVQAE

SEQ ID NO: 28984 - protein, 332 aa, Oryza sativa (japonica cultivar-group)
MAASTSQHALVSVKSLCTGANFGFEKRTSKVRFVLVGRCCSGTRKLGLVCASNSHSSVMEPAQLPLSPESGNTPKKSSESALILIRHGESLWNEKNLFTGCVDVPLTPKGVDEAIEAGKRICNIPVDVIYTSSLIRAQMTAMLAMMQHRRKKVPIVVHSESEQAHRWSKIYSEETKKQSIPVITAWQLNERMYGELQGLNKQETADRFGKEQVHEWRRSYDIPPPNGESLEMCAERAVAYFKDQIVPQLVAGKHVMIAAHGNSLRSIIMHLDKLTSQEVISLELSTGIPMLYIFKEGKFIRRGSPAGPSEAGVYAYTRSLAQYRQKLDNMFQ

SEQ ID NO: 28985 - protein, 168 aa, Oryza sativa (japonica cultivar-group)
MAALPLATAEVCDANSNPIIAGELRALPPIFKIYGRRQVFAGPVATVKVFEDNVLVRELLQEKGHGRVLVVDGGGSVRCALLGGNLAQLAQINGWVGIVVNGCIRDVDEINGCDVGVRALNSHPMKSGKKGAGEKRVPVTIEGTRICDGEWLYADADGILISRTELTV

SEQ ID NO: 28986 - protein, 385 aa, Oryza sativa (japonica cultivar-group)
MAGVSAASAAGKIGSFLSKRPYAPPSWASHLSPAPSQTFSLGHFPTPIHKWNLPNLPNGTEVWIKRDDISGMQLSGNKVRKLEFLMADAVAQGADCVITVGGIQSNHCRATAVAAKYINLDCYLILRTSKLLVDKDPGLVGNLLVERLVGAHIDLVSKEEYGKIGSVALADLLKKKLLEEGRKPYVIPVGGSNSLGTWGYIEAIREIEHQIQISGDVQFDDIVVACGSGGTIAGLALGSKLSSLKAKVHAFSVCDDPGYFHSYVQDLIDGLHSDLRSHDLVNIENAKGLGYAMNTAEELKFVKDIATATGIVLDPVYSGKAAYGMLKDMGANPAKWEGRKILFVHTGGLLGLYDKVDELSSLSGSWRRMDLEESVPRKDGTGKMF

SEQ ID NO: 28987 - protein, 203 aa, Oryza sativa (japonica cultivar-group)
MPSARVQAGGGGNGGAGGGGSGRFKRALLRNLILGLRKGGVASGEMGFHERKSAIKRAADAALAAARGAAPCWSRSLAAELAQAPQQHRSPPSPSPRKMICRKIVRRSLIRRRRRPIRPANNTTAATTKAYGGGGGGGGGVARAMVRKRASVLKEIVPGGKALDMCALLGETLDYAVSLKAQVDVMQLLVRTLQEQKLKNSGN

SEQ ID NO: 28988 - protein, 328 aa, Oryza sativa (japonica cultivar-group)
MRAVVIARAGGPEVLEERDVGEGLPPPGEGEVLVGVSAAGVNRADTVQRQGRYPAPPGASPYPGLECSGTILALGPNVPSRWAVGDQVCALLSSGGYAEKVVVPAGQLLPVPEGVSLTDAAGLPEVACTVWSTVFVTSHLSPSESFLIHGGSSGIGTFAIQIAKHLGIKVFVTAGSEEKLAACKGLGADVCINYKTEDFVARVKEETNGKGVDVILDNIGGLYLQRNLNSLAVDGRLFIIGFQGGAVTEVNLQPMLARRLTIQAAGLRNRSLDNKALIVSEVEKNVWPAVVQGKVKPVIYKTFPLSEAAEAHKLMEESSHIGKILLIP

SEQ ID NO: 28989 - protein, 338 aa, Oryza sativa (japonica cultivar-group)
MSSNFEANNNNNGEKQLVCVTGAGGFIGSWVVKELLIRGYHVRGTARDPADSKNAHLLELEGADERLSLCRADVLDAASLRAAFSGCHGVFHVASPVSNDPDLVPVAVEGTRNVINAAADMGVRRVVFTSSYGAVHMNPNRSPDAVLDETCWSDYEFCKQTDNLYCCAKMMAEMTATEEAAKRGLELAVVVPSMTMGPMLQQTLNFSTNHVARYLMGTKKSYPNAVAAYVDVRDVARAHVLVYERPEARGRYLCIGTVLHRAELLRMLRELFPRYPATAKCEDDGKPMAKPYKFSNQRLKDLGLEFTPLRKSLNEAVLCMQQKGHLPLIYPVPKRAYL

SEQ ID NO: 28990 - protein, 337 aa, Oryza sativa (japonica cultivar-group)
MSSNFEANNNNGEKQLVCVTGAGGFIGSWVVKELLIRGYHVRGTARDPADSKNAHLLELEGADQRLSLCRADVLDAASLRAAFSGCHGVFHVASPVSNDPDLVPVAVEGTRNVINAAADMGVRRVVFTSSYGAVHMNPSRSPDAVLDETCWSDYEFCRQTDNLYCCAKMMAEMTATEEAAKRGLELAVVVPSMTMGPMLQQTLNFSSNHVARYLMGTKKSYPNAVAAYVDVRDVARAHVLVYERPDARGRYLCIGTVLHRAELLRMLRDLFPQYPATAKCEDDGKPMAKPYKFSNQRLKDLGLEFTPLRKSLHEAVLCMQQKSHLPLIYPVPKRAYL

SEQ ID NO: 28991 - protein, 354 aa, Oryza sativa (japonica cultivar-group)
MSCNSAEVAANDGSSNGGEKQQQQEEEVVCVTGAGGFIGSWVVKEHLLRGYRVRGTARDPTKNAHLLALDGAGERLTLCRADVLDSESLRAAFAGCHGVFHVASPVSNDPNLVPIAVEGTRNVVNAAADMGVRRVVFTSSYGAVHMNPNRSPDTVLDETCWSDPKFCRQTDVYCYAKTMAEKAAEEEAAKRGVQLAVVLPCVTVGPILHPAINTSINHVVRYLTGAAPTYPNAVAAYVDVRDVARAHALVYERHDARGRYLCIGAVLHRAHLLQMLKELFPQYPVTSKCKDDGNPMVEPYKFSNQRLKDLGFEFTPMRKCLYDAVVCMQQKGHLPLVGTAVPDQNVTSNTSSIV

SEQ ID NO: 28992 - protein, 339 aa, Oryza sativa (japonica cultivar-group)
MSSISNDNNGDQKRQQQQQLVCVTGAGGFIGSWVVRELLLRGYRVRATVRDPADRKNAHLLALEGAHERLSLRRADVLDFAGLLAAFAGCHGVFHVACPLSNRDPELMAVAVDGTRNVMNAAADMGVRRVVFTSSYGAVHMNPNRSPDAVLDESCWSDPEFCRQKDVSLLHMYCYAKTMAEMAATEEAAKRGLELAVVVPSMTMGPMLQRALNLSSTHVANYLTGAKKSYPNAVAAYVDVRDVARAHALVYERHDARGRYLCIGAVLHRAQLLQMLMDLFPQYTIASKCDDKGKPMVKPYEFSNQRLKDLGLEFTPLRKSLYDAVMCMQRNGHLPVVLP

SEQ ID NO: 28993 - protein, 496 aa, Oryza sativa (japonica cultivar-group)
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 28994 - protein, 463 aa, Oryza sativa (japonica cultivar-group)
MDLLPLVTLLLLAHAAAWVAWQAAARRRRATCYLLDYACHKPSDDRKVTTELAGAIIERNKRLGLPEYRFLLKVIVNSGIGEHTYSPRNVLDAREDCPTLRDALDEMDDFFDDAVAAVLARAAVSPRDVDLLVINVGSFSPSPSLADRVVRRFGLRDDVMAYNLSGMGCSAGLVSVDLARNVMLTRPRTMALVLTSESCAPNWYTGTDKSMMLGNCLFRCGGAAALLTNDPAFRSRAKMELRCLVRAHIGAHDDAHAAAVHREDADGRLGVSLSKALPKAAVRAFTENLQRLAPRILPAGELARFAARLLLRKLLRRKAAAGAAAKINFKTGVDHFCLHPGGTAVIEAVRKSLGLDSYDVEPARMALHRWGNTSASSLWYVLSYMEAKRRLNAGDRVLMVTFGSGFKCNSSYWVVTKDLADAGAWEDCIHDYPPANLVNPYMEKFGWVNDLPSQGQGGAFPFF

SEQ ID NO: 28995 - protein, 381 aa, Oryza sativa (japonica cultivar-group)
MASSTQGQVITCKAAVAWEANRPMTIEDVQVAPPQAGEVRVKILFTALCHTDHYTWSGKDPEGLFPCILGHEAAGIVESVGEGVTEVQPGDHVIPCYQAECRECKFCKSGKTNLCGKVRAATGVGVMMNDRKSRFSINGKPIYHFMGTSTFSQYTVVHDVSVAKINPQAPLDKVCLLGCGVSTGLGAVWNTAKVEAGSIVAIFGLGTVGLAVAEGAKSAGASRIIGIDIDSKKFDVAKNFGVTEFVNPKDHDKPIQQVIVDLTDGGVDYSFECIGNVSVMRSALECCHKGWGTSVIVGVAASGQEISTRPFQLVTGRVWKGTAFGGFKSRSQVPWLVEKYLNKEIKVDEYVTHSMNLTDINKAFDLLHEGGCLRCVLATDK

SEQ ID NO: 28996 - protein, 375 aa, Oryza sativa (japonica cultivar-group)
MAAAAIHQFAECITCHAWSPDHSMIAFCPNNNEVHIYKFFTDKWEKLHVLSKHDQIVSGIDWSRSSNKIVTVSHDRNSYVWTQEGHDWVPTLVILKLNRAALCVQWSPKENKFAVGSGAKSVCICYYEQDNNWWISKVVRKKHESSVTSVAWHPNNILLATTSTDGKCRVLSTFIKGVDTRGSHASTSTDWKFGEQIAQLDLSSMWAFGVRWSPSGKTLAYAGHNSMIYFIDDVETSPAAQNLALRDLPLRDILFLSERTVIGVGFDCNPMIFSADETGLWSFVRYLDERKVTTSTSRASQLSEAFGKLYGQSKQVASSDTVEPSKPRGGVHENCITCIVPLRKGNDSIVKRFSTSGLDGKIVVWDAENHIDIKK

SEQ ID NO: 28997 - protein, 216 aa, Oryza sativa (japonica cultivar-group)
MAGATAAGAAAAAAGTGAGSPCGACKFLRRRCVPECVFAPYFSSEQGAARFAAIHKVFGASNASKLLSHLPVADRCEAVVTITYEAQARLRDPVYGCVAQIFALQQQVAILQAQLMQARAQLACGIQSSSHSPVSWPDSGSISALLRQDMARRPPGGALDDCFGGGGALLPELMAAGFKDDVAAVQMQQHCSKAVDAGELQYLAQAMMRSTSNYSQ

SEQ ID NO: 28998 - protein, 306 aa, Oryza sativa (japonica cultivar-group)
MRPPRGRGFGRGGRGDGGGRSGGGGRGFGRGGDSGGRGGRGRGGGRTPRGRGGGRGGGRGGMKGGSKVVVVPHKHNGVFIAKAKEDALCTKNMVPGESVYGEKRISVQNEDGTKVEYRVWNPFRSKLAAAVLGGVDNIWIAPGTRVLYLGAASGTTVSHVSDIVGPTGLVYAVEFSHRSGRDLVNMAKKRTNVIPIIEDARHPARYRMLVGMVDVIFSDVAQPDQARILALNASYFLKNGGHFVISIKANCIDSTMPAEAVFASEVEKLKADQFKPSEQVTLEPFERDHACVVGGYRMPKKQKGTS

SEQ ID NO: 28999 - protein, 362 aa, Oryza sativa (japonica cultivar-group)
MLRQTHDSYGFERSHRGSAEKLLSESRFSQREPMPLTADSSDLRQRLLKQRRLNNPRSGQVSDRHNVYPEDERHDRHRQRGEEQASNDGVSSSRLRGRIRLPAETTFDRLGLQPEKERDRGPRARLSPPSQTDLRGKLHDRLKAKPNEDVSGNVQSSLSKANEDAESLNFAGPKSLAELKAKKVAGSLMKSSRSLTGPVRMTSEIVTIKDSSDPVLFDGPKPLNAILKRKREADSGNATDFGSKREEHSGGDEEGSQNDFRNIEDDIVGMNTEGNGEEAFQPEDDVVYGDSLSPADDIAAEAADDASRELEEQQDVETAEEYDYEMDDVNAAEENDYQEYEDEDDDLEDDDDFARKVGVMIT

SEQ ID NO: 29000 - protein, 448 aa, Oryza sativa (japonica cultivar-group)
MTRKKERSGWGSLFRGCLSGGGAAGSRKVRPGPRTAAAAAAKHGGGASSAAAQRLSFTDVMSTASEQELSVSLVGSNLHVFTVGELKAATQGFLDGNFLGEGGFGPVYKGNVADKAKPGLKAQPIAVKLWDPEGAQGHKEWLSEVIFLGQLRHPNLVKLIGYCCEDEHRLLVYEYMAKGSLENHLFKKFPSMLSWSTRLNIAVGAAKGLVFLHDAEKPVIYRDFKTSNILLDPEYKAKLSDFGLAKDGPEGDDTHVSTRVMGTHGYAAPEYILTGHLTAKSDVYSFGVVLLEILSGRRAVDKTRPSREQHLVEHMRSWLKDPQKLSRVMDPALEGQYFATAAHKAALVAYKCLSGNPKNRPDMCQVVKDLEPLLNVTDDVSDESVAPIAPVREDNAVRKERTARRRPGERDGGKLRQSKMRSPQKVVRRRPGQSEEFWVWHMPGEVKC

SEQ ID NO: 29001 - protein, 203 aa, Oryza sativa (japonica cultivar-group)
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNSSTVVALAGNKADLLETRQVQIEEAKTYAQENGLFFMETSAKTATNVNDIFYEIAKRLLQGQPAQNPQAGMVLSQRPNERLVSSASCCS

SEQ ID NO: 29002 - protein, 257 aa, Oryza sativa (japonica cultivar-group)
MADSMVSSFWGPVTSTTELCEENYAHSSYIAEFYNTVSNVPCVLLALVGLVNALRQGFEKRFSVLHISNMILAIGSMIFHATLQHVLQQSDETPMVWEILLYLYVLYSPDWHYRSTMPTFLFLYGAAFAVVHFLVRFQVVFKLHYVGLCLLCIPRMYKYYIQTKDMAAKRLAKLWVLTLSLATLCWLFDRMFCKKLSHWYVNPQGHAWWHILMGFNSYFANTFLMFCRAQQRGWEPKITHLFGFLPYVKIQKPQKRE

SEQ ID NO: 29003 - protein, 420 aa, Oryza sativa (japonica cultivar-group)
MGCCSCFGFLRKPRVSVSRPRDADGILSEDLLNHKSAEDPDGSFYTGDDPDRSFYDRDDLDRSFYNGDDPDRSFYDGDDPDHLYGSDDGQPRKRSEDIILSRAQNGFACRESLVKETKKVFRSEDENGSKMVNQYVHLGKIGSGSYGKVVLYRSMKDGKLYAVKVLNKSYMMKVRVVRSETAMTDVLREVSIMKMLDHPNIVNLIEVIDDPNADKFYMVLEYVEGKMVCDNGLGEATSRNYLRDIISGVMYLHSHNIIHGDIKPDNLLVTSTGSVKIGDFSVSQIFEDDDDLLWRSPGTPVFTAPECCQGSAYHGRAADTWAVGVTLYCMITGHYPFLGDTLQETYDKIVNDPVQIPDNMNPQLADLLERLLCKDPANRITLQAVGEHPWVAGDQGPVVEYFCRCGFGRRKRDDLKGEVQ

SEQ ID NO: 29004 - protein, 399 aa, Oryza sativa (japonica cultivar-group)
MEVVEVREYREDRDRAAVEEVERECEVGSSGGGEAKMCLFTDLLGDPLCRIRNSPAYLMLVAETANGGGGGNGREIIGLIRGCVKTVVSGGSVQAGKDPIYSKVAYILGLRVSPRYRRKGVGKKLVGRMEEWFRQSGAEYSYMATEQDNEASVRLFTGRCGYSKFRTPSVLVHPVFGHALQPSRNAAIRKLEPREAELLYRWHFAAVEFFPADIDAVLSKELSLGTFLAVPAGTRWESVEAFMDAPPASWAVMSVWNCMDAFRLEVRGAPRLMRAAAVATRLVDRAAPWLKIPSIPNLFAPFGLYFLYGVGGAGPASPRLVRALCRHAHNMARKGGCGVVATEVSACEPVRAGVPHWARLGAEDLWCIKRLADGYNHGPLGDWTKAPPGRSIFVDPREF

SEQ ID NO: 29005 - protein, 140 aa, Oryza sativa (japonica cultivar-group)
MALEEAGEGWFLCDADGVGFEGRVVAVPGDEELRPGQIYFVLHPEARRRSLTREEVAALAVKASAALVKAAAAAAASSPAGGRRRRGAVAPLVFPLPEEDDTAVAAAAPKPAVARKRRVASRGVRASKFSPDLTAIPESE

SEQ ID NO: 29006 - protein, 435 aa, Oryza sativa (japonica cultivar-group)
MPPPPLLLAAAVAAAALPPPAAARRHASPPPPQPQHPDKAGGGNGVLTTALVAAAVLLVVLLLYLCVAIAVRRYRGRGPAPAAGPTNAAARAAAFLRRNGLHQHRPSFTYEQLRAATAGFDPSRKLGDGGFGTVFLAYLPPGGRPAAVKRLHVPPSPSPSFPSASATITKSFCNEVLILSALRHPHLVRLHGFCADPRALLLVYDFVPNGTLSHHLHRRCGVTAAAPPPPPLPWRTRLAMAVQIASALEYLHFGVKPAVVHRDVTSSNIFVEADMRARLGDFGLSRLLSPPDACATGAGRELVCCTAPQGTPGYLDPDYHRSFQLTEKSDVYSFGVVVLELVTGLRPVDVGRERRDVTLADWVVAKIQVGELREVVDQPVLGEGAGVMASVEAVAELAFRCVAPDKDDRPDAREALAELRRIQGMLPEVSGLKGS

SEQ ID NO: 29007 - protein, 210 aa, Oryza sativa (japonica cultivar-group)
MDPEVKDSRPSRSPGEPNLFLQWGSRKRLRCVKTRDDGSPSPARTDVLRRTIPRVNRPLGGDVAPFRSPRRPSTLNRRKTEPFVSDNRHSMSLSPEKDRYYSTRGSPFPFEGNGFDFGGGMEEKGTTALPRFFISLSNKEKEEDFMAMKGCKLPQRPKKRPKLMQKCLLMVSPGAWLSDLSHERYEVREKKCARKRARGLKALCNESDSE

SEQ ID NO: 29008 - protein, 383 aa, Oryza sativa (japonica cultivar-group)
MSCGSDGGCRDGGGSEEFRRPRPSKVAAGDLVEPARCSDAAASPASWIDKKLLVDPKNLFIGSKIGEGAHGKVYKGKYGEQIVAIKVLNNGTTPEEKATLEARFIREVNMMCKVKHDNLVKFIGACKEPLMVIVSELLPGMSLKNYLNSLRPSQLDIHTAIGYALDIAHAMECLHANGIIHRDLKPDNLLLTANRKKLKLTDFGLAREETVTEMMTAETGTYRWMAPELYSTVTLQRGEKKHYTNKVDVYSFGIVLWELLTNKMPFEGMSNLQAAYAAAFKQARPPLPEETPQELVFIVQSCWVEDPAMRPSFSQIIRMLDAFLMTIPPPPPSESNEDVESEETASSLNGKNSAVSSIVSRATSKLSVVRHLFASKKAGNGRT

SEQ ID NO: 29009 - protein, 441 aa, Oryza sativa (japonica cultivar-group)
MMKPQHGGMAGHGGGRTRSPFLTSYALTLAFITFVSVLYFKDFSSTLHQPFLTRPPPHRRQIARPRAPSHHHGGGSSSGGGDVVPPFAVGAAAAAGCDVGVGEWVYDEAARPWYEEEECPYIQPQLTCQAHGRPDTAYQHWRWQPRGCSLPSFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 29010 - protein, 334 aa, Oryza sativa (japonica cultivar-group)
MASGGGGGGEGETVLVTGASGFIGSCLVRRLLARGYSVHAAVLNPDDKAETDHLHALAAAGGGEGRRLRVFPGDLLDGAALLAAARGCSGVFHLASPCIVDRVLDPQAQLMVPAVEGTLNVLRAAKDAGGVRRVVVTSSISAIVPSPGWPAGEVRDERCWTDLDYCEKNGVWYPASKTLAEKAAWKFAEENGLDVVVVNPGTVMGLVIPPTINASMAMLVRLLEGCTEEYADFYMGPVHVEDVALAHILLYENPSASGRHLCVQSIAHWSDFASKVAELYPEYKVPKLPKETQPGLVRAEAASKKLIALGLQFSPMEKIIRDSVESLKSRGFIS

SEQ ID NO: 29011 - protein, 427 aa, Oryza sativa (japonica cultivar-group)
MAAVQLLPLPPAAPPQPRRGKPGCWNTPPAPPKVCHYWKSGRCSRNPCRFLHTDAPDPAPPIAAVNTRSNTWVNPSCVAANSDGKGRAPPVQPAKRQVEAPPETPAKRRCGGGAWCVGDGFCGVARLKGHAKAVTGFALPEGSDKLFSGSLDSTVRAWDCSTGQCVRVEEMQEGEVHKLIAMGPWVLAGVRGAVKAIHTGTGKELRLRGPASQITAMLAEDEDHLFAGAEDGAVFMWRMNQEQQSFDEVAALTGHYKAVVSLAQGKGALYSGSTDGSIRVWDLDTHRCIYSFAGHSSTVTALLCWERFLLSSSDDGTVKVWQWKPDHDDLDLEVHYTHKEDERVVSMDGTYDADEKPVLLVSRGDGVVRVYDLPSLKKRGDIICDDEVRTISVRSRGVVFTGDASGEVRVVKWTSLSDAAESYLAMA

SEQ ID NO: 29012 - protein, 180 aa, Oryza sativa (japonica cultivar-group)
MASSGVGGVPGSPCGACKFLRRKCAAECVFAPYFCAEDGAAQFAAIHKVFGASNAAKLLQQVAPGDRSEVAATVTYEAQARLRDPVYGCVAHIFALQQQVQVAQAKTQVAQTLAAAGMLTAGNPLLQHQQQQQQAWQIEHESTMTSTQSSGCYSAPRSDGSTSLQDMYCFGEQEEGSYSR

SEQ ID NO: 29013 - protein, 287 aa, Oryza sativa (japonica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVRIVHSIDVSLVGVAGLLILVSRRVFEQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 29014 - protein, 1202 aa, Oryza sativa (japonica cultivar-group)
MASWENLGDVATVVQLTGLDAVRLISMIVKAASTARLHKRNCRRFAQHLKLIGGLLEQLRVSELKKYPETREPLEQLEDALRRAYLLVHSCQDRSYLYLLAMGWNIVYQFRKAQNEIDNYLRLVPLITLVDNARVRERMEYIERDQCEYSFDDEDKEVQDALLNPDPSTNPTVVLKKTLSCSYPNLPFNEALRKESEKLQVELQRSQSNMDMGQCEVIQHLLGVTKTVASSIPEKCATPKVSEKADSNHTKVSEDSAKTYHDDSPKKQKDACTAPRFENILFPLWNILKDCFNCEEQAHGGCIDDFLSHLMCCCCALVQEWREVEIRGAYDCHLLLSQAAAEALDNESMLDEYKVQHIIGRDRNAKSPRSEAAFSVAVRLHWAKSEIQQLQRLMLSALSNSKTGKSIDGLTEPRLRLPPDHAAETPNTRPATNVPYRKEVPAILLHCRCPGDQRIKLRTPCRQQENLLSTGHRFPPLEKIKGQFGSWPMLGLPIYGSSKHSSCTDSGVLSCCEKHHRLLQEKMENTRQQYMHHFLLTKKAVVVLCLLIIIWLRNKYRRRSSRKGVKYGPLVHRDVWRTSELIRLINISDRTCTQQLRMSRAVFYKLCARLRNKGLLVDTFHVSVEEQVAMFLKKVGQHHSVSCVGFSFWRSGETVSRYFRIVLRAMCEIARELIYIRSTNTHSKITSKKNKFYPYFKDCIGALDGTHIRASVPAKKVDRFRGRKPYPTQNVLAAVDFDLRFIYILAGWEGSAHDSLVLQDALSRPNGLKILEGKFFLADAGYAARPGILPSYRRVRYHLKEFRGPQGPHGPQGPKCPKELFNYRHSSLRTTIERAFGALKNRFKILMNKPFIPLKAQSMVVIACCALHNWILENGSDEFVNDEKTCMGKRTEGTSEEGGSREKYISWSDDATQFMLEWYIELRKDKPSTFKWKKQHHQQCAIALKDKFGIRVTKSQVHRHLRLCKEKWSWICVALGKSGYGFDAASCKFNIDPSEKDSNKLGTTKYNYLTKPIKFFHLFEELFVGCSKADGSLAIDQFNANGSSDSDGSGSIKELEEYIFALEDGGHDSDTIARNSPTTDGTYSGHKRRSVKSPTKKTLKHKTSHKEEEQDELAGSILKLANKLASVEQSIVGDPNASIWRRIEDLTIPASDKIELATFLAKPEQEIFRSYLRVASDASFQAWVIDYLERKCACNGGNGCTM

SEQ ID NO: 29015 - protein, 274 aa, Oryza sativa (japonica cultivar-group)
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEAIKGIKTSQKPVAVPA

SEQ ID NO: 29016 - protein, 444 aa, Oryza sativa (japonica cultivar-group)
MAKQAWSSLFGCFTSHHDGGGKRKKGGGGGKKAKKKVAAAASQKQRKLQSRLSFSDLSFGGMVSPEDLSLSLAGSNLHVFTIAELRAVTRDFSMTNFIGEGGFGPVYKGYVDDKLKPGLRAQPVAVKLLDLEGTQGHNEWLLKFQHGNRAKGLEFKSCQLTEVIFLGQLRHPHLVKLIGYCYEDEHRLLVYEFMTRGSLEKHLFKKYAASLPWSTRLKIAIGAAKGLAFLHEAEKPVIYRDFKTSNILLDSDFKAKLSDFGLAKDGPEDDETHVSTRVMGTQGYAAPEYIMTGHLTAKSDVYGFGVVLLELLSGRKSVDKSRPAREQNLVEWARPYLTDARRLGRVMDRNLAGQYPAKAAQKAAALAHRCVSLNPKSRPHMSAVVEALEPLLALDDDCLVGTFVYVAPPDDVAANGDGSSKRRAGRRRSDGAAAAAAADGVQRE

SEQ ID NO: 29017 - protein, 476 aa, Oryza sativa (japonica cultivar-group)
MDFSGDVKPAIHRPSVAAARGGGNGGAIPLLRGWQAFRRSGAPARLLCFEGGAWADVAGEVVGLLRRAFMEGKAVCEAACGGRVFLFDFMRMVRIDEATAEEAALGWIDDRGACFFPAPEGGRKRKRERDEAGSEVKGEDRRRRQPAAEEEDGDEASSGVEERSGESRPEADEPDRKKARGTLWGKAVRLDEADKFYKVVEKLFVSRMAPVAAARGVAITAVHKVAQGPRARAFHLQGQLLAAARGVGDGSNAKFAWYGAPAADVAAAVEHGFGRTNGQFLGGRAHGDGVHLSPPQYPHASAMLTKPDENGEAHIVLCRVLMGRPEAVPASSPQFHPSSDEYDSAVDNLENPRWYVVWSTDMNTRILPEYVVSFRWPNLPQMEGSSGLGSKLKKPSPAATRDMFPMLLTEIQRFVPSPKLQTLQRTYNCFKLTQNNPFALMIMPRGQMKKDQFIRFLRSHIGDNVLTTVAKKLRGY

SEQ ID NO: 29018 - protein, 389 aa, Oryza sativa (japonica cultivar-group)
MLRSRARLPLRLPPAVRRCRSPSAAKEKDATSVKPDKNTAEGPQEMPRYDDHYGSTRLYVGRLSSRTRSRDLEYLFGRYGRSCVFDLNDLVEGFSVFYTTREWKLQVGDAFEYLSHDGLLFGNHWCRIREVELKRDYAFIEFSDPRDADEARYNLDGRDVDGSRILVEFAKGVPRGAAGGSREYMGRGPPPGTGRCFNCGIDGHWARDCKAGDWKNKCYRCGERGHIERNCQNSPRNLSRSRSRSLSGSPRGRRDRDDRRSRSLSYSRSPRRSISPAANGKERNPSPNGRRSPRSPQDRVSPPPKDNDERNGDSPWGRENSRSPSDGYRSPVAANGRSPSPRNNGSPSPMDNNSRSPRDNGSPSPRDGNGDGGSRGGSRSPRASESPEA

SEQ ID NO: 29019 - protein, 446 aa, Oryza sativa (japonica cultivar-group)
MATVSSLPSPAFLAADPAAALPSATILRFPPNFVRQLSTKARRNCSNIGVAQIALLGSDASLAVHAGERLGRRIATDAITTPVVNTSAYWFNNSQELIDFKEGRHASFEYGRYGNPTTEALEKKMSALEKAESTVFVASGMYASVAMLSALVPAGGHVVTTTDCYRKTRIYMETELPKRGITMTVIRPADMDALQNALDNNNVSLFFTETPTNPFLRCIDIDLVSKMCHSKGALLCIDSTFASPINQKALTLGADLVIHSATKYIAGHNDVIGGCISGRDELVSKVRIYHHVVGGVLNPNAAYLILRGMKTLHLRVQCQNNTAMRMAQFLEEHPKIARVYYPGLPSHPEHHIAKSQMTGFGGVISFEVAGDFDATRRFIDSVKIPYHAPSFGGCESIIDQPAIMSYWDSKEQREIYGIKDNLIRFSIGVEDFEDLKNDVVQALDKI

SEQ ID NO: 29020 - protein, 467 aa, Oryza sativa (japonica cultivar-group)
MELLALVTVLLLAHAVAYLAWTAAARRRQSRCYLLDYVCHKPSDDRKVSTEAAGAVIERSKRLSLPEYRFLLRVIVRSGIGEETYAPRNVLDGREGEPTHGDSLGEMEDFFGDSIAELFARTGFGPRDVDVLVVNASMFSPDPSLASMIVHRYGMREDVAAYSLAGMGCSAGLISLDLARNTLATRPRALALVVSTESIAPNWYTGTDKSMMLANCLFRCGGASVLVTNDPVLRGRAKMELGCLVRANIAANDDAHACALQREDDDGTVGISLSKALPKAAVRAFAANLRRLAPRILPITELARFAAQLLITKKLLRRRATAATATKHTGGDGPRINFKTGVDHFCLHPGGTAVIEAVKRSLGLDDDDVEPARMTLHRWGNTSASSLWYVLSYMEAKGRLRRGDKVLMVTFGSGFKCNSCVWEVTGDMADKGAWADCIDAYPPENTANPYMEKYSWINDVDGDSLII

SEQ ID NO: 29021 - protein, 391 aa, Oryza sativa (japonica cultivar-group)
MVDVDRRPPLPHGLPRPPSHAAGLRRLSTRASAPTTPRASPATPSPSSAAAAAPSPSALVAHLAAAGVSVLPGLSDPELAHAEAALGGLQLPPDLRDLLAIGVPSGDGFPDYRSPAGLRLLRFAAEEVPAAVAAALPGRRAGGRGRWCSSSPPPLVPLYGRHYVPAVPCLAGNPVFHVSDTGVAVAGANIAAFLLRAFAAEPPRGAPLRRQLSAPMPPPAPSPAPSTARRSLDSATGKAPRWIEFWTDAAAAGDRFVEVSTCTSTRANAAPQWVRSYLEWAGSVLRRGGWGGGEVEEMTTGSGGGGEEAVALALTVDRCCGELGRAGWGAEEVVEALGALLGPRTRKRPAVALPPDVAARVGRLAEAVSRAVFTGSGSGSGGNPEPAKRPF

SEQ ID NO: 29022 - protein, 499 aa, Oryza sativa (japonica cultivar-group)
MGALALALVVVVVVHVAVNAFGRRRLPPSPASLPVIGHLHLLRPPVHRTFHELAARLGPLMHVRLGSTHCVVASSAEVAAELIRSHEAKISERPLTAVARQFAYESAGFAFAPYSPHWRFMKRLCMSELLGPRTVEQLRPVRRAGLVSLLRHVLSQPEAEAVDLTRELIRMSNTSIIRMAASTVPSSVTEEAQELVKVVAELVGAFNADDYIALCRGWDLQGLGRRAADVHKRFDALLEEMIRHKEEARMRKKTDTDVGSKDLLDILLDKAEDGAAEVKLTRDNIKAFIIDVVTAGSDTSAAMVEWMVAELMNHPEALRKVREEIEAVVGRDRIAGEGDLPRLPYLQAAYKETLRLRPAAPIAHRQSTEEIQIRGFRVPAQTAVFINVWAIGRDPAYWEEPLEFRPERFLAGGGGEGVEPRGQHFQFMPFGSGRRGCPGMGLALQSVPAVVAALLQCFDWQCMDNKLIDMEEADGLVCARKHRLLLHAHPRLHPFPPLL

SEQ ID NO: 29023 - protein, 213 aa, Oryza sativa (japonica cultivar-group)
MAITRRHPPLLLLFLAVAAAATIAGASQSTRPRPAVSPAAAADFVRRSCRATRYPQVCERSLMPQAPAVGRSPRLLAQAALTVGADRARSCSGYLGGGGSSSSSKRSGGGGRGGAVGDCADTLRDAEERLRQSAAEMSRMGRSGSPRFAWRLSNVQTWASAALTDASTCLDSLATYAAPGIDVDALRKRVGAVSQATSNALALVNNLDPHHHL

SEQ ID NO: 29024 - protein, 497 aa, Oryza sativa (japonica cultivar-group)
MAALLWKDIHIQTEDVDAFIKDRGSMGVIPFKTLINLCGTNMQFTLNVTLEESIKERRDKLVTKVHCMIQGYTSSKIHLSHGMKIVDAIERLGVGYHFHEEIGMFMRVLNDTPARENDMAEAALRFRLLRQHHYNAPSDVFGCFLDKNGDFKETLRHDVDALLSLYEAAHLGKCDEDLLKSAVVFTTGCLSAMAENDQLPQPLLEKVEHALTSPTQRRMKRLEAKLYISIYENDEDSNHDILELAKLDFHILQQMHRDEARRFSLWYKELNVRSTLGPYIRERPVECYFWSLGVFYEPQYAKARMMFARLIKIFSLFDDTFDSYGTLEELHLFNNAVQSWDEGGAKQIGDYFGYVMSLLSKTLNEFVVDGASPLGIDCTKKTIKEASRCMLQEIIWREEGQWEKDGGGVPTAVECYMKEYGVTVQEAKKALWCLVEEQWRSINQEFLRNTTVPVPLLTRVINLARLMETLYKTTNGYTHCSGVTDLISNVLDTCVSH

SEQ ID NO: 29025 - protein, 206 aa, Oryza sativa (japonica cultivar-group)
MAEEKVLAAPATVDGGMQSSGDLQASSAAAARVRPVETLLRAAPLGLCVAAMAIMLRNSVTNEYGTVSYSDLGGFKYLVYANGLCAAYSLASAFYIAVPRPATLSRSWVVFLLDQVFTYLILAAGAASAELLYLAYNGDKEVTWSEACGVFGGFCRQARTSVAITFASVACYILLSLISSYRLFSAYDPPQPSLGNKGVEIAAFPR

SEQ ID NO: 29026 - protein, 1056 aa, Oryza sativa (japonica cultivar-group)
MADNGNAKPGGGGSGAYTINLDNFSKRLKVFYDHWKEHNSDLWGSSNAIAIATPPPSEDLRYLKSSALDVWLLGYEFPETIIVFMHKQIHFLCSQKKANLIGTLKKAANDAVGADIVLHVKAKNDSGVGLMEDIVRAVCAQSKSDDPIVGHIAKEAPEGKLLEAWADKLSSSSVQLTDITNGFSELFAMKDTSEITCVKKASYLTSSVMKNFVVPKLEKVIDEERKVTHSSLMDETEKAILDPLKVKVKLKAENVDICYPPVFQSGGKFDLKPGASSNDDYLYYDSASVIICAIGARYGNYCSNMARTFLIDATPTQIKAYETLMKAHEAALEALKPGNRMSAVYQAAVDVIEKNAPELLRNLTKSAGTGIGLEFRESGLNLNPKNDRIIKAGMVFNVSLGLHNLQAEKKSEKTKQYSLLLADTCLVPLENLTASCSKLVKDVAYSFNDEDEVLPVKKVEVNAKEALPPTKATLRSDNQEMSKEELRRQHQAELARQKNEETARRLAGVGSGSGDGRGPSRSSNELVAYKNVNDVPYARELVIQVDQKNEAVLLPIYGSMVPFHVSTVKSVTSHQDNRTCTIRIFFNVPGMPFSNDSNLKSQGAIYLKEITFRSKDPRHSSEVVQQIKTLRRQVASRESERAERATLVTQEKLQLTSNRNKPVRLSDVWIRPAFGGRGRKLTGTLESHVNGFRYSTSRADERVDIMYGNVKHAFFQPAEKEMITLLHFHLHNHIMVGNKKTKDVQFYVEVMDVVQTLGGNRRSALDPDEIEEEQRERDRKNRINMDFQNFVNKVNDHWSQPQFKGLDLEFDVPLRELGFHGVPYKASAFIIPTSTCLVELIETPFLVVTLSEIEIVNLERVGFGTKNFDMAIVFKDFKKDVLRIDSIPSTSLDAIKEWLDTTDLKYYESRLNLNWRPILKTIIDDPQKFIDDGGWEFLNMEASDSETEETEESDQGYEPSDAEPESESEDEDSDSESLVESDEDDEDDSEEDSEEEKGKTWEELEREASNADRENGAESDSEEERRRRKVKTFSKSRPPPERSSFKGGPSKKPKFR

SEQ ID NO: 29027 - protein, 511 aa, Oryza sativa (japonica cultivar-group)
MEDKVVLAMGASILLVVVVSKLMISFAAKPRLNLPPGPWTLPLIGSIHHVVSSRESVHSAMRRLARRHGAPLMQLWFGEVGTVVASSPEAAREVLRSHDLAFADRHLTAAAAAFSFGGRDVVLSPYGERWRQLRKLLTQELLTASRVRSFRRVREEEVARLMRDLSAAATAGAAVNLSEMVTRMVNDTVLRCSVGSRCEHSGEYLAALHAVVRLTSGLSVADLFPSSRLAAMVSAAPRAAIANRDKMVRIIEQIIRERKAQIEADDRAADSKSCACSLDDLLRLQKEGGSPIPITNEVIVVLLMDMFAGGTDTSSTTLIWAMAELIRSPRVMAKVQSEMRQIFDGKNTITEDDLVQLSYLKMVIKETLRLHCPLPLLAPRKCRETCKIMGYDVPKGTSAFVNVWAICRDSKYWEDAEEFKPERFENNDIEFKGSNFEFLPFGSGRRVCPGINLGLANMEFALANLLYHFDWKLPNGMLHKDLDMREAPGLLVYKHTSLNVCPVTHIASSCA

SEQ ID NO: 29028 - protein, 507 aa, Oryza sativa (japonica cultivar-group)
MVERAEKLKDDVRTMFETCDSTEGRLQLVDAIQHLGIDHLFKEEIEYSLSEINASEFISSSLHDVALRFRLLRQHGFHVSPDVFNKFKGDDGRFVSGITNDPRGLLSLYNAAHLLTHDEPELEEAISFATQHLASLSSGTDLNPHLIDQINRALDVPLPRTYRRMETLCYMPEYRQEEGHIPILLELAMLDFNLLQHVHLKELKAISEWWKDLYGYMGLSYIRDRVVESYVWSYVVFYEEDSALARMIFTKIIAFIILMDDTYDSYATIQECRKLNEAIQRWDESATAFLPEYIKKFYSALLKTFKEFEIHVEDDGQYRIDHTKKAFQNLSAYYLQEAEWSYQNYKPSFEEQVALSTVTSTVPLLCVSTTVGRGDALTNEAFEWAANDIGAKIACAKITRFMNDIAAFKQRGRKNRGDVVSTVECYMNENKVTSEGAFTKIDLMIEDEWRTINQALCEHRELLPAVQQVLNLAICATFFYGKRKDAYTFSTHLQETVESLFVRPVSI

SEQ ID NO: 29029 - protein, 284 aa, Oryza sativa (japonica cultivar-group)
MMLIAKKPLLLLLLLLVLLVLEPRSSAEANLVGVNGGETDERRLESLVYDELPFSQLGLGFPTTVVAGGSENDVEEVVQAWYMDDDDNAEEDQRLPHRRQPDDLLPLAKLLDLGLVAMRLDADNHEHDENLKIMREQRGYLHMDIVELTPEKMPNYEVMIKRFFEEHLHTDEEVRYCLDGSGYFDVRDENDKWVRVSVRKGALIVVPAGIYHRFTLDTNNYIKMGPGGLLFGFLQTMRLFSGGPDWTAYNRPHDHLPERKKYLEALHNRTPRFGQLHRIRSKME

SEQ ID NO: 29030 - protein, 396 aa, Oryza sativa (japonica cultivar-group)
MAQPKAASAAAQLSLAASACIAGAEAAAMVGREGAPAMVAAAAAAAMVVIGHRGKGMNALGSADPRLREVKENSLRSFHAAARVAGVSYVEFDVQTGASTIVQLNLNQMVTKDGYPVIFHDDFIFTEQDGEICGRRVTDLRLDEFLSYGPQKDQSKAGKPLFRKLNDGRVLRWDVQSDDALCTLQEALDGVDRRVGFNVELKFDDDVVFEHAKERPIFFSSFQPDAARIMRKLQDRYPVYFLTKGGTQVFADERRNSLEAAVKLCVAGSLRGIVSEARAVLRQPSAIGRIKEAGLSLLTYGQLNNVPKAVYLQQLMGVDGVIVDLVAEIAAAVSEFAAAAAAAVPVPERDSSSSYMDGGGDVGLLEMTSPAARTTASFSRREDVSFLLRLTPELVQ

SEQ ID NO: 29031 - protein, 476 aa, Oryza sativa (japonica cultivar-group)
MAATEATTIEDTPTWIVAAVCSAIVLISFAFERSLHYLGKALERRRRTLYEALLKLKEELMLLGFISLLLVVFQEPIQRICIAESLMGHWLPCRSDGKASSHHGVAAASAAVVSGAGARRLLGEGTAGSGHCSSKGKVPLLSLHAIEQIHIFIFVLAITHVVLSAVTVLLGLLQMRRWRHWENAIKADGDFGPKMINRAQQFKFIQDRYKGFDKVTMVIIWMRSFFKQFYGSVTKDDYTAMRLGFVMEHFRGHPKFNFYDYMIKALEKDYKRVVGIKWYLWIFVMIFLLLNITGWHSYFWISLIPLVLLLLIGTKLEHIITQLAYEVATKHTAVEGDIAVSPSDNLFWFHSPRLVLALLRFILFQNAFEFAYFIWTMATFGFNSCIMDRLPYRVSRIVICVVVQVLCSYSTLPLYAIVSHMGSSFKSAVFSDDVADNLRKWADEARRRTGRAAAGVGCLGAAAGSSRREGIHIQNM

SEQ ID NO: 29032 - protein, 341 aa, Oryza sativa (japonica cultivar-group)
MGHVDASAAAAAARDAKKKRGNRSSAKLKQCKLDARREQWLSQDCSNSDPPAFWIGIVKDGKEAKASTSPTGTEPNAGSMTVPSPHPPLPRRRLDVRSKGGDPEEDREERGAARQELGSSYLDSPVHSPSSDNSGSVGGMHRKHYNNGGGLNLSSSSSVWSSSRSVSEAEDDDTGGPEEENGVLDDWEAVADADALTVDDCHSHQSSGHVAPPAAPNVCTAPANQTGRQDPIQRTKAWAPDDIFRPQSLPSISRQVSFPASIGNGWMGAAQQANLSTPLTCPICCEDLDLTDSSFCPCPCKFCLCLFCHNKILEADGRCPGCRKEYVAARLSRSCSMGPRY

SEQ ID NO: 29033 - protein, 505 aa, Oryza sativa (japonica cultivar-group)
MAAPSAIPRRGLFIGGGWREPSLGRRLPVVNPATEATIGDIPAATAEDVELAVSAARDAFGRDGGRHWSRAPGAVRAKYLKAIAAKIKDKKSYLALLETLDSGKPLDEAAGDMEDVAACFEYYADLAEALDGKQRAPISLPMENFESYVLKEPIGVVGLITPWNYPLLMATWKVAPALAAGCTAVLKPSELASLTCLELGGICAEIGLPPGVLNIITGLGTEAGAPLASHPHVDKIAFTGSTETGKRIMITASQMVKPVSLELGGKSPLIVFDDVDIDKAVEWAMFGCFANAGQVCSATSRLLLHEKIAKRFLDRLVAWAKSIKISDPLEEGCRLGSVVSEGQYQKIMKFISTARCEGATILYGGARPQHLKRGFFIEPTIITNVSTSMQIWREEVFGPVICVKEFRTEREAVELANDTHYGLAGAVISNDLERCERISKAIQSGIVWINCSQPCFVQAPWGGNKRSGFGRELGQWGLDNYLSVKQVTKYCSDEPYGWYRPPSKL

SEQ ID NO: 29034 - protein, 341 aa, Oryza sativa (japonica cultivar-group)
MSSSNNGGGGDKKPASGGRGGPTIRTLADISRGPSGFPGGGGGGGSDSDEPQEYYTGGEKRFVSFGSGIVPHTGRLFRCPQNSDYISDQLSGMLVQDPTRRNTVDSIFEQARQMGALQDQPPPFEDQSSSSRSFTGTGRLLSGETAPAAPPPPGNVLHNIQFWNNGFTVDDGPLRDYDDPANADFIESIKKSQCPQELEPADRRTPVHVNVIKRLEDYQAPLRPPSPFQGVGRTLGGGSSAEESQAPAPATQEPRRSVGIVVDDSLPFTSIQLRLADGTRMVARFNMHHTVGDIRSFIDASRPGATRPYQLQTGFPPKQLADPAQTVEQAGLANSVIIQKM

SEQ ID NO: 29035 - protein, 509 aa, Oryza sativa (japonica cultivar-group)
MASLQAPEFLASCLLLATILFFKQLLAPSSKQRAASPSLPRPRGLPLIGNLHQVGALPHRSLAALAARHAAPLMLLRLGSVPTLVVSTADAARALFRDNDRALSGRPALYAATRLSYGQKSISFAPDGAYWRAARRACMSELLGPPRVRGLRDAREREAAALVAAVAAAGASPVNLSDMVAATSSRIVRRVAFGDGDGDESMDVKAVLNETQALLGGLWVADYVPWLRWVDTLSGKRWRLERRFRQLDALYERVIDDHLNKRKHASDEEDDLVDVLLRLHGDPAHRSTFGSRSHIKGILTDMFIAGSDTSAVTVQWAMTELVRNPDVLAKAQHEVRRVVAAGDKVREADLPELHYLRLVIKETLRLHPAAPLLVPRETTEPFRTAHGVEIPARTRVVVNAMAIHTDPGVWGPDAERFVPERHRDDADGCAQQHDGFALVPFGIGRRRCPGVHFAAAAVELLLANLLFCFDWRAPPGREVDVEEENGLAVHKKNPLVLIATKSKRNTGGH

SEQ ID NO: 29036 - protein, 389 aa, Oryza sativa (japonica cultivar-group)
MDGGVGEEGKQQPHLVLAHKLFLLSHPDVDDLAKVDLRADVLAAVKSDDMASLYESLGAGGVLETDAALLAEMRGRIEEEIRKLDEKIADAEENLGESEVREAHLAKSLYFIRVGEKEKALEQLKVTEGKTVAVGQKMDLVFHTLQIGFFYMDFDLISKSIDKAKKLFEEGGDWERKNRLKVYEGLYCMATRNFKKAASLFLDSISTFTTYELFPYDTFIFYTVLTSVISLDRVSLKAKVVDAPEILAVIGKVPHLSEFLNSLYNCQYKSFFAAFSGLTEQIKLDRYLQPHFRYYMREVRTVVYSQFLESYKSVTMEAMASAFGVTVDFIDLELSRFIAAGKLHCKIDKVACVLETNRPDARNAFYQATIKQGDFLLNRIQKLSRVIDL

SEQ ID NO: 29037 - protein, 174 aa, Oryza sativa (japonica cultivar-group)
MSRDPLVVGHVVGDILDPFNKSASLKVLYNNKELTNGSELKPSQVANEPRIEIAGRDIRNLYTLVMVDPDSPSPSNPTKREYLHWLVTDIPESANASYGNEVVSYESPKPTAGIHRFVFILFRQYVQQTIYAPGWRPNFNTRDFSALYNLGPPVAAVFFNCQRENGCGGRRYIR

SEQ ID NO: 29038 - protein, 506 aa, Oryza sativa (japonica cultivar-group)
MTIDLSMPGSSGLLDDVGGKKHMNFFSNRYVLALTGAAGIGGFLFGYDTGVISGALLYIRDDFPAVRDNYFLQETIVSMALVGAIIGAAGGGWINDTYGRRKSTLVADMLFALGSLVMCAAGGPYILILGRLLVGLGVGIASVTAPVYIAEAAPSEIRGGLVSTNVLMITGGQFFSYLINLGFTEVPGTWRWMLGVAAVPAILQFVLMLFLPESPRWLFWKDEKAKAISVLEKIYDSDRLEEEVELLASSSMHEFQSDGTGSYLDIFKSKELRLAFFAGAGLQAFQQFTGINTVMYYSPTIVQMAGFTSNKLALLLSLIVAGMNAAGTIVGIYLIDRCGRRRLALTSLAGVVVSLAILAMAFILQSSSDICSNALNGACQGALGWFAVAGLALYIAFFSPGMGPVPWAVNSEIYPEAYRGMCGGMSATVNWVSNLIVAQTFLSIVGLVGTGLTFLIIAGIAVLAFIFVALYVPETKGLSFEQVELLWKERAWGNQGNRQSLLGAAP

SEQ ID NO: 29039 - protein, 246 aa, Oryza sativa (japonica cultivar-group)
MGANGHPPPASAAAQNGSHSSGGGGGGDGGGGGANPSPGGTVAALRHDPGLAREWSPEEQSTLDELLVKYASDAPVIRYAKIAMKLPDKTVRDVALRCRWMNKKESGKRKKEDHSSSKKSKDKKEKVSDSSLKPPVHIAGRPNVPPYPLPALPIDDDEISSKAIGGPTGEILETNAQVLSQISTNLSTMQIQDNISLLCQTRDNILRVLKEINDAPDIMKQMPPLPVKINEELVNSMLPRPTVPMQ

SEQ ID NO: 29040 - protein, 135 aa, Oryza sativa (japonica cultivar-group)
MASTACFAIVSKNDIPIYEAEVGSAPKKEDLAYQHQFILHAALDVVQDLAWSTNAMFLKSVDRFNDLVVSVYVTAGHARFMLLHDSRSEDGIKSFFQEVHELYIKIFLNPLYLPGSRITSSHFDTKVRALARRYL

SEQ ID NO: 29041 - protein, 498 aa, Oryza sativa (japonica cultivar-group)
MATCAADLAPLLGPVAANATDYLCNRFADTTSAVDATYLLFSAYLVFAMQLGFAMLCAGSVRAKNTMNIMLTNVLDAAAGALFYYLFGFAFAFGTPSNGFIGKQFFGLKHMPQTGFDYDFFLFQWAFAIAAAGITSGSIAERTQFVAYLIYSAFLTGFVYPVVSHWIWSADGWASASRTSGPLLFGSGVIDFAGSGVVHMVGGVAGLWGALIEGPRIGRFDHAGRSVALKGHSASLVVLGTFLLWFGWYGFNPGSFTTILKTYGPAGGINGQWSGVGRTAVTTTLAGSVAALTTLFGKRLQTGHWNVVDVCNGLLGGFAAITAGCSVVDPWAAIICGFVSAWVLIGLNALAARLKFDDPLEAAQLHGGCGAWGILFTALFARQKYVEEIYGAGRPYGLFMGGGGKLLAAHVIQILVIFGWVSCTMGPLFYGLKKLGLLRISAEDETSGMDLTRHGGFAYVYHDEDEHDKSGVGGFMLRSAQTRVEPAAAAASNSNNQV

SEQ ID NO: 29042 - protein, 434 aa, Oryza sativa (japonica cultivar-group)
MLRAAASRCARGAIRRLSSAASPAAVAAGARRQPPLDEGDWSYHREWWGEDEGPGEGAHTVFRRHSEHGNGVVSVSAYPASRPASDEWTVTERWLQERNARIYPNSFGANQFKILGYQWRVMRFNDHTRQSVAKVMACYRSSGDTGMYLMQQPHCLAVPYVKSMVSAGLTALPCCSYDLHQAVSGQNNMKILCIGHGGGSLPLVLASKFRGAVVHIVEIDPVVASASIDSMGFPSLPVKGLPPEPTKPANGNELLWGGIHDRLFLHIADAEDFVANDSNVYDLVFIDAYDGDDIFPRKLWDAEGTFLKNLEMKVHPVHGTVVVNLHSDSELSVAGVEKTSSVDSILPLGKHVSQVCRAYKQHFGLAFTAAVPWLCNITLVACRDRAIASGARLGLSRRDFVLGKLLSKSNMVEHALDLPFPCLQYIKNGFTLVD

SEQ ID NO: 29043 - protein, 290 aa, Oryza sativa (japonica cultivar-group)
MAKDIEAAAAAEGGEYMAKDYSDPPPAPLIDAEELTKWSLYRAVIAEFVATLLFLYITVATVIGYKHQSDPGANAADAACSGVGILGIAWAFGGMIFILVYCTAGVSGGHINPAVTFGLFLARKVSLVRAVLYIVAQSLGAICGVGLVKGFQSAFYVRYGGGANELSDGYSKGTGLAAEIIGTFVLVYTVFSATDPKRNARDSHVPVLAPLPIGFAVFMVHLATIPITGTGINPARSLGAAVIYNQHKAWHDHWIFWVGPLIGAAIAAAYHQYVLRASAAKLGSSSSFRG

SEQ ID NO: 29044 - protein, 223 aa, Oryza sativa (japonica cultivar-group)
MGKRWLPLEANPEVMNQFMRGLGVPAEAGFCDVYGLDDEMLAMVPQPVLAVILLYPQDRKKESVASPSSTVESKKLSKNVYFTKQTIGNACGTVGIIHAIGNALSRIKLVEGSYFDRFYKQTADMDPAQRASFLEEDEEMEKAHSVAVSAGDTEAKDGVIEHYVCFSCVDDEIFELDGGNSQPISHGPSSPDSLLQDAAKVIKARIAQYPGSLNFNVMALSKQ

SEQ ID NO: 29045 - protein, 480 aa, Oryza sativa (japonica cultivar-group)
MASSMAYIALLCAALAAVVALLRWAYRWSHPRSNGRLPPGSLGLPVIGETLQFFAPNPTCDLSPFVKERIKRYGSIFKTSVVGRPVVVSADPEMNYYVFQQEGKLFESWYPDTFTEIFGRDNVGSLHGFMYKYLKTLVLRLYGQENLKSVLLAETDAACRGSLASWASQPSVELKEGISTMIFDLTAKKLIGYDPSKPSQVNLRKNFGAFICGLISFPLNIPGTAYHECMEGRKNAMKVLRGMMKERMAEPERPCEDFFDHVIQELRREKPLLTETIALDLMFVLLFASFETTALALTIGVKLLTENPKVVDALREEHEAIIRNRKDPNSGVTWAEYKSMTFTSQVIMEIVRLANIVPGIFRKALQDVEIKGYTIPAGWGIMVCPPAVHLNPEIYEDPLAFNPWRWQGKPEITGGTKHFMAFGGGLRFCVGTDLSKVLMATFIHSLVTKYSWRTVKGGNIVRTPGLSFPDGFHIQLFPKN

SEQ ID NO: 29046 - protein, 492 aa, Oryza sativa (japonica cultivar-group)
MYAYVGLVGGAAALVLLLLLRHQARRWRNPRCGGQLPPGSMGLPLVGETFQFFSSDASLDIPPFIRHRLASLGCKFRYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 29047 - protein, 223 aa, Oryza sativa (japonica cultivar-group)
MATAAAAARAVAAAGRPAQGVPLSRRLTTASSSSARPLRPRGGRAAGSVRCMARRPESSYSPLRSGQGGDRAPTEMAPLFPGCDYEHWLIVMDKPGGEGATKQQMIDCYIQTLAKVVGSEEEAKKKIYNVSCERYFGFGCEIDEETSNKLEGLPGVLFVLPDSYVDAENKDYGAELFVNGEIVQRSPERQRRVEPVPQRAQDRPRYSDRTRYVKRRENQAYQR

SEQ ID NO: 29048 - protein, 410 aa, Oryza sativa (japonica cultivar-group)
MAPTTTATAAAEQAPPPQHTRKAVGLAAHDDSGHLTPIRISRRKTGDDDVAIKVLYCGICHSDLHTIKNEWRNAVYPVVAGHEITGVVTEVGKNVARFKAGDEVGVGCMVNTCGGCESCRDGCENYCSGGVVFTYNSVDRDGTRTYGGYSDAVVVSQRFVVRFPSSAGGGAGAALPLDSGAPLLCAGVTVYAPMRQHGLCEAGKHVGVVGLGGLGHVAVKFARAFGMRVTVISTSPVKRQEALERLGADGFIVSTNASEMKCNFARLCKPKKSLNTTDAPHCRQSILRLFGQAAMGTMHGIINTASASTSMHSYLALLKPKGKMILVGLPEKPLQIPTFALVGGGKILAGSCMGSISETQEMIDFAAEHGVAADIELIGADEVNTAMERLAKGDVRYRFVVDIGNTLRSD

SEQ ID NO: 29049 - protein, 299 aa, Oryza sativa (japonica cultivar-group)
MRKRCDQILAKLRKDKRSIWFNAPVEVDRLGLQDYHAVIKCPMDLGTVRANLAAGRYPSHDDFAADIRLTFSNALRYNPAGHEVHTFAGDLLASFEKMYKASVSWFEQELKILEPPMPVPPPELPPAKAPAQVKPRAGNVKMRKTKAREPNKREMTLEEKNLLRVGLESLPEEKMHNVLQIVRKRNGNPELVGGEIELDIDEMDVETQWELDRFVNKFKKALNKSRRAAIVNGENADVIDASVANDSDMLVNGSTATMVDNGDVTMAIESKDPDKITTQAEQLDEYVDALGPPLCRCRG

SEQ ID NO: 29050 - protein, 456 aa, Oryza sativa (japonica cultivar-group)
MASALLAGRGGVNHHHHHHQWGETRAPLAPVAPNSDPNHPLQQRANGSATRPPPSSYVALRPGAMAHREARALRDRLAGELGQVRALIARIDTWQQGQVKRHGSPRRDLPTPPAKLRAAMRKRCEQILAKLRKDKRSIWFNAPVEVDRLGLHDYHAVIKCPMDLGTVRANLAAGRYPSHDDFAADVRLTFSNALRYNPAGHEVHTFAGDLLASFEKMYKASMSWFEQELKLLEPPMPVPPPELPPATAPVQVKPRAANVKMRKPKAREPNKRDMTLEEKNLLRVGLESLPEEKMHNVLQIVRKRNGNPELVGGEIELDIDEMDVETQWELDRFVNNFKKALNKSRRAAIVNGENADVIDASVANDSDMLVNGSTATMVDNGDVTMAIESKDPDKITTQAEQLDEYVDIGDEMPTATYQSVEIEKDTEAASSGSSSSSDSGSSKDSVSESGNAHSLV

SEQ ID NO: 29051 - protein, 346 aa, Oryza sativa (japonica cultivar-group)
MSSEVERKTVCVTGGNGYVASLLVKMLLEKGYAVQTSVRDPNNPEKVSHFKDMEKLGPLKVFRANLEDEGSFDEAVAGCHYAFLVAAPVYDKSHKSDDLEKEIVQGGVEGTLNVMRSCARAGTVKRVILTSSTAAVSSLRPLEGAGHVLDESSWSDIEYLRSMEKLSPTQAYSISKVLSEKEATKFAEENGLSLVTLCPVVAVGASPAVRVDTSVPACLSLITGDEEMMNILKGIEKASGWSMPMVHIEDVCRAEIFVAEEESASGRYICGSLNTTVTEIAGFLAAKYPQYNVRCDCIEEHHPEKPTISLSSAKLIGEGFEFKYKNLDEMYDDLVAYGKALGLIPN

SEQ ID NO: 29052 - protein, 406 aa, Oryza sativa (japonica cultivar-group)
MSAVERKTACVTGGNGYIASALIKICCWRRDMLSRRRSETPCFFHSVQSSVSPLKDSTNCCDLYSDDMAKNSHLKDLQALDPLKVFRADIGEEGSLDDAVAGCDYAFLVAAPMNFNSENPEKDLVEAAVNGTLNAMRSCAKAGTVKRVIITSSDAAISRRPLQGDGHVLDEESWSDVDYLRTEKPLAWAYCVSKVLLEKAACKFAEENNMSLVTVFPVFTLGAAPAPVARTSVPGILSLLSGDETHLEVLKPLQSFTGYVSIVHVDDLCRAEIFLAEKESSSLSSAESSARYICCSFNTTVLALARFMAGRYPQYNVKTDRFDGMPEKPRVCCSSEKLIREGFDRSSSSTRIWATYLMTLWSKAGPWEFYHIERTAHAALLSTYSLRQKNETKTGCDISFRPKKRN

SEQ ID NO: 29053 - protein, 269 aa, Oryza sativa (japonica cultivar-group)
MAAAAAAATIGMMDSAYFVGRGEILSWINATLQLSLAKVEEAASGAVQCQLMDMVHPGVVPMHKVNFDAKTEYDMIQNYKILQDVFNKLRLSKNIEVNKLVKGRPLDNLEFLQWLKRYCDSVNGGIMNENYNPVERRSKGCKERSLKGSNKSSKSLQANRLSSANSADGGPCVGKVNVISEEHYIEQIQQLSEKIAGLKISMDSAEKERDFYFSKLRDIEILCQRPELEHLPMTKAVQKILYAADARDSPLPEANEIITRSPSMFPDEA

SEQ ID NO: 29054 - protein, 348 aa, Oryza sativa (japonica cultivar-group)
MNYLRSRSLKRLLSLGRRSNNSDESNDECVFVVDQPPPSNKPTWRCFSYEEVNKATNGFHRDNMVGRGGYGEVYRGVLEDGSAVAVKRLSPAAAADEKKEKDFLTELGTVGHVRHPNVTALLGCCVDRGLHLIFEFSARGSVSANLHDERLPVMPWRRRHGIAVGTARGLRYLHKGCARRIIHRDIKASNVLLTADYEPQISDFGLARWLPSEWTHHAIAPIEGTFGCLAPEYFTHGIVDEKTDVFAFGVFLLELISGRKPVDGSHKSLLAWAKPYLNDCVAQGLVDPRLGDGGYDGAQLRRLMFVASLCVRPAAAWRPTMTQVRRKGKRKQTFFFLQLHLLFHLGVD

SEQ ID NO: 29055 - protein, 241 aa, Oryza sativa (japonica cultivar-group)
MAAVPSAAAPPVPVSPGERWPPLESSPDVFNQLMWSLGVPEDVAEFHDVYSLDADALEMVPQPVLAVVFCFPDPTQDASNPSQHLLITGEKETLFFIKQIESLGNACGTIALLHAVGNAYSEISLSENSFLDMFIKSTSGMTSYERAVFLEKDDDMARAHLSAASAGDTKLSDDVEEHYICFVECDGTLYELDGMKPGPINHGPSSSKSLLQDAVNIIKATMHNIPNSVNFNVIVLSRKAE

SEQ ID NO: 29056 - protein, 511 aa, Oryza sativa (japonica cultivar-group)
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 29057 - protein, 492 aa, Oryza sativa (japonica cultivar-group)
MGGRVSKAVACCCCRSQHHGVVVESSEKTAEEDHGESYELPAFQEFSFEQLRLATSGFAVENIVSEHGEKAPNVVYKGKLDAQRRIAVKRFNRSAWPDPRQFLKLNQLDNFGAKVSNLLGCCCEGDERLLVAEYMPNDTLAKHLFHWEAQAMKWPMRLRVVLYLAEALEYCTSKGRALYHDLNAYRVLFDDDCNPRLSCFGLMKNSRDGKSYSTNLAFTPPEYMRTGRITPESVIYSFGTLLLDVLSGKHIPPSHALDLIRDRNFNMLTDSCLEGQFSNEEGTELVRLASRCLHYEPRERPNVRSLVQALAPLQKDLETPSYELMDIPRGGATSVQSLLLSPLAEACSRKDLTAIHEILEKTGYKDDEGTANELSFQMWTNQMQDTLNSKKKGDNAFRQKDFSSAIDCYSQFIEVGTMVSPTIYARRCLSYLMNDKAEQALSDAMQALVISPTWPTAFYLQAAALLSLGMENEAQEAIKDGCAHETSSSSGH

SEQ ID NO: 29058 - protein, 226 aa, Oryza sativa (japonica cultivar-group)
MVVVSVARLPPILVSPIRFRTTATRRRLLPSSALRLTRPLSSSCSASPLAVVASMETPPENYRTNVGICLADPSLTKIFTASRIDIANTWQMPQGGIDAGEDPREAAFRELREETGVTSAEMVAEVPVWLTYDFPVDVKEKLNARWGGTNWKGQAQKWFLFRFTGKEDEVNLNGDGSERPEFCEWTWMTPQQVIEKAVEFKKPVYEAALKHFAPYLQSDPATTTSS

SEQ ID NO: 29059 - protein, 280 aa, Oryza sativa (japonica cultivar-group)
MYNNYGNSPGMQMPPIGQMPPAAGQMPSANPQPGQFGNPFYGASSGLIKTGLGAYGEKFLGSSSEFMQSNINRYFSNPQYYFHVNDQYVRNKLKVILFPFLHRGHWTRISEPVGGRLSYKPPIYDINAPDLYIPFMAFGSFIILAGFTLGFMGKFTPEAINLQFSRGLIGWALQIVILKGLLYSMGGGEVPLLDLVAYGGYLFAGLSLAVISRLLWAYSYFVMMPWMSLCMGVFLVRTMKRVLFTEMRSSERHSTRQHYFLLFLAISQFPLFFWLGNIGA

SEQ ID NO: 29060 - protein, 507 aa, Oryza sativa (japonica cultivar-group)
MEINSAATLTLVSLLTLPILLALLTRKSSSKKRRPPGPWNLPLVGGLLHLLRSHPQVALRELASKYGPVMFLRMGQIDTVVVSSPAAAQEVLRDKDVMFASRPSLLVSEIFCYDNLDVGFAPYGAYWRMLRKLCTVELLSTKVVRQLAPVRNDETLTLVRNIKAASSGHGGGGGKKPVTLARLLTTCTNTITAKAAFGQACGVELQEQFLTALDVGLKFSGGFCFGDLFPSLRFIDAMTGLRSRLWRARGQLDSVFDKIIAQCEEHQGDSLVNVLLRIRDQGDLEFPFGTTNIKAIILDMFTGGTETTSSAAEWVMSELMRNPEVMAKVQAEVRRVFDNKSPQDHEGLIDNLRYMKMVIKETMRLNPVLPLLMPHLCRETCDIGGYEVVEGTRVVINSWAMARSPEYWDDAEEFKPERFEDGMADYKGSRFEYLPFGTGRRRCPGDTFGMVLLELIVARLLYYFDWSLPAGMQPDDVDMDFVVTATTRRKNHLQLVASPYKLAPIQI

SEQ ID NO: 29061 - protein, 360 aa, Oryza sativa (japonica cultivar-group)
MEVTPNHTQTVSGWAAMDESGKIVPFVFKRRENGVDDVTIKVKYCGMCHTDLHFIHNDWGITMYPVVPGHEITGVVTKVGTNVAGFKVGDRVGVGCIAASCLDCEHCRRSEENYCDKVALTYNGIFWDGSITYGGYSGMLVAHKRFVVRIPDTLPLDAAAPLLCAGITVYSPMKQHGMLQADAAGRRLGVVGLGGLGHVAVKFGKAFGLHVTVISTSPAKEREARENLKADNFVVSTDQKQMQAMTRSLDYIIDTVAATHSLGPILELLKVNGKLVLVGAPEKPVELPSFPLIFGKRTVSGSMTGGMKETQEMMDICGEHNITCDIEIVSTDRINDALARLARNDVRYRFVINVGGDSKL

SEQ ID NO: 29062 - protein, 282 aa, Oryza sativa (japonica cultivar-group)
MSKEVSEEPEHVRPKDYTDPPPAPLFDVGELRLWSFYRALIAEFIATLLFLYITVATVIGYKVQSSADQCGGVGTLGIAWAFGGMIFILVYCTAGISGGHINPAVTFGLLLARKVSVIRAVMYIVAQCLGGIVGVGIVKGIMKHQYNANGGGANMVASGYSTGTALGAEIIGTFVLVYTVFSATDPKRNARDSHVPVLAPLPIGFAVFMVHLATIPITGTGINPARSIGAAVIYNQKKAWDDHWIFWAGPFIGALAAAAYHQYILRAAAIKALGSFRSNPSN

SEQ ID NO: 29063 - protein, 173 aa, Oryza sativa (japonica cultivar-group)
MDVGVGGKAAKKAVGRKLGGPKKKPVSRSVKAGLQFPVGRIGRYLKKGRYAQRVGTGAPVYLAAVLEYLAAEASHCLSLPLPNPSKPSMVLELAGNAARDNKKNRIIPRHVLLAIRNDEELGKLLAGVTIAHGGVLPNINPVLLPKKTAEKADKPAKASKDKAAKSPKKQARS

SEQ ID NO: 29064 - protein, 354 aa, Oryza sativa (japonica cultivar-group)
MVLTIMEAKGKDAWGLLLVLLLGQLVAFSMAVSSFTSSLIATLGVDAPLTQSFFAYLLLTLVYVPILLKRRQKLQIPWYWYLALAFIDVQGNYLVVKAYQYSYITSVTLLDCWTVVWVVILTWYALGTRYSFWQIVGAGTCVAGLALVLLSDSKSADAQDPSKIPLLGDALVIAGTIFFAFSNVGEEYCVKKKDRVEFVAMFALFGLLVSIIQILIFEKKNLVAIAWSPTMLCLFAGFAVALFMFYSITPFVLKMSGSTLFNLSLLTSDMWAVAIRVLFYHQQINWLYYIAFAVVAIGLIIYSLNDHSSDSGTRTTANTEAAAQYQQLPGENNSTGIGSNDSQERKQEEEVHIC

SEQ ID NO: 29065 - protein, 259 aa, Oryza sativa (japonica cultivar-group)
MVKGADAPFTQSFLSYLLLALVYGPVLLHRQRKFLMPWYWYLALAFIDVQGNCLAIKAYHYSYITSVNLLNCWTITWVMILTRFALGTRYSLWQFVGAGTCMTGLALVLLSDSNYSDVQDESKRPLLGDALIIVATFCFAFSNVGEIGLFIGFAVASLVFSSIAPFVLKVNWLYYLAFAVVAIGLIIYSINFYGYGIQTNQTKCILLRVIYEARVQMMRQLQVQWKLKLSMTMNNFYVNKLVVLFRTGKQSGRSQLLMG

SEQ ID NO: 29066 - protein, 163 aa, Oryza sativa (japonica cultivar-group)
MEVGAKVPKKAGAGGRRGGGGPKKKPVSRSVKAGLQFPVGRIGRYLKQGRYSQRIGTGAPVYLAAVLEYLAAEVLELAGNAARDNKKNRIIPRHVLLAIRNDEELGKLLAGVTIAHGGVLPNINPVLLPKKTGSAAAKEAKEGKTPKSPKKATTKSPKKAAAA

SEQ ID NO: 29067 - protein, 351 aa, Oryza sativa (japonica cultivar-group)
MARIHADPVLEADQFDRLPDSLVLVILNNVEDVRSLGRCSAVSKRFYGLVPLVHDVYVKIDRVVTVDGEAEDALNLSSPKPRNILSHFLKMMLFTIIKPFHSMRGPNGAGRPLFPQLAQHSPAQVLRNFTHIRNLRVELPSGDVGTEEGVLLKWRAEYGSTLQNCVILGGTQVDRKPVGAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 29068 - protein, 216 aa, Oryza sativa (japonica cultivar-group)
MAPTSAGNLAPATAILVVVVAVVLAAAAASQDGDALTEFRKGMSDPDGALASWDPDLVNPCTWFRVTCNADNRVIRLDLEEMNLSGHLSADLARLDQLQFMEIASNNIEGPIPPEFGNLENLISLDLCNNTISGPIPPSLGKLKSLKFMRIDHNLLTGPIPNELAGLSNLMILNVSNNDLCGTIPTSGPFDHFPPSSFASNPRLRYPGMDDDDTGR

SEQ ID NO: 29069 - protein, 310 aa, Oryza sativa (japonica cultivar-group)
MAYKINSHVGVRLIKQQQAPHVAVAAITAASSPTQPPPPRALPRPPPMASAAAPTTSSLSLAARRAAAVGPAAASPLRRGGLAAGCQPARSLAFAAAADPRLATHVASRCRQAASSSSRGTRAVATMAKKSVGDLTAADLEGKRVFVRADLNVPLDDNQNITDDTRVRAAIPTIQYLIKNGAKVILSSHLVTKAEDVIGPDVEKLVSELPNGSVLLLENVRFYKEEEKNDPEFAKKLASLADLYVNDAFGTAHRAHASTEGVTKFLKPSVAGFLLQKELDYLVGAVSSPKRPFAAIVGGSKVSSKIGVVV

SEQ ID NO: 29070 - protein, 496 aa, Oryza sativa (japonica cultivar-group)
MAKRHLLLVTTCLWALSCALLLHASSDGFLRVNLNKKRLDKEDLTAAKLAQQGNRLLKTGSSDSDPVPLVDYLNTQYYGVIGLGSPPQNFTVIFDTGSSNLWVPSAKCYFSIACYLHSRYNSKKSSSYKADGETCKITYGSGAISGFFSKDNVLVGDLVVKNQKFIEATRETSVTFIIGKFDGILGLGYPEISVGKAPPIWQSMQEQELLADDVFSFWLNRDPDASSGGELVFGGMDPKHYKGDHTYVPVSRKGYWQFNMGDLLIDGHSTGFCAKGCAAIVDSGTSLLAGPTAIVAQVNHAIGAEGIISTECKEVVSEYGEMILNLLIAQTDPQKVCSQVGLCMFDGKRSVSNGIESVVDKENLGSDAMCSVCEMAVVWIENQLRENKTKELILNYANQLCERLPSPNGESTVSCHQISKMPNLAFTIANKTFILTPEQYIVKLEQGGQTVCISGFMAFDIPPPRGPLWILGDVFMGAYHTVFDFGKDRIGFAKSA

SEQ ID NO: 29071 - protein, 502 aa, Oryza sativa (japonica cultivar-group)
MASLARRRAAEAALLRRAPAAAWASAWRGYAAAAAGEESDVVVIGGGPGGYVAAIKAAQLGLKTTCIEKRGTLGGTCLNVGCIPSKALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIGLEMGSVWNRLGSEVTVVEFASDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 29072 - protein, 338 aa, Oryza sativa (japonica cultivar-group)
MSRYVDPNDRYEPRGRNSRLYVGHISLRTRAEDLENLFSRYGRVRFVDLKNEYGFVEFSDPRDANDARLDLDGRKYDGSDIIVQFARGVERGLGGSRGYKARPAHGSDHCFNCGMEGHWHRNCTAGDWTNRCYGCGERGHILRECKNSPKDLKQERGYSRSRSPRRRRSPSYGKSGPPSHWGSHGADREERLHSRRDGRGYSRSPRRHDSPSNQRNHSPRRYALPSNERYDGTRRYASPSYGRDRSPGGNALPANGRSHNLTSDGMNPSPRERDDQNGSHRRGDNDYLPSKRDDQNGSYRRGDSDYLSRERDDYLSRGRDDQNGSHRRGDSDYLSRDR

SEQ ID NO: 29073 - protein, 430 aa, Oryza sativa (japonica cultivar-group)
MGSLAGGGGGGKVGLPALDVALAFPQATTASQFPPAVSDYYQFDDLLTDEEKTLRKKVRGIMEREIAPIMTEYWEKAEFPFHAIPKLATLGLAGGTTKGYGCPGLSLTASAISVAEVARVDASCSTFILVHSSLAMSTIALCGSEAQKQKYLPSLTQFRTIGCWALTEPDYGSDASSLRTAATKVPGGWHLDGQKRWIGNGTFADVLIILARNSDTNQLNGFIVKKGAPGLKCTKIENKIGLRMVQNADIVLNKVFVPDEDRLTGINSFQDINKVLAMSRIMVAWQPIGISMGVFDMCHRYLKERKQFGVPLAAFQLNQEKLVRMLGNIQAMLLVGWRLCKLYESGKMTPGHASLGKAWTSKKAREVVSLGRELLGGNGILADFLVAKAFCDLEPIFSYEGTYDINSLVTGREITGIASFKPAALTKSRL

SEQ ID NO: 29074 - protein, 412 aa, Oryza sativa (japonica cultivar-group)
MAEDPAGSRRWRCDAGDEHGCWLSSSAGGGGDDHFDRLPDPLLLVIFNRIGDVKALGRCSLVSRRFHDLVPLVDSVLVRVDCVIPDDPASSSSSSSSPSAAPSSPTASARARTVFSQIARIVLGGIVKPIQALGQILSPANSASVLAASVTSSPSSSSSSSSSSPPLPGDVSHHSPSEVLRSFKELRRLRIELPAGELSMEEGVLLKWKADFGSTLGSCVILGASSAGKDGGAGAAPAVDCGESDETGSIPESFYTNGGLKLRVVWTISSLIAASARHYLLQPIIADHTTLESLDLTDADGQGVLTMDKWQLQELRVKPVSASGGSHRTLMPALSMRLWYAPHIELPGGLVLNGATLVAIKPTEEATRDTVGSGIAGSAGGCWVSDAFEEPYRTAVGMLLKRRTYSLEMNSF

SEQ ID NO: 29075 - protein, 390 aa, Oryza sativa (japonica cultivar-group)
MATANPFDLLGGDDNDDPAQLLAKAAVAAQKAEAKKAAAAAAAPAAGKGGAQPAASKFPTKPAPPSQAGCKDMSFDFILPFSVRESRDGSAPSRGGYGRGERGRGRGGRGYGQNRDFGGEEMNGFQGGYGGGGGSRAGGEEGAQDRERGPRPPFQGGGRRGGYGDDSERMSRRPYERHSGTGRGYEMKREGSGRGNWGTTTDEILAQETGEALKLDEKAPVTEKQGAPEGAPQADENKDNKDVTPNEEEKEEDKEMTLEEFEKLREEKRKALLSLKTEERKVEIDKDLKSMQPLSNKKENDEVFIKLGSDKDALKKKENAERDERAKKSVSINEFLKPAEGERYYGGRGRGRGRGDRGGFRGGYGEGHRSAAPPAPEIKDQSQFPTLGRK

SEQ ID NO: 29076 - protein, 188 aa, Oryza sativa (japonica cultivar-group)
MSAVNITNVAVLDNPTAFLNPFQFEISYECLIPLDDDLEWKLIYVGSAEDENYDQQLESVLVGPVNVGTYRFVLQADPPDPSKIREEDIIGVTVLLLTCSYMGQEFMRVGYYVNNDYDDEQLREEPPAKLLIDRVQRNILADKPRVTKFPINFHPEPSTSAGQQQQEPQTASPENHTGGEGSKPAADQ

SEQ ID NO: 29077 - protein, 381 aa, Oryza sativa (japonica cultivar-group)
MKEGGGDGGFVRADQIDLKSLDEQLERHLSRAWTMEKRKEEAAADQRGSKPPALAAAHYSQNRRQRREEWEIDPAKLVVRGVIARGTFGTVHRGVYDGHDVAVKLLDWGEDGHRSEQDIAALRAAFSQEVSVWHKLDHPNVTKFIGAIMGARDLDIQTESGHLAMPSNICCVVVEYLAGGSLKGFLIKNRRKKLAFKVVVQIALDLARGLSYLHSKKIVHRDVKTENMLLDKTRTVKIADFGVARLEASNPSDMTGETGTLGYMAPEVLNGSPYNRKCDVYSFGICLWEIYCCDMPYPDLSFSEVTSAVVRQNLRPEMPRCCPSSLANVMKRCWDANPDKRPEMAEVVSMLEAIDTSKGGGMIPVDQRQGCLSCFRQYRGP

SEQ ID NO: 29078 - protein, 151 aa, Oryza sativa (japonica cultivar-group)
MSSLMDKAKGFVAEKIAHIPKPEASLDSLSFKGMSRECITVHSNVNVSNPYDHRLPICELTYTLKCAGNVVASGTMPDPGWIAASDTTKLEIPAKIPYDFLISLVKDVGRDWDIDYQLDVGLTIDLPIVGNFTIPLSTSGEMKLPTLKDMF

SEQ ID NO: 29079 - protein, 491 aa, Oryza sativa (japonica cultivar-group)
MVYDGAVKDQESSANPASASAALSEASAAASEVTAAAAAGAGAGAAEEGAAVSGRPPRPPHDKRLGVRHPLKHRRFRAGGKVMVEPGDPPSAQEVADEEASEVEQEAAPVEREPPQEEGGDVEVSSAPAEMEVVEGDAMEVSPEPAVAVGESELEGRPGEEEEVSSPVVSQGERKQETAAAAPVPAVEEKKHKDQENKHKEREREKERERVDEVGYMSGGWKSEDGFLSCGYSSFRGKRASMEDFYDIKSSKIDDKQISLFGIFDGHGGSRAAEYLKEHLFENLMKHPEFMTNTKLAISETYKKTDSEFLDSESHTHRDDGSTASTAVLVGNHLYVANVGDSRAVISKAGKAIALSEDHKPNRSDERKRIESAGGVVMWAGTWRVGGVLAMSRAFGNRLLKQFVVADPEIQEQEIDDELEFLILASDGLWDVVPNEDAVSLVKIEEEPEAAARKLTETAFSRGSGDNITCIVVKFQHDKMDGDSSPTSDKS

SEQ ID NO: 29080 - protein, 237 aa, Oryza sativa (japonica cultivar-group)
MVMNPDAVRNVVGIIGNLISFGLFLSPLPTFVTIVKKKDVEEFVPDPYLATFLNCALWVFYGLPFIHPNSILVVTINGTGLLIEIAYLAIYFAYAPKPKRCRMLGVLTVELVFLAAVAAGVLLGAHTYDKRSLIVGTLCVFFGTLMYAAPLTIMKQVIATKSVEYMPFTLSLVSFINGICWTIYAFIRFDILITIPNGMGTLLGAAQLILYFCYYDGSTAKNKGALELPKDGDSSAV

SEQ ID NO: 29081 - protein, 1206 aa, Oryza sativa (japonica cultivar-group)
MGRKKNVAIDDDDAFDALAADEDQGEDDDEAPAPAPAPVEPDAAAKSDAEDDDLDFDFSKAKKKKKKKDKGARPVPLEHDDLDLDKPAPPPPAAAADEADDDEAAAAAASKKPQKKKKKKGGFTVDNEDIDKLLAEIDDTSPPTEEAEPVEEVPAPDADDALGKKSKKKKKKGGFTVDDEDVDKILAEFEDQPPPVDDPEPEPEAVKDVGNVAASTSVDDAEGKKSKKKKKKSGRTAQEEEDLDKLLAELGEGPTPAEKEKEVLPQAPPAAAMVKEDTETAEDGKAGEGEVESAAAKKKKKKKEKEKEKKAAAKEADAKKEEEKAVEAPKGKVDMKKLPKHVREMQEALARRQEAEERKKREEEERLRKEEEERLKKEEEERKAEEAKRRKKEREKEKLLKKKQEGKLLTGKQKEEAKRLEAMRRQFLEQSELQVADGAVPETKKRPIYDSKKKKGQQKTLETAKVVEEQPQEVNETINDEEEYVLVDQESQLQVEESEKTEPDQDVEELKPEEEEDEDEWDAKSWDDIDVNLPKTSAFEEEEANPVAKKVAEPVQKQENSKAQSTVATVKKVANSNKGETEDGESSSANARRNRGASKKGPIKEDETKNGSDLRSPICCILGHVDTGKTKLLDCIRRTNVQEGEAGGITQQIGATYFPTENIRERTKELKADATLKVPGLLVIDTPGHESFSNLRSRGSSLCDIAILVVDIMHGLEPQTIESLNLLKSRDAVFIVALNKVDRLYGWKKCTNAPIGKALRQQNEDVKREFNMRLTDIVTQFKMQGVNTALYYKNKEMEDTYNIVPTSAISGEGIPDLLLLLVQWAQKTMEERLTFVDEVQCTVLEVKVVEGHGTTVDVVLVNGILHEGDQIVVCGMQGPIVTTVRALLTPHPMRELRVKGTYQHHKKIRAAQGVKISAQGLEHAIAGTALYVLKPDDDLDRLKDAVMEEMTRVRNRIDKSGEGVYVQASTLGSLEALTEFLKSPAVNIPFCDFSIGPVHKKDVMKASVMLERKKEYATILAFDVKVMPDARDLAEESGVRIFVADIIYHLFDQFTAYIKNLREEKKKESAEEAVFPCVLKIMPNCVFNKKDPIVLGVDVLEGIAKVGTPLCIPTKEYIDIGKIASIEINHKQVDMATKGQKVAIKIIGSNPDEQQKSFGRHFDMEDELVSRITRRSIDLLKENYRDDLSMDDWKLVVKLKSILKIP

SEQ ID NO: 29082 - protein, 423 aa, Oryza sativa (japonica cultivar-group)
MSNRRRKRGESKPQAHDAGDTTPIDNILTSLDDAPPPPPPPRHELPLLQLNDHQEADDADASSSSSPHQQRRLWVKDRSRAWWELCSSADYPEADFRRAFRMSRPTFHFLCDALAAAVAKEDTALRAAIPVRQRVAVCVWRLATGEPLRVVSKRFGLGISTCHKLILEVCAAIRNLLMPRFLHWPDHPTSTAYKTRFEATSGVPGVVGAMYTTHIPIIAPKVSVAAYLNRRHTERNHKTSYSITLQGVVGPDGTFTDVCIGWPGSMSDEQVLRKSALHQRASAAAGSMSWVVGGASYPLTEWMLVPYAQRNLTWTQHAFNEKVGEVRRVATEAFVRLKGRWACLQKRTEVKLQDLPAVLAACCVLHNICETRGEDMDPDLRCDLPPDEEEDDTVLVQSESANKVRDDIAHNLLHRGLAGTAFF

SEQ ID NO: 29083 - protein, 302 aa, Oryza sativa (japonica cultivar-group)
MGSTAAAGGNLRTALSYCVQQVRNYDYHHYLCLLHLPPAMRKAAFAFRAFNIETAKAMDVVSDPKTGLMRLLWWKDVVDKVFANKLVEHPVAQVLSSVVSEHKISKHWLKRSVEARINDANRDDYAIPETISELERYAEDTQSTILYMTLQAGGIQSTIADHAASHIGKASGLLLLLKALPHHVSKQGRIPYIPASIAEECGLLTREGGRSEVRMGDELPDAVFKVASVADAHLQKARELASSVPAEAIPVLLPGVPAQVLLDSLRRREFNVFDSRLSRGVHGISPLWYQIKLIWHSVRKKY

SEQ ID NO: 29084 - protein, 205 aa, Oryza sativa (japonica cultivar-group)
MGLCLSSGVAAAMAEAGMAASTAMVLLPTGELREYPRPATAARVLEDVAAAEGEEEDVGRRFFLCDADKMGFEGPVAAVAAAAELRPGQIYFVLPGEVRRRGMRREEVAALAVKASAALAAASSSSTTSGCGGGRRRRGSVAPLVFAPPEEEYEYDASDYCKSNASAAAAAAGKRRPVAARRGGGKGRQFATDLTAIPELDMITE

SEQ ID NO: 29085 - protein, 376 aa, Oryza sativa (japonica cultivar-group)
MDRLLAFSRRRRRWLAWAGASAGAYLVYHHPAVAARRRRIARVASALASLADAVADVASDLAAFLRSDSDSIPPTVRQLSKLASSPEASASASALSGALTTGVIRGYATAAAASSSGDEAAFSDRLLDRILSPSGERLASAVAGSFGSQLVLAYYSAPSDPSSGSSSPSWVDVVTTGSCRRAIRSWVEVFTATAVGVFIDKTIHINTYDQLFAAATNPSYGARLQQLLVALCNASMETLVKTSHSVLSNPNPNANSNQNGSNNGSGSGSGNGGDGEGWVETVSTVLAVPSNRRLVLDLTGRATFEAVRSFLDFVMWRLHEGARAGGDAAIGAGLCALRHMSERSMVIAAICIALCLHLLNGAWLMTRPEPASVDQL

SEQ ID NO: 29086 - protein, 385 aa, Oryza sativa (japonica cultivar-group)
MNNTMSLLLLLLGLSILAMNSTAATTDNGQFIYTGFAGANLTLDGVATVTPAGLLQLTNGTSALKAHAFHPDPLHFRDLPVAGGGGSGNGNGNDVHSFSVSFVFAILSIYPNLSSHGMAFFVSPTKNLSAAAPRSYLGLFSNKTDGDVANHIFVVELDTIQNTDFMDINNNHVGVDINSIRSVRSYPTGYYDDGDNGNLKNLTLNSHEPMRIWIDYDQETTRIDVTVAPLEISKPKRPLGSVIYNLSTVLTDSAYVGFSSSSGDIDSQYYVLGWSFAINGAAPAIDISKLPKLPREGPKSSSKVMEITLPIATAMFVLVIGVIVLHLLRRQLRYAELREDWEVEFGPHRFSYKDLFDATQGFKNKYLLGSGGFGSVYRGVLKSSR

SEQ ID NO: 29087 - protein, 462 aa, Oryza sativa (japonica cultivar-group)
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSAAVQGEGKCSRPAVEVGVQNVGCAEDAAAFVALAAAVDLSMDACRLFSHRLRRELSASRSDLLR

SEQ ID NO: 29088 - protein, 487 aa, Oryza sativa (japonica cultivar-group)
MGMERPQEKVATTTTAAFNLAESGYADRPDLDDDGREKRTGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 29089 - protein, 460 aa, Oryza sativa (japonica cultivar-group)
MAAAGRTLGCIYAGTLVTASAHIITAVIGSGVLSLAWAIAQLGWVIGPAVLVAFSVITWFCSSLLADCYRSPDPVHGKRNYTYGQAVRANLGVAKYRLCSVAQYVNLVGVTIGYTITTAISMGAIKRSNWFHRNGHDAACLASDTTNMIIFAGIQILLSQLPNFHKIWWLSIVAAVMSLAYSTIGLGLSIAKIAGGAHPEATLTGVTVGVDVSASEKIWRTFQSLGDIAFAYSYSNVLIEIQDTLRSSPAENEVMKKASFIGVSTTTTFYMLCGVLGYAAFGNRAPGNFLTGFGFYEPFWLVDVGNVCIVVHLVGAYQVFCQPIYQFAEAWARSRWPDSAFVNGERVLRLPLGAGDFPVSALRLVWRTAYVVLTAVAAMAFPFFNDFLGLIGAVSFWPLTVYFPVQMYMSQAKVRRFSPTWTWMNVLSLACLVVSLLAAAGSIQGLIKSVAHYKPFSVSS

SEQ ID NO: 29090 - protein, 441 aa, Oryza sativa (japonica cultivar-group)
MEKKTKKKNPSKRGRKRGGRGEGREKKVEEISSSSSSRGRGRRRMAPVKKSKKGKRKSKDSGKLKIVKYGGGAPPLPPELRGLDTEWWYTFLHKHSELGLSAPSDEGEAFRYFFRTSRRTFDYICSIVREDLISRPPSGLINIEGRLLSVEKQVAIAMRRLASGDSQVSVGAAFGVGQSTVSQVTWRFIESMEERARHHLVWPGQERMEQIKARFEAESGLPNCCGAIDATHIIMTLPAVESSEDWCDPAKNYSMFLQGIVDDEMRFIDIVTGWPGSMMFSRLLKCSGFFKHCDAGTRLDGPVMVSAENGEIREYIVGNNCYPLLPWLMTPYEGESLSAPMASFNARQKAARTLGPRALSRLKGSWRILNKVMWRPDKNKLPSIILVCCLLHNIIIDCEDELLPDVQLPDHHDTGYSEEKCEQVDPNGKIMRDVITGYLQI

SEQ ID NO: 29091 - protein, 454 aa, Oryza sativa (japonica cultivar-group)
MNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 29092 - protein, 329 aa, Oryza sativa (japonica cultivar-group)
MAFALKASTASAAAASTASASASSLSVAAAAPGRRGGAAGRVSFRGVPAPMVAIRAEAAAVGEDERVISGTFAKLKEQGKTAFIPFITAGDPDLATTAKALKILDACGSDLIELGVPYSDPLADGPVIQASATRALSKGTTFEDVISMVKEVIPELSCPVALFTYYNPILKRGIANFMTVVKEAGVHGLVVPDVPLEETNILRSEAAKNNLELVLLTTPTTPTERMEKITKASEGFIYLVSTVGVTGARANVSGKVQSLLQDIKQVTDKAVAVGFGISTPEHVKQIAGWGADGVIIGSAMVRQLGEAASPEEGLKKLEELAKSLKAALP

SEQ ID NO: 29093 - protein, 310 aa, Oryza sativa (japonica cultivar-group)
MAGNDYWGLAGWRVAFIMVALVSLIIGILVYLYATDPRKIPGNHLLDDDDYERLHLASKDVLPPPSIWRDSLVATRSVMKVRTFQIIVLQGIIGSLPWTAIVFFTMWFELIGFDNNSSAALNSLFAIGCATGAFLGGVIADRLSRHFPDSARVMCAQFSAFMGIPFSWILLTVIPQSVDYWSAYAVTLFFMGITISWCATSANNPMFAEVVPPKHRTMIYAFDRAFEGSFASLAAPAVGLVTEKIYGYDSKTVNLANGSAEGAYALSRGLLTMMIVPFGVCVLFYSPLYLVFKRDRENAKLSSFKDQELV

SEQ ID NO: 29094 - protein, 327 aa, Oryza sativa (japonica cultivar-group)
MATNDRFSDLLWMPHCQHKVSKIWDSPTNCINIRLHRVGIPYHSLCQTALENLGFFQIARMKEINNDKYLISALVERWRPKTNTFHLPVGEMTITLQDVSCLWGLPIHGRPITGQADGSWVDMIERLLGIPMEEQHMKQKKRKKEDDMTMVSYSRYSISLSKLRDRFRVMPKNATEREINWYTRALVLDIIGSMVFTDTSGDGVPAMYLQFMMNLSEQTEYNWGAAALSMLYRQLSIASEKERAEISRPLLLLQLWSWSRLPLGRPVKAMKITKEREEEDEQEELDYCLVFGAKWCLSHEFRAPHNAGTEYYRSQINLIREGVIVWQ

SEQ ID NO: 29095 - protein, 408 aa, Oryza sativa (japonica cultivar-group)
MSLRCYHHHLKVRALLCGFGGGCFPTRTPPSPSPWSPPLTHFIKHLLGSPAALSGTATGAACEPCSLTLHFLRNTCGLSEDEAAAAAARVRLRSTKKAHAIVALFRGIGFSAADIARLVTSNPSLLSYRADATLMPKIEFFRRELGLTDAEIRRLVLANPYRVLRYSLKRCIRPNYLILRDLLGSDKNVTAAVLQSTDLIHGDVRGILLPKIKILQDYGATNDVIVKLVTTHPRALMHRASRFEESLAAMKELGVRPSSGMFPYSFGLFARLHPRKWKGRMDNFLSLGWTKEQVIEAFVRHPYCMSVSNDKVKLIWQFLAKKLRWTTDYVARSPMVLSFSYDKRILPRCTVLNLLASRGIFNRDIKTSHLVLGEKKFKEKYVTPYQDEIPEVLEAYSSVAESRVPVYK

SEQ ID NO: 29096 - protein, 244 aa, Oryza sativa (japonica cultivar-group)
MSFTNCFHGRTMGSLALTSKVQYREPFAPVMPGATFAEYGNLEEAKKVIQSGKIAAVFVEPMQGEGGIHSATKEFLQGLRDACDEAGALLVFDEVQCGLGRTGYLWAYEAYGVVPDIMTLAKPLAGGLPIGVVLVTEKVASAINYGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRQCC

SEQ ID NO: 29097 - protein, 414 aa, Oryza sativa (japonica cultivar-group)
MNPPCNGKLPPGSMGFPVVGETFQFFRASPSVDMPSYYKQRLEYGPLFKTSLVGQPLVVSLDPEVNRFIFQQEPHHVQWNRSQVHPELCVQALWAENLKESLLPELENSMRESFASWASKPRIEVQDGVSDMIFDLVAKKLIGLNVTQSRELRKNFQEFFQGMVSFPIYFPGTSFYRCMQGRKNVRNTLTDVMKERLSAPEKKYGDLVDLIVEELQSEKPVIDENFAIDALAALLFTSFATLSSTLTVALKFLNDNPKIVEELKEEHDVILKKREVMNSGFTWEEYKSLKFTTQVTNEITRISNVAPGVFRKTLTDVQVNYTIPSGWLVMISPMAVHLNPELFEDPLKFDPWRWTEEKRSSLLRNYMPFGGGIRLCLGADFSKLFIALFLHILVTEYRYIRMLVFTHCLLSSLK

SEQ ID NO: 29098 - protein, 482 aa, Oryza sativa (japonica cultivar-group)
MASTDPLLGGKEEEEGGGEVRRARRWWVGRVVDTEEAWAQTRFAVPMVLTNMSYYAIPLVSVMFSGHLGDVHLAGATLGNSWATVTGYAFVTGMSGALETLCGQAYGARMYRMLGLYLQSSLLMSAAVSVLVSALWCFTEPLLLLLRQDPAVSAAASAFVRAQVPGLFAFSFLQCLLRYLQTQSVVAPLVACSLAPFLLHVALAHLLVNALGLGLAGAGAAVSITFWASCLMLLAYVLRSERFAETWNGFSAEAFRFVVPTIKLATPSAVMVCLEYWAFELLVLIAGLLPNPTVSTSLIAMCSSTEAIAYMITYGFSAAVSTRVSNEIGAGNVEGAKNAVAVTLKLSVFLAAAFVLLLGFGHGLWAGLFSGSAIIAAEFAAVAPLMMASILLDSAQGVLSGVARGCGWQHLAAVTNLVAFYVIGMPLSIFFAFKLKWYTKGLWMGLICGLTCQTCTLMVITARTKWSKIVDAMQEKKASYVA

SEQ ID NO: 29099 - protein, 372 aa, Oryza sativa (japonica cultivar-group)
MASSRDFDHADCFDNSGPVHMMAKNGAGSPRTVLDWGKEEHRRCVAACLVKGVYIIENDSTRRRVHTNALAPPWWENFGFNLLDVIRDDSDHDDQFIIGAIYEHVPPLGEPAHPLSPHYVVAFRGTMMSHPKALIDLYLDAKIMVNTLKESKRSRLANTAVKKLVATIDKGMGGACGHGTAGSCIVWLAGHSLGASLALDVGRAMMVEQGYNLPTFLFNPPQVSPTPAIDVLLPIEKAQKAKRDIYAVSYFVKAGLGKVLNPHKERMENLFKRLSPWAPELYVHERDVICKGYIDYFEQRQQVQERFRAVATSAMTLSYRDMFFSMFGMEKEQPHLLPSARLWKSTSKDEDAHALQQWWKPMGEQAMVEADG

SEQ ID NO: 29100 - protein, 488 aa, Oryza sativa (japonica cultivar-group)
MAGNLLANYVQVNVMLPLDVVTVDNKFEKVDETRAQLKKLTEAGVDGVMVDVWWGLVEGKGPGSYDWEAYKQLFRLVQEAGLKLQAIMSFHQCGGNVGDIVNIPIPQWVRDVGASDPDIFYTNRGGARNIEYLTLGVDDQPLFHGRTAIQMYADYMKSFRENMAEFLDTGVIVDIEVGLGPAGEMRYPSYPQSQGWVFPGIGEFICYDKYLEADFKAEAAKAGHPEWELPDDAGEYNDTPEKTRFFADNGTYVTEKGKFFLTWYSNKLIKHGDKILDEANKVFLGCRVQLAIKISGIHWWYRVPNHAAELTAGYYNLDNRDGYRTIARMLTRHRACVNFTCAEMRDSEQSSEAKSAPEELVQQVLSAGWREGLHVACENALGRYDATAYNTILRNSRPTGINKNGPPEHKLFGFTYLRLSDELLEGQNYSTFKTFVKRMHANLDYNSNVDPLEPLQRSMPEMPIGKILQAAHPKLAPFPFDENTDLPV

SEQ ID NO: 29101 - protein, 491 aa, Oryza sativa (japonica cultivar-group)
MAGGDAEEEEEEEEETYTTDDALTRAGFGRFQALVLAYACVGWVAEAMEVMLLSFVGPSVKAEWGVSGAAEGLVSSVVFAGMLIGACLGGLISDRYGRRIGFLSTAVVTGIFGLLSAFSPNYASLLVLRFVVGLGLGAGHVLSTWFIEFVPAAKRGTWMVVFHCSWTVGTILEALLAWAVMPVLGWRWLLALSSAPCFILFIFFPVTPESPRYLCSVGRTMDARVILEKIARMNNSSLPPGILTYASTRRIDKVLDDSETALLITEDGGSGIDEHTSSKPGGITALRESWSYDLIRSTFLLWFVYLANYFAYYGVILLTSELSNGQRRCASVGINFMQPKDANLYRDVLVTSLAEFPGLVLAALLVDRIGRKVSLGIMLLLSCAFLAPLAVHLGQGSVTTLLFCARTCIMGGFAVLYVYTPEIYPASSRNTGVGITSSFGRIGSIVSPVVTVSLSENCRQKEAVFFMDLMLFLAAVACALIPLETKGRQIQ

SEQ ID NO: 29102 - protein, 296 aa, Oryza sativa (japonica cultivar-group)
MAVSASAGEEEEAFEEVDPTGRFGRYADVLGLGSVKKVYRGFDQEEGIEVAWNRVRLRALADRDPAMVERLHAEVRLLRSLHHEHIIGFHKVWLDRDAGVLNFITEVCTSGSLREYRDRHRHVSVKALKKWARQILLGLDHLHTHDPCIIHRDLNCSNVFINGNTGQVKIGDLGLAAIVDKTHVAHTILGTPEFMAPELYTETYTESVDIYSYGMCVLEMVTREMPYAECDSVVQIYHSVTRGVPPAALKRIRDPELRAFIERCIGQPRNRPSAAELLRDPFFAGIDDDDSTGTLG

SEQ ID NO: 29103 - protein, 472 aa, Oryza sativa (japonica cultivar-group)
MEADSGKLFVGGISWETDEDRLREYFSRFGEVTEAVIMRDRNTGRARGFGFVVFTDAGVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNENLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGITS

SEQ ID NO: 29104 - protein, 471 aa, Oryza sativa (japonica cultivar-group)
MRSSSDCKVVAAAARKKEKEAAAWPWSLWGFLLTGCLGGGGGGGKKKSGGKKVRPRGGGGGGLRRLSFTDLTGAADQDLSVSLVGSNLHVFTVAELRDATRGFVSGNFLGEGGFGPVYKGLVGDGVKPGLRPQAIAVKLWDPEGAQGHKEWLAEVIFLGQLRHPNLVKLVGYCCEDENRLLVYEYMEHGSLENHLFKQIPAVLPWSTRLNIAVGAAKGLAFLHDAEKPVIYRDFKASNILLDSDYKAKLSDFGLAKDGPEGDDTHVSTRVMGTHGYAAPEYIMTGHLTAKSDVYSFGVVLLEILTGRRAVDKTRPNREQSLVEYARPCLRDPLRLIRIMDPALEGRYSPAAAREAAAVAYRCLSGSPKNRPDMSAVVDALEPLLVATDDVPLGPVVLFVAPDQEADAAAAADDDEDDKARRRQRRTRKDEQHRRRSRLRTSPKGSPRKPAVAAACRNEEFWVWHVPADHKA

SEQ ID NO: 29105 - protein, 299 aa, Oryza sativa (japonica cultivar-group)
MAGSPVLRAAILAAVLVLPFVGVPAPAAAQTKKFCLSQFAIASQACAILPPGEDHHHHHDDDDDDDDDDDDDDDDDDDDDEDDQGGGDDDGGGGGGGGGGGGGGGGDDSGGDDGGGGGGGGDGDRRSNRKSMVTVDAEVDTDDDALRVNGTGAGAGAGNHTRGSGGVVVRRRHRRRRRSRRRRRRHRHHPGVREGEDDDSGGDDEDHGGDDDDDHDDDDDDDDDDDDDDDDDDDDDDDDDDDDDDHRANRDCCRWLKEVEPACVCDALLRLPPFLVKPQHKYTVKVGDSCKYTYHCGGY

SEQ ID NO: 29106 - protein, 313 aa, Oryza sativa (japonica cultivar-group)
MALYLLFESASGYALFHAHGVDEIGQGVDAARASVLELQRFSKAVKLAGFSPFSSAVDALNQCNAISEGIMTDELRSFLELNLPKVKEGKKAKYSVGVMEPKVGSHISEATGIPCQCNEFVQELLRGVRLHFDHFIDQLKPTDLEKAQLGLGHSYSRAKVKFNVNRVDNMVIQAIFLLDTLDKDINSFSMRVREWYSWHFPELVKIVNDNYVYSKIAKFVVNKSDLAEKDIPALADIIGDEDKAKEIVEAAKASMGQDLSPVDLINVQQFAQRVMNLSEYRKNLYEYLVTKMNDIAPNLTSLIGEIVGGLELG

SEQ ID NO: 29107 - protein, 445 aa, Oryza sativa (japonica cultivar-group)
MYKAKRTAAQKVRRCLGKYELGRAIGQGTFAKVRFAKNMETGDHVAIKILDKAKVQKHRLVEQIRREICTMKLIQHPNVVHLHEVMGSKTRIFIVLEYVMGGELHDIIATSGRLKEDEARKYFQQLINAVDYCHSRGVYHRDLKLENLLLDTAGNIKVSDFGLSAISEQVKADGLLHTTCGTPNYVAPEVIEDKGYDGALADLWSCGVILFVLLAGYLPFEDENIVSLYNKISGAQFTCPSWFSAEAKRLIARILDPNPATRITTSQVLQDQWFKKGYESPVFDDKYYPYFHDVYDAFGDSEEKHVKEAMEEQPTLMNAFELISLNKGLNLDNFFESDKKYKRETRFTSQCPPKEIINRIEEAANLLGFNIQKRNYRMRMENIKEGRKGHLNIATEVFQVAPSLHVVELKKAKGDTLEFQKFYQTLSTQLKDVVWELEDAAEDMS

SEQ ID NO: 29108 - protein, 364 aa, Oryza sativa (japonica cultivar-group)
MVSPSLRIPAAARVFDPAINTRCPPPHAVVMRMRSRSRRSIAASASPPGDPSIRDPISLPRPLTSADLMEASGDGLKVAYQGCPGAYSEAAAKKAYPSCHTVPCEYFETAFQAVENWVADRAVLPLENSLGGSIHRNYDLLLRHRLHIVGEVRLAVRHCLLANRGVKIQNLRSAMSHPQALAQCEQTLTKLGIEHREAVDDTAGAAKLIAEQKLQDTGAVASSLAAQLYGLDILAENIQDDTDNVTRFMMLAREPIIPRTDKPFKTSIVFSLEEGPGQLFKALAVFALRKINLTKMESRPHKKKPLRIADDNCSAPLKHFDYLFYVDLEASMADPNAQNALANLKEFATFLRVLGSYPTDVSEA

SEQ ID NO: 29109 - protein, 337 aa, Oryza sativa (japonica cultivar-group)
MECEPEELQFLGMVGIYREAASILRAHRPLFARIAAAFVLPLSLLFLLHIAISHALFSHIDSDDSALDSAAPGTPAQRRLLHRLADDWLALLLFKAAYLLALLLFSLLSTAAAVFSVASVYSAKHDALSFPRVLSVVPRVWRRLAATFLAAFLLLFAYHLLFVAVFVALLVAADSGSGLAALLAFLLALAYIAGLVYLSVVWHLASVVSVLEDYKGFEAMRKSKALIQGKLWTASAIFFVLNVVFIVVEVAFRAWVVRGATHGLGAGSRLLLGLAMLAALCAVVMLALVVQTVVYLVCKSYHHESIDKSNLSDHLEVYLGEYVPLKASDVQMEQFNL

SEQ ID NO: 29110 - protein, 422 aa, Oryza sativa (japonica cultivar-group)
MSITSASRRAGAAALPILRRIGGAFRRPFSSEPDPASSPGYHVAGGPSFMRGAVFWEPGRPLTLEDFRMPRPKAGELLIKTKACGVCHSDLHVLKGELPFSSPCVVGHEITGEVVDHGTHTPAEIINRFPVGSHVVGAFIMPCGNCFYCVKGQEDLCESFFAYNRAKGTLYDGQTRLFLRSNGKPVYMYSMGGLAEYCVVPANALAVLPNSLPYTESAILGCAVFTAYGALRHAAEMRAGDSVAVIGVGGVGSSCLQIAKAFGASEVIAVDVLDEKLQNARTLGATHTVNAAKEDAVEKIKEITDGRGVDVAVEALGKALTFSQCAKSVRDGGKAVMIGLAATNVMGEVDITRLVRRQVKIIGSYGARARQDLPQIVKLAESGAFNLKNTISRKCKFEEANSAYEDLDRGKIVGRAVVEIMS

SEQ ID NO: 29111 - protein, 336 aa, Oryza sativa (japonica cultivar-group)
MAPLGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 29112 - protein, 109 aa, Oryza sativa (japonica cultivar-group)
MAGKLYQLMSRMHLARSRSSSSSAATAAAAAADVPRGHFAVYVGERRKRFVIPTAYLKHPSFVLLLKRVEEEFGFDCHRCGGLTIPCATEGDFASFVAEAIASDDHHHH

SEQ ID NO: 29113 - protein, 102 aa, Oryza sativa (japonica cultivar-group)
MGGKLQHLMERLHLAGKGGGGGAARDVPRGHFAVYVGEARARFVVPTAYLRQPAFVALLKSVEEEYGFDHCGGGGLTIPCSERDFSALLGRLASSPPPPSWR

SEQ ID NO: 29114 - protein, 434 aa, Oryza sativa (japonica cultivar-group)
MGRMKGVSEGLIIGITVGVVIGVLLAVGILLCLRYRRSQAQIRSSSSRRASTIPIRANGVNACTILSNSTTGQESPREVEDRGASMWLEGPGRKSVISASGIPKYAYKELQKATSNFTTLLGQGAFGPVYKADLSSGETLAVKVLANNSKQGEKEFQTEVLLLGRLHHRNLVNLVGYCAEKGQHMLLYAFMPNGSLASHLYGENIAHLRWDLRVNIALDVARGLEYLHDGAVPPVVHRDIKSPNILLDQSMHARVADFGLSREEMVTRNGANIRGTYGYLDPEYVSSRSFTKKSDVYSYGVLLFEMIAGRNPQQGLMEYVELAAINADGKTGWEEIADSRLEGAFDVEELNDMAAVAYRCVSRVSRKRPAMRDVVQALIRVAKHSQSKKHHKRRPPPGRADDESVDLEASEVQSSLSGHQRQESVGSVSDLADV

SEQ ID NO: 29115 - protein, 305 aa, Oryza sativa (japonica cultivar-group)
MEGGKMSSMGMDAASASVTVPPMQMQAGDQSNRIAIIISPRAGSSKILPFELVNGAANAGSQRHADPAESTPEAHHHLWHPVDLPKIKPPVPLVKKVGAEFFGTFTLIFTVLSTIIMDEQHKGVESLLGIATSAGLAVTVLVLSLIHISGCHLNPAVSIAMTVFGHLPPAHLLPYIAAQILGSITASFAVKGMYHPVNPGIVTVPKVGTVEAFFLEFVTTFVLLFIITALATDPNAVKELIAVAVGATIMMNALVAGPSTGASMNPARTLGPAIATGRYTQIWVYLVATPLGAVAGEGFYFAIKL

SEQ ID NO: 29116 - protein, 278 aa, Oryza sativa (japonica cultivar-group)
MEGHKSGMEAVAVAIPPLHTGESNHRIDSNVSSQCHADPAELSDETQQQSLWHLGLRKIIPSSVPLLKKVSAEFFGTFILIFTVLSTIIMDEQHKSIETLLGIATSAGLAVTVLVLSLIHISGCHLNPAISIAMAVFGHLPSAHLLPYISSQILGAVAASFAVKGLYHPVNPGIVTVPNVGTVEAFFVEFIITFFLLFIITALATDPNAVKELIAVAVGATVMMNILVAGPSTGASMNPARTIGAAIATGRYTQIWVYLVATPLGAIAGTGAYVAIKL

SEQ ID NO: 29117 - protein, 493 aa, Oryza sativa (japonica cultivar-group)
MTSRKPPGIRLFGGITVLRTYQTLVLVLTFVAYTCFHMTRKIPSIVKSVLDPQTKLGSSPWGRLHTKNTLNIGWLPFNTIDGSALLGEIDVAFLAVYSVGMFFAGHLGDRMDLRIFLTIGMFGTAVFTALFGAGYWLNIHNFYYFLVIQMIAGLFQAIGWPSVVAIVGNWFGKSKRGLIMGIWNAHTSVGNISGSLLAAFLLKFGWGWSFAIPSLIMVAVGLLVFVFLPVSPEVMEIDIDDGEISSVKDTTKEPLLEPGQEVKHNAVGFLEAWKIPGVAPFALCLFFSKLVAYTFLYWLPFYISHTPIGGEYLSDALAGSLSTIFDVGGVLGGVLAGHISDRLNARAVTAASFMYCAIPALFLYRTYGSMSIMWNICLMFITGMFVNGPYALITTAVSADLGTHSSLNGNSRALATVTAIIDGTGSVGAAIGPLLTGYISSSSWSAVFTMLMAAALLAGLLLTQLVCSELKGKATSNASKDVADAQGTYSDEV

SEQ ID NO: 29118 - protein, 392 aa, Oryza sativa (japonica cultivar-group)
MEGGGGGGHGHHGGGGGGHGHHGGIGGGEAQIKGTLTHGGRYVQYNVYGNLFEVSSKYVPPIRPVGRGACGIICAVVNAQTRQEVAIKKIGNAFDNQIDAKRTLREIKLLRHMDHDNVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 29119 - protein, 462 aa, Oryza sativa (japonica cultivar-group)
MSSTPAANFSNEDDERKAPTGFHPSLWGDFFISYQPPTAPKHAYMKERAEVLKEEVRKVVKGSNEVPEILDLVITLQRLGLDSYYKAEIDELLCTVYNTDYNDKDLHLVSLRFYLLRKNGYDVSSDIFQHFKDKEGSFVADDTRSLLSLYNAAYMRTHGEKVLDEAVVFTTNRLRSELKHLKSPVADEVSLALDTPLFRRVRIIETQNYIPIYESATTRNEAILEFAKLNVNLLQLIYCEELKTITRWWKELNVESNLSFIRDRIVEMHFWMTGACSEPHYSLLRIILTKMTAFITILDDIFDTYATTEESMMLAKAIYMCNESATVLLPKYMKDFYLYYLKTFDSFEEALGPNKSYRVLYFKELREQAGDHYASTIQCYMLQHGTTIHEACIGIKELIEDSWKDMMKEYLAPTNLQPKIVARTVIDFARTGDYIYKQADSFTFSHTIKDMIASLYVEPYSI

SEQ ID NO: 29120 - protein, 470 aa, Oryza sativa (japonica cultivar-group)
MKERAEVLKEEVRCMVKGSKEVSEILDLVLTLQRLGLDSYYKTELDDLLYSIYNSDFDDKDLNLVSLRFYLLRKNGYDVSSDIFLCFKDKEGSFAADEVRSLLGLYNAAHVRTRGDKVLDGAIAFTKSHLEAKLEHLKSPLKEEVSSALETPLFRRVRILETRNYIPIYEKISGRNETILEFAKLNFNLLQFLYCEELKKITLWWKELNIQSNLSFIRDRIVEMHFWMTGVCPEFNYSLSRIILIKMMAYITIIDDIFDTHGTTEESMMLAEAIYKCNESAIVRLPEYMKCFYLYLLKTFDLIEEELGTSNSYRVFYLKELASIYAIKLLKRLVQGYSQEIKWRDEHYIPKTVDEHLEVSRATVGAFEIACASFVREQKGEHHVSTVQCYMFQHGTTMHDACVKIKELIEDSWKDIVKEYLTLPTEQPKIVAETIVDLARTADYMYKKTDSYTFANTIKDMVASLYVKPI

SEQ ID NO: 29121 - protein, 490 aa, Oryza sativa (japonica cultivar-group)
MHQGAAGPGPSGGGGDRLSALPDAVLFRIVSHLKAREAVRTSGLSRRWRHVWASAPRVDVRYPCACDGRAVDQKSFRDFVTILLLRRRPLAPFKALRLSWSHDEDDVSAWIAHAVRRGAEEIDLSARRHHGYPVPDYKHFISPKIKILKLTHLGTTRFTADNTLDLLCSGCTSLEELELKDIKSLWGGIQSDSLKRLSIINCHVTSDGFLVEAPNLISLCCIRPARAVPWFSHMVSLVEATVVLDDSRLSDDYQQPVLEDDNDGSDYDDNFFAPKAEGPDDKRDNEADNDSGDKRNRDGSKSDLDDHDGEYDHEDGSESGDKEVDDLEGGDDRTVTYGEIADESSSYGIPIPSDEYGGNYGNHDYTIFGGDHMLDHLSDVRTLGLLGHQGEDIHRSRGGINPTGGSFACNNLKKVKITCRKDDVMVHMLAKFLQRNGISLQKIFVRRTSSTHNGEEGTGKDSSAKRKAQDEAARRAVKQLRRARNSRSPE

SEQ ID NO: 29122 - protein, 192 aa, Oryza sativa (japonica cultivar-group)
MHAPRKFKKAFMERLLLSLQVAGLTSKSMGLRERRDAVRLSSDVAMASARGRAAPWARALVARHAAERRNEPLLRRIMGGDVYERAVSSAGAAVARSRRIVRRSQRVACSSRRKRRSLAMAAASGGGGALAARRMVKGRLRLLRRLVPGGEALRGFSLLSETLDYVVCLKTQVELMHSLCKGSQQKLHLQLG

SEQ ID NO: 29123 - protein, 342 aa, Oryza sativa (japonica cultivar-group)
MGVEKTTANGGSGAAAVSGGGRTVCVTGAGGFIASWLVKLLLEKGYAVRGTVRNPDDAAKNAHLMALAGAAERLTLVRAELLDKESLAAAFAGCEGVFHTASPITDDPEKMIEPAVSGARNVITAAADAGGVRRVVMTSSIGAVYMGGGGGEEVDETCWSDLDHCRDTGNWYCYAKTVAEQAAWELAKERRLDLVVVNPSLVLGPLLQRGVNASTWHVLKYLDGSARTYADAAQAYVHVRDVADAHARAYESPAARGRYLCAGRTLHRGEVCRILAALFPGYPVPTRCKGDAGETAEGCRFSSRKLAELGVAVMPASQCLYDTVVSLQDKGLLPFVPAAAMP

SEQ ID NO: 29124 - protein, 213 aa, Oryza sativa (japonica cultivar-group)
MGQAFENVSIVVRGCYILLHLLLNKAWLRDCYYVVGAAALLFILFLPLAVVVKEEHKNVSHLERALQQPPSIAVEHPTKEADGGDATAAAACGGCGIGRMFRLPELGEDYSIMQALVSVEMVVLFVVSVFVIGGTLRAIDNMAQIGQLLGYPARSVNTFVSLISIWNYAGRVGAGYLSEMLLARYRFPRPLVLTAVLHASCVGHHCLPAEPRA

SEQ ID NO: 29125 - protein, 202 aa, Oryza sativa (japonica cultivar-group)
MALLLLAFFAAAATANGGAAPAASNFIRKLCRATQYPAVCVQSQASYGGAPLPRSPPELVHAVLSVSVDKAQSVSMYVGRICGPGGSRGVAGPVRDCLENMADSVGHLCDAAQELGGNMGRAGSPGFKWHLSNVQTWCSAALTDKNTCLDGLSRGVDAATRSATRGKIVVGVHRRRPPSSSTAWRGCGGRRLLVAGRARTRA

SEQ ID NO: 29126 - protein, 171 aa, Oryza sativa (japonica cultivar-group)
MWGELGNAATVAQLVGADLGGLISKIIQAAATARRNKAECEQLAVRASMIYDLLPHLQHPEVVRRPEVLRPLALLEDTLREAHQLVTCCQHKGPTYRFVMAGRLADKIRSVQARIDSYLLFLPLISHIDIIHCLDQIHRMLISTGDGDCRTMASPSADSQSLLQRRLVEES

SEQ ID NO: 29127 - protein, 399 aa, Oryza sativa (japonica cultivar-group)
MIGLIVSGGSLLLLLGFAAPFIVSKLKLQRMKKMRDKFFTQNHGLLLQQLISRNTYFAERMIINLEELEKATNNFDKTREVGDGGHGVVYKGIIDLHVVAIKKSKIVVQREIDEFINEVTILSQVNHRNVVKLLGCCLETEVPLLVYEFISNGTLYHHLHVDGPVSLSWDDRLRITVEVARALSYLHSAASMPIFHRDIKSSNILLDDSLTAKVSDFGTSRYISINQTGITTAVQGTVGYLDPMYYYTGRLTSKSDVFSFGVLLMELLTRKKPVGDTFDNGHNLVSHFVLVFSEGNLYDIIDPQVKEEDDGEALEVATLAIACTKFKGEDRPTMREVEMALENIASKKGLFHNGNTTASRRPDENQNSTLYMSVEGVTKEAITESTTEEEILLSSRFAR

SEQ ID NO: 29128 - protein, 440 aa, Oryza sativa (japonica cultivar-group)
MLSTAAPSSTSLVASFPSRARRRGLPGRRGVVVAAAGAGPGAGAAERFAASSSSITDYLRYRRPGSAGGGGGTGVCGGELQTAVVRYEKRLPWSLIHPFLHVDLVSTVHIADKEYFDRLQQALQDYDCVLYEMVTSRENLNNRKDPTFAKKLKSSRRGFSILGFIQKQMANILSLDYQLDCLDYGSEKWQHADLDFETFKQLQSERGESLFTFAVDMTLKSTKALVQPTLPDGLDFWRSKLLWASRVLPMPLVGLFLISGLCLPIDDQGGYPELEALSRLDFGAALKIFLAKQLTSDFTSMTSPIEEKSVIIGERNRVATEKIQEAINHGYKRIAVLYGGGHMPDLGRRLREELNMVPADVQWVTAWSIRSRELDRESLPFLKTMAEVSGWPLNRYETLALLIFSSVLAVDLWFWELLVGTAVNWASLAGSWIEQFNGPF

SEQ ID NO: 29129 - protein, 503 aa, Oryza sativa (japonica cultivar-group)
MATAIPQRQLFVAGEWRAPALGRRLPVVNPATESPIGEIPAGTAEDVDAAVAAAREALKRNRGRDWARAPGAVRAKYLRAIAAKIIERKSELARLETLDCGKPLDEAAWDMDDVAGCFEYFADLAESLDKRQNAPVSLPMENFKCYLRKEPIGVVGLITPWNYPLLMATWKVAPALAAGCTAVLKPSELASVTCLELADVCKEVGLPSGVLNIVTGLGSEAGAPLSSHPGVDKVAFTGSYETGKKIMASAAPMVKPVSLELGGKSPIVVFDDVDVEKAVEWTLFGCFWTNGQICSATSRLILHKKIAKEFQERMVAWAKNIKVSDPLEEGCRLGPVVSEGQYEKIKQFVSTAKSQGATILTGGVRPKHLEKGFYIEPTIITDVDTSMQIWREEVFGPVLCVKEFSTEEEAIELANDTHYGLAGAVLSGDRERCQRLTEEIDAGIIWVNCSQPCFCQAPWGGNKRSGFGRELGEGGIDNYLSVKQVTEYASDEPWGWYKSPSKL

SEQ ID NO: 29130 - protein, 499 aa, Oryza sativa (japonica cultivar-group)
MAAVAGTGVFAEILEGEVYRYYADGEWRVSASGKSVAIVNPTTRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 29131 - protein, 361 aa, Oryza sativa (japonica cultivar-group)
MTVIDGAVAADAGGAAAAVVQPGNGQTVCVTGAAGYIASWLVKLLLEKGYTVKGTVRNPDDPKNAHLKALDGAGERLVLCKADLLDYDAICRAVAGCHGVFHTASPVTDDPEQMVEPAVRGTEYVINAAAEAGTVRRVVFTSSIGAVTMDPNRGPDVVVDESCWSDLDYCKETRNWYCYGKAVAEQAAWEAARRRGVELVVVNPVLVIGPLLQPTVNASVAHILKYLDGSASKFANAVQAYVDVRDVAAAHLLVFESPSAAGRFLCAESVLHREGVVRILAKLFPEYPVPTRCSDEKNPRKQPYKMSNQKLRDLGLEFRPASQSLYETVKCLQEKGHLPVLAAEKTEEEAGEVQGGIAIRA

SEQ ID NO: 29132 - protein, 1024 aa, Oryza sativa (japonica cultivar-group)
MWTPSRGSASGRRATGHRRIADYLADDRTEASTENGSFNTAYSDELFAPTSSSAGGDGVGGMLPAFLADQSDLVEVMLELDEESMVVRSVTPTTGALYGPTSLAGGGAAHTPPGSGRSLSRCSSTSSRIRKKFAWLRSPSPAPAPRAPTPSEPPPPREAAMAARERRRIQARLNRSRSGARRALKGLRFISRTTGSAEAAELWTRVEHRFNALSRDGLLSRDNFGDCIGKQAKPSSMSMARRARARSRDDTAYGAGIGAGMEDSKEFAVGIFDALARRRRQELERISKEELYDFWVQISDQSFDARLQIFFDMVDTNVDGRITREELIVLSASANKLSKLKEQAEEYASLIMEELDPEDLGYIELWQLEALLLQRDAYMNYSRPLSSGSTAQWSQNLGGGGGGQQGGQGQGQGQSEGRRNDWRRRWSPRRAAARAQVAAEENWRRAWVLALWFAAMAGLFAWKFVQYRRTPAFRVMGYCLPTAKGAAETLKLNMALVLLPVCRNTLTWLRSSWARFFVPFDDSITFHKIIATAIALGICTHAGTHLACDFPRLIGSSREEYELLLSGFFGASRPTYRGLLAGVEGVTGIVMVVLMVVSFTLATRPLRKREAPRLPFPLGHLAGFNAFWYSHHLLIVVYLLLLVHGWFMFLVTKWHQRTTWMYIAVPLMLYVGERTLRAFRSKAYAVKILKVVCLLPGNVLTITMSKPYGFRYRSGQYIFLQCPTISPFEWFVCPSIYCFSQPCSDYLLLLLSDTTPGDDYISVHIQTRGDWTQELKRIFVENYFVPSVPRRASFGALGMAEQKSPPRLLVDGPYGAPAQDFRNYDVLLLVGLGIGATPFISILRDLLNNIKLADELMDLAMETSRSDDSANSFSVSTASSNKRRAYRTSRAHFYWVTREPGSFEWFKGVMNEVAEMDKKGVIELHNYLTSVYEERDARSTLLSMVQALNHAKHGVDIVSGTRVRTHFARPNWKEVFTRIASKHPNSTVGVFYCGKPTLAKELKKLSLDMSHKTTTRFHFHKEYF

SEQ ID NO: 29133 - protein, 315 aa, Oryza sativa (japonica cultivar-group)
MDGEEAPPGALNLADYAPAGARTVDCFRRIRKIGEGTYGEVFEAMDIITGERAALKKIKLDDGKEGFPRQILREIKLLKKLDHENIIRLKEIVVSPGTAHGAGGSDDYMYRGDIYMVFEYMDHDLKKVLHHSTPSQVKYYMEQLLKGLHYCHVNNVLHRDIKDYLLPFIGANLLISGGGKLLKLADFGLARPFTRDGSFTNHVITLWYRPPELLLGATNYAEAVDIWSVGCIFAEFLLRKPLFPGRTEENWPGVSKLPLYKTIRPTTPTKRRLRDIFHNFDSHAVDLIDRMLILNPTERISAHDALCAAYFITKM

SEQ ID NO: 29134 - protein, 478 aa, Oryza sativa (japonica cultivar-group)
MAELRTSWKSMLCCVGGGGVAGVEDDVPPERRRVRGGGHHQRLLSSSSSASSASRVSLSSLSSTGTLTPEDLSLTLSGSNLYAFTYAEMRAVTGGFSRANYLGSGGFGPVYKGRADDGLRPGLAAQAVAVKYLDLDCGTQGHREWLAEVFFLGQLRHKNLVKLIGYCYEDEHRMLVYEYMSNGSLEKHLFKSLDGAMPWMRRMQTAVGAAKGLAFLHDADTPVIYRDFKASNILLDSDFNTKLSDFGLAKDGPQGDATHVTTRVMGTNGYAAPEYIMTGHLTDKSDVYSFGVVLLELLSGRHSVDRSRRHREQSLVDWTRKYLKKPDQLHRVVMDPAMEGQYSYKGAQEAALVAYKCLSPSPKSRPSMREVVKALEPILDMNDYLQIGTFVFTVVVEDNKKDDVTKTKQVDGENKVDMRIEATVEEKHQSHHDRYRQKNPNSAIHADIVLQRDGSIGSYTTSLRRHRRTPSYLKERGA

SEQ ID NO: 29135 - protein, 398 aa, Oryza sativa (japonica cultivar-group)
MVDVDRRMAGLSPAAHAAGLRRLSTRAAAGPSSASASPRHGLHSFHALAGAVLSHLRASGVAVLPGLSDAELARAEAEMGFAFPPDLRAVLAMGLPSGPGFPDWRTRAGLRSAFDLPIAAASLQIARGALWPRCWGPRPADPDRALRLARSSIRRAPLLVPLFDRCFLPCRPCLAGNPIFFVTDDRVLCCGLDILHFFTRDSSFQPLDLRPPSSSSSVAPSSGEATPYMRRSLDAACGGKAPRWIEFWSDAASDRRRRDSSSSEASTASSSSGCASPPARRSRTPHWVDTYLDRLGSVLKSGGWRDTEVNEMVEVTASGLFDGEEAPAVDADAVLDALLLKADRCSDSLRRAGWSSEDVSDALGLDLRRCKERPRPAVQLPPEIAVKVERLAKSVARR

SEQ ID NO: 29136 - protein, 510 aa, Oryza sativa (japonica cultivar-group)
MAFLLFFVFVTAAVLCFVVPAFLLLCTSVQRRRDVGQGGGRDWQKKKKLRLPPGSMGWPYVGETLQLYSQDPNVFFASKQKRYGEIFKTNLLGCPCVMLASPEAARFVLVSQARLFKPTYPPSKERMIGPSALFFHQGEYHLRLRRLVQAALAPDSLRALVPDVDAAVAATLAAWSGGHVASTFHAMKKLSFDVGVVTIFGGRLGRRHREELRTNYSVVERGYNCFPNRFPGTLYHKAIQARKRLRAILSEIVAERRARGGGGGGGGDDLLGGLMRSRDDGTAGAVALLTDDQIADNVVGVLFAAQDTTASVLTWILKYLHDSPKLLEAVKAEQMAIYVANEGGKRPLTWTQTRSMTLTHQVILESLRMASIISFTFREAVADVEYKGFLIPKGWKVMPLFRNIHHNPDYFQDPQKFDPSRFKVAPRPSTFLPFGSGVHACPGNELAKLEMLVLVHRLVTAYRWEIVGASDEVEYSPFPVPRGGLNAKLWKQEAEEDMYMAMGTITAAGA

SEQ ID NO: 29137 - protein, 169 aa, Oryza sativa (japonica cultivar-group)
MSGNGVKKVAEVAAKAGKAIDWEGMAKMLVSDEARKEFNTLRRTFEDVNHQLQTKFSQEPQPIDWEYYRKGIGSKVVDMYKEAYESIEIPKYVDTVTPQYKPKFDALLVELKEAEKESLKESERIEKELAELQEMKKNISTMTADEYFAKHPEVKQKFDDEIRNDNWGY

SEQ ID NO: 29138 - protein, 414 aa, Oryza sativa (japonica cultivar-group)
MGGVTSSVAAKFAFFPPDPPAYGVADEEEPPPPGSAAPAAAATARRVSLTGVPWREGVEARRVRTRRGTEIIAVYVRCPKARLTVLYSHGNAADIGKMYELFVEFSARLHVNLMGYDYSGYGRSSGKASEANTFADIEAAYKCLVEVYGTREEDIILYGQSVGSGPTVDLAAQLHRIRAVVLHSPILSGLRVMYSVKKTYWFDIYKNIEKMPLVKSPVLVIHGTNDDIVDCSHGKQLWELCQNKYEPLWIEGGDHCNLQTFPVYIRHLKKFISTIENMPLEKESSSTENEKLLAETETASDGSALSDAPWTTSQRLEPPRKSTRHELPPRLSNDRVDKRRRSTGRREKPRSIVEKKEKSRRSVDTFDRTRDEHDQPDKPRKSIDRLGEMIRSMGLCNVDCFKEPPRSIETSRDR

SEQ ID NO: 29139 - protein, 432 aa, Oryza sativa (japonica cultivar-group)
MSRRSGYRAAEQEDRQVDLMGDSDFDDDEYGQPIESKEDTSAVDVKKGKDIQGIPWDNLSFSRDRYRKTRMVQYANFENVPNSGKNSEKVCTPVDKGALYYEFQYNTRSVKPTILHFQLRNLVWATTRHDVYLLSQRSVLHWSPFASEKHKVIDLQGHITPSEKHQGNVSEGFYQAQVSTLAVRGNLLVAGGFRGELICKFLDREGISYCCKSTHDDNGITNSLEIFEKPSGSVHFLASNNDCGVRDFDMEKFQICNNFRFPWAVNHTSLSPDGKLVAIVGDNPEGLIVDTNSGKTVHELRGHLDYSFASAWNPDGRTFATGNQDKTCRIWDIRNLSKSVAVLGGNMGAIRSIRYTSDGRFLAMAEPADFVHIFDVGSGYRRKQVVDFFGEISGISFSPDTEALFIGVHDRTYSSLLQYNRLRFYSYLDSAI

SEQ ID NO: 29140 - protein, 361 aa, Oryza sativa (japonica cultivar-group)
MENTTKGKVCVTGASGYVASWLVKRLLESGYHVLGTVRDPGNHKKVGHLWNLTGAKERLELVRADLLEEGSFDDAVMACEGVFHTASPVITETDSSKACYTNCEDHFHPAIMRLSFLSWNSDLRCHLVAAVLDSAINGTLNVLRSCKKNPSLKRVVLTSSSSTVRLKDEADLPPNVLLDETSWSSMEFCESLQIWYAIAKTLAEKAAWEFAKENGIDLVAVLPTFVVGPNLSHELSPTTTDVLGLFQGETTKFTMYGRMGYVHIDDVASCHILLYETPRAAGRYICNSAVLDVNELVTLLARRFPSYPIPKSLPCVYGEQTYGFSTAKVRELGMKFRDVEEMFDDAVDSLRAHGYLLNSVP

SEQ ID NO: 29141 - protein, 390 aa, Oryza sativa (japonica cultivar-group)
MSVLGVFLASLLLAAVAPARAAGGGCAAERFSSNRVYAACSDLPHLGASVHWTYDAAASASLSVAFVAAPPSPGGWVAWGLNPTGGGMAGTQALVALPKGGGGGYEVQTFDIEGYSLSAPGKLKYPATDLAAEVAADGRVSVFGKLALQNGTAEVNQVWQVGPVSSGSMVPHAMSSDNKAAMGKLNLLTGAATSSGGGGSNLRKKNTHGILNAVSWGLLLPMGAIFARYLKTFKSADPAWFYLHVACQLIGYGVGVSGWATGIHLGNLSKGITYSLHRNIGITVFALGTLQIFALFLRPKKDHKYRIYWNAYHHSVGYTIIILGIVNIFKGMSILNVEQKWKTGYIITISILGGIAVILEAVTWSIVLKRRKEENKSYNGASNGHLPLSM

SEQ ID NO: 29142 - protein, 335 aa, Oryza sativa (japonica cultivar-group)
MPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 29143 - protein, 478 aa, Oryza sativa (japonica cultivar-group)
MAGAAAASAAAAAVASGISARPVAPRPSPSRARAPRSVVRAAISVEKGEKAYTVEKSEEIFNAAKELMPGGVNSPVRAFKSVGGQPIVFDSVKGSRMWDVDGNEYIDYVGSWGPAIIGHADDTVNAALIETLKKGTSFGAPCVLENVLAEMVISAVPSIEMVRFVNSGTEACMGALRLVRAFTGREKILKFEGCYHGHADSFLVKAGSGVATLGLPDSPGVPKGATSETLTAPYNDVEAVKKLFEENKGQIAAVFLEPVVGNAGFIPPQPGFLNALRDLTKQDGALLVFDEVMTGFRLAYGGAQEYFGITPDVSTLGKIIGGGLPVGAYGGRKDIMEMVAPAGPMYQAGTLSGNPLAMTAGIHTLKRLMEPGTYDYLDKITGDLVRGVLDAGAKTGHEMCGGHIRGMFGFFFTAGPVHNFGDAKKSDTAKFGRFYRGMLEEGVYLAPSQFEAGFTSLAHTSQDIEKTVEAAAKVLRRI

SEQ ID NO: 29144 - protein, 387 aa, Oryza sativa (japonica cultivar-group)
MALPAATARAAALCRIAACASASSAAAAATGGRRGAEKLPFSLAERGMVVGGHRGMGMNAVGAPPGARIEAVRERENTLLSFGRAAAHAAVAFVEFDVQVTKDGCPIIFHDDFILTQETDAVYAKRVTDLLLEEFLSYGPQKNSHEISKPLLRRTSDGRVVNWSAKDDDSLCTLQEVFERVSPRLGFNIELKFDDDIFYERSQLDRALQAVLQVVSQYASNRPVFFSTFHPDAARIMRELQSLYPVLFLTEGGTAQHKDSRRNSLDEAIRVCLEYELHGLVSEVRGVLKNPSAVLRAKESNLALLTYGQLNNVWEAVYIQYLMGVNGVIVDLVEEISNAVADFSKPVLNQSMLGSGVDLVGAKHQAFSQQQLGFLLWLIPELIQQPH

SEQ ID NO: 29145 - protein, 344 aa, Oryza sativa (japonica cultivar-group)
MAPPLLPAAEEDGGCVARWMRRDVLLGLALGQFVSLLITSTGFSSSELARRGINAPTSQSLLNYILLSLIYGGILIYRRQPLTIKWYYYLILGIIDVEANYIVVKSYQYTSLTSVMLLDCWSIPCVIILTWIFLKTKYGLRKFIGVGVCVAGLILVVFSDVHASDRAKGPNPLKGDLLVIFGSMLYACSNVTEEYLVKKSNRIELMAMLGLFGAIISGIQISILERKELHSIKWNAGAVLPFLGFALAMFLFYSTVPTVLKICGATMLNLSLLTSDMWAVLIRIFAYHEKVDWIYFVAFAGTAAGLLIYSYKSSKEAEETAQVAGASDKQGKAGDEEAGMQNSS

SEQ ID NO: 29146 - protein, 243 aa, Oryza sativa (japonica cultivar-group)
MASMLRSASVPSSPCSNEANVEEQLQSLRATISSPSATVETMLDGFSRIGGVYRNIEEIMCFPSSQVLLCQPQQRKAAEQELERSLILLDLCNAMQESFCELKASIQDMQLAIKRADDAAVQAKVQSFIRLTKKAQKQSKKISKKSASDDQEGCTVLKLSAEAREAAISMVESSLHLLLKQIVKPNSSRWSLVSKAFQKARIACQEEQLQALELDISDLESGVETLFRRLIQSRVSLLNALSL

SEQ ID NO: 29147 - protein, 243 aa, Oryza sativa (japonica cultivar-group)
MAFHLRSASVPSSPCSNETNAEELLQSLKVTISSPSSTIETMSSGWKKLGSIYNCIDEIMCLPSSQALLCQPLQRKAVEQELEGSLVVLDLCNAIHESFSGLKACIQDMQLAVKRGDDAAVQAKIQSYIRLAKKGRKQFKHISKKSSSADQESCRVIKLLAEAREIALSMLESSSHLLSKQIALPCSSKWSLVSKTFQKRRLVCEEEQLQVLELDIVDLETGVENLFRKSIQSRVSLLNILSL

SEQ ID NO: 29148 - protein, 121 aa, Oryza sativa (japonica cultivar-group)
MNSRRDFRSHRAALFDGIEEGAIRSSAYSSQIHEHENDQAMDSLHDRVSVLKRLTGDIHEEVENHNRMLDRMGNDMDASRGFLSGTVDKFKMVFETKASRRMATMVASFISVFFLIYYLTK

SEQ ID NO: 29149 - protein, 215 aa, Oryza sativa (japonica cultivar-group)
MTGLGSPCGACKFLRRKCVKGCVFAPYFCHEQGAAHFAAIHKVFGASNASKILMHLPVSDRCEAAVTMSYEAQARLRDPIYGCVAHIFSLQQQVVSLQAQLESLKAQATQGYGDGCSISSPQNDSCGNMLTSIVQDEQQFVGPTMASNSSVKNENHSYIANGHLAPMSAQSSQGFEAELCMAEYSNTNPCCSVQGNWYHDMEDLQSVAFAYLNQA

SEQ ID NO: 29150 - protein, 454 aa, Oryza sativa (japonica cultivar-group)
MAAASPLAAAAALALLLLLLLAAPAAAEIRETVIRSDPRSIIPLDEFGFSHSGVLELNVSGIAFDPPASSELDLSQLGFFLSTLDAWVHVLRQLQDLDVTCALQADLVKLAYSFDRLRPPSNPAGVEVARSSSFSTAFPVSEPGQYTLVFANCLGGGLKVSMDVRSAMYNVDPPTGERSYLSAGATALPTIFGFFGVAYAALAAGWIAILLRKRAAVFRIHYFMLAVLVLKAVNLLAEAEDKSYIERTGTAHGWDVLFYIFSFLKGISLFTLIVLIGTGWSFLKPYLADREKKVLMVVIPLQVVANIAQVVIDESGPYARAWVTWKQVLLLVDVICCCAVLFPIVWSIKNLREAARSDGKAAVNLMKLTLFRQYYVVVICYIYFTRVVVYALMTITSYRYQWTSYVAKELATLAFYVFTGYKFRPEVHNPYFAIDDEEEEAAAEALKLDDEFEL

SEQ ID NO: 29151 - protein, 395 aa, Oryza sativa (japonica cultivar-group)
MGNCWGAKISSESPCRSASSPSGGTSKYASNSSVSAASVPPTPRSEDEILEAANVKAFAFNELRTATRNFRPDSVLGEGGFGSVFKGWIDEKTLAPTKPGTGMVIAVKKLNQEGHQGHREWLAEVNYLGQLSHPYLVRLVGYCVEDEQRLLVYEFMPRGSLENHLFRRSTHFQPLSWNLRMKIALGAAKGLAFLHSDKVKVIYRDFKTSNVLLDANYDAKLSDFGLAKDGPTGDKSHVSTRVMGTYGYAAPEYLATGHLTTKSDVYSFGVVLLEMLSGRRALDKNRPTGEHNLVEWARPYLMSKRRIFRILDARLGGQYSLAKAQKAATLALQCISVEAKNRPNMEQVVAVLEQLQDSKETGANPQLQKKSSSKNAGSNGSKPSSKGKPANARLV

SEQ ID NO: 29152 - protein, 337 aa, Bifidobacterium breve
MAENEWLSKDFYKVLGVSKDASDDDIKKAYRKLARKYHPDVNKTKEAEEKFKDISEAYDVLSKKEDRQKYDAIRQFGMGGARFAGGSGAGGFDASGFSDIFGSMFGQGAGGNGSRIRFSTSGGGNPNLNDIFSMFGGAAGQGAGGYGQQAYGNAGGYGYEEAPRPENGEDRNSKISLTLRQAVKGATVSLSVDGKKFKAHVPAGVKDGQKIKLAGKGKPGINGGKAGDLYLHVTVNPDSTFSMRGRDIVMNLPVTVGQAVAGGKVDAKDIDGNLVTFKVPAGSSSGAEVKLAGLGVKRGNQPGDLIGRVQIMVPAKPGLAVKHAAKEFDEKAGDYLN

SEQ ID NO: 29153 - protein, 216 aa, Marinibacillus marinus
MNIVLMGLPGAGKGTQAEQIIEKYEIPHISTGDMFRAAIKNGTELGLKAKSFMDQGNLVPDEVTIGIVHERLSKDDCQKGFLLDGFPRTVAQADALDSLLTDLGKKLDYVLNIKVEQEELMKRLTGRWICKTCGATYHTIFNPPAVEGICDKDGGELYQRIDDKPETVKNRLDVNMKQTQPLLDFYSQKGVLKDIDGQQDIKKVFVDINDLLGGLR

SEQ ID NO: 29154 - protein, 211 aa, Paxillus involutus
MAEGSNYDFLFKVVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYRIVSTKSLEQSSDPIRAPTSDTIPVAIDSSAPTKNGSCC

SEQ ID NO: 29155 - protein, 494 aa, Paxillus filamentosus
KLQQIYDAEHPRLILKELFAQDPDRFSKFSKEYVDPTDPNTTFLIDYSKNLITQPILDTLLSLASEAELETYRDKMFAGERINTSEDRAVLHVALRNFDDFKIQEKGVEEVASVLAHMKEFSDAIRSGSWKGYTGKTINTIVNIGIGGSDLGPVMVTEALKPYAKRDLTALFVSNIDGTHLAETLRECDPERTLFIIASKTFTTQETITNAESARDWFLSFAKDKAHVAKHFVALSTNTKAVTAFGIDGANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKNGERVDYQTGPIIWGAAGTNGQHSFYQLVHQGTKLIPADFLAPATSHNPIADSKHHRILLSNFFAQPEALAFGKTEEEVRKELGRGASEALVKSKVFEGNRPSNSIMFPLLTPRTLGALISLYEHKIFTQGVIWGINSY

SEQ ID NO: 29156 - protein, 161 aa, Paxillus involutus
VVLIGDSGVGKSNLLSRFTRNEFNLDSKSTIGVEFATRSINVDSKTVKAQIWDTAGQERYRAITSAYYRGAVGALLVYDISKHATYVNVTRWLKELRDHADSNIVIMLVGNKSDLKHLRAVPTEEAKNFSAENELSFIETSALDASNVESAFQTILTDVYR

SEQ ID NO: 29157 - protein, 161 aa, Paxillus involutus
VVLIGDSGVGKSNLLSRFTRNEFNLDSKSTIGVEFATRSISVDGKTVKAQIWDTAGQERYRAITSAYYRGAVGALLVYDISKHATYVNVTRWLKELRDHADSNIVIMLVGNKSDLKHLRAVPTEEAKNFSTENELSFIETSALDASNVESAFQTILTDVYR

SEQ ID NO: 29158 - protein, 510 aa, Paxillus involutus
  misc_feature (21)..(21): Xaa can be any naturally occurring amino acid
  misc_feature (99)..(99): Xaa can be any naturally occurring amino acid
  misc_feature (183)..(183): Xaa can be any naturally occurring amino acid
  misc_feature (438)..(438): Xaa can be any naturally occurring amino acid
GARDASFAHLTDPRRKWYNNXRIIILNAWIVLLLITSSTNGYDGSMMNGLQSLPQWESAFGYPTGGKLGLLNAIQNIGALAGYPFAPYMSDGIGRRRTXWFGATIMCIATAVQTASKSVGMFIGARFLIGFGLTFAANSAPMLVTEISYPTYRAPLTSMYNSLWYSGSIVAAWTTYGTFKINXTWAWRLPSLLQAVPSILQFALVLFAPESPRWLISKGREAEALQTLAYYHADGNDQDPLVQYEFEEIRAALQFDRTVASNVGWKSLIATPGNRKRMRIIVALAFFSQWSGNGLVSYYLTEVFDQIGITGSSTQLLINGILQIWNLGWAVFAALMVNRLGRRFLFLTSASLMTLFYMAQAICFSQYTQHKAPAAGHAVIGFIFLFYAAYDLAFTPLIVSYTVEILPYNLRAKGFNIFSFVISLALIFNQYVNPIALXALGWKYYLVYVFWLAFELVYLWFFLVETKNRTLEETAALFDGEEALQQIAHQAETHEVREKASLERESFVAV

SEQ ID NO: 29159 - protein, 510 aa, Paxillus involutus
GARDASFAHLTDPRRKWYNNRRIIILNAWIVLLLITSSTNGYDGSMMNGLQSLPQWESAFGYPTGGKLGLLNAIQNIGALAGYPFAPYMSDGIGRRRTIWFGATIMCIATAVQTASKSVGMFIGARFLIGFGLTFAANSAPMLVTEISYPTYRAPLTSMYNSLWYSGSIVAAWTTYGTFKINSTWAWRLPSLLQAVPSILQFALVLFAPESPRWLISKGREAEALQTLAYYHADGNDQDPLVQYEFEEIRAALQFDRTVASNVGWKSLIATPGNRKRMRIIVALAFFSQWSGNGLVSYYLTEVFDQIGITGSSTQLLINGILQIWNLGWAVFAALMVNRLGRRFLFLTSASLMTLFYMAQAICFSQYTQHKAPAAGHAVIGFIFLFYAAYDLAFTPLIVSYTVEILPYNLRAKGFNIFSFVISLALIFNQYVNPIALGALGWKYYLVYVFWLAFELVYLWFFLVETKNRTLEETAALFDGEEALQQIAHQAETHEVREKASLERESFVAV

SEQ ID NO: 29160 - protein, 510 aa, Paxillus involutus
  misc_feature (21)..(21): Xaa can be any naturally occurring amino acid
  misc_feature (99)..(99): Xaa can be any naturally occurring amino acid
  misc_feature (438)..(438): Xaa can be any naturally occurring amino acid
GARDASFAHLIDPRRKWYNNXRIIILNAWIVLLLITSSTNGYDGSMMNGLQSLPQWESAFGYPTGGKLGLLNAIQNIGALAGYPFAPYMSDGIGRRRTXWFGATIMCIATAVQTASKSVGMFIGARFLIGFGLTFAANSAPMLVTEISYPTYRAPLTSMYNSLWYSGSIVAAWTTYGTFKINSTWAWRLPSLLQAVPSILQFALVLFAPESPRWLISKGREAEALQTLAYYHADGNDQDPLVQYEFEEIRAALQFDRTVASNVGWKSLIATPGNRKRMRIIVALAFFSQWSGNGLVSYYLTEVFDQIGITGSSTQLLINGILQIWNLGWAVFAALMVNRLGRRFLFLTSASLMTLFYMAQAICFSQYTQHKAPAAGHAVIGFIFLFYAAYDLAFTPLIVSYTVEILPYNLRAKGFNIFSFVISLALIFNQYVNPIALXALGWKYYLVYVFWLAFELVYLWFFLVETKNRTLEETAALFDGEEALQQIAHQAETHEVREKASLERESFVAV

SEQ ID NO: 29161 - protein, 510 aa, Paxillus involutus
  misc_feature (368)..(368): Xaa can be any naturally occurring amino acid
GARDASFAHLIDPRRKWYNNKRIIILNAWIVLLLITSSTNGYDGSMMNGLQSLPQWESAFGYPTGGKLGLLNAIQNIGALAAYPFAPYMSDGIGRRRTVWFGATIMCIATAVQTASKSVGMFIGARFLIGFGLTFAANSAPMLVTEISYPAYRAPLTSLYNSLWYSGSIVAAWTTYGTFKINSTWAWRLPSLLQAVPSILQFALVLFAPESPRWLISKGREAEALQTLAYYHADGNDQDPLVQYEFEEIKAALQFDRTVASNVGWKSLIATPGNRKRMRIIVALAFFSQWSGNGLVSYYLTKVFDQIGITGSSTQLLINGILQIWNLGWAVFAAFMVNRLGRRFLFLTSASLMTLFYMAQAICFSQYXQHGAPAAGHAVIGFIFLFYAAYDLAFTPLIVSYTVEILPYNLRAKGFNIFSFVISLALIFNQYVNPIALDAIGWKYYLVYVCWLAFEFVYLWFFLVETKNRSLEETAALFDGEEALQQISHKAETHEVREKASLERESFVAV

SEQ ID NO: 29162 - protein, 510 aa, Paxillus involutus
  misc_feature (488)..(488): Xaa can be any naturally occurring amino acid
GARDASFAHLIDPRRKWYNNKRIIILNAWIVLLLITSSTNGYDGSMMNGLQSLPQWESAFGYPTGGKLGLLNAIQNIGALAAYPFAPYMSDGIGRRRTVWFGATIMCIATAVQTASKSVGMFIGARFLIGFGLTFAANSAPMLVTEISYPAYRAPLTSLYNSLWYSGSIVAAWTTYGTFKINSTWAWRLPSLLQAVPSILQFALVLFAPESPRWLISKGREAEALQTLAYYHADGNDQDPLVQYEFEEIKAALQFDRTVASNVGWKSLIATPGNRKRMRIIVALAFFSQWSGNGLVSYYLTKVFDQIGITGSSTQLLINGILQIWNLGWAVFAAFMVNRLGRRFLFLTSASLMTLFYMAQAICFSQYAQHGAPAAGHAVIGFIFLFYAAYDLAFTPLIVSYTVEILPYNLRAKGFNIFSFVISLALIFNQYVNPIALDALGWKYYLVYVCWLAFEFVYLWFFLVETKNRSLEETAALFDGEEALQQIXHKAETHEVREKASLERESFVAV

SEQ ID NO: 29163 - protein, 494 aa, Paxillus involutus
  misc_feature (141)..(141): Xaa can be any naturally occurring amino acid
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTXVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 29164 - protein, 494 aa, Paxillus involutus
KLQQIYDAEHPRLILKELFSQDPHRFSKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGVWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 29165 - protein, 494 aa, Paxillus involutus
  misc_feature (314)..(314): Xaa can be any naturally occurring amino acid
KLQQIYDAEHPRLILKELFSQDPHRFAKFSKEYVDPTDPNTTFLLDYSKNLVTQPILDTLLSLASEAQLETYRDKMFAGERINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHLAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGXWYNDFYGAQTHALLPYDQYLHKFADYFQQGDMESNGKFVTKSGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 29166 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFAEYFQQGDMESNGKFVTKGGERVDYQTGPIIWGAAGTNGQHSFYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 29167 - protein, 494 aa, Paxillus involutus
KLQQIYDAEHPRLILKDLFSQDPHRFSKFSKEYVDPTDPNTTFLLDYSKNLVTQPILDTLLSLASEAELETYRDKMFAGEHINTSEDRAVLHVALRNFDDFKIQENGVEEVASVLAHMKEFSEAIRSGSWKGYTGKTINTIVNIGIGGSDLGPVMVTEALKPYAKRDLTALFVSNIDGTHIAETLRECDPERTLFIIASKTFTTQETITNAESARAWFLSFAKDKAHVAKHFVALSTNTKAVTAFGIDEANMFQFWDWVGGRYSLWSAIGLSIALYIGYDNFESLLKGAHGMDKHFKETPLESNLPVLLAVVGIWYNDFYGAQTHALLPYDQYLHKFADYFQQGDMESNGKFVTKGGERVDYQTGPIIWGAAGTNGQHSLYQLVHQGTKLIPADFLAPATSHNPIADSKHHRILLSNFFAQPEALAFGKTEEEVRKELGSGASEALVKSKVFEGNRPSNSIMFPLLTPRTLGALIALYEHKIFTQGVIWGINSF

SEQ ID NO: 29168 - protein, 380 aa, Pseudomonas marginalis [sequence omitted]

SEQ ID NO: 29169 - protein, 376 aa, Nerium oleander
MAIDCMFKSKSTVPEMCKDEKKPLVFDASLLQHQTHIPTEFIWPEHEKPCPNPREHPVPLIDLGGFLSGNPVAAMEASRLVGEACQEHGFFLVVNHGVDADLIADAHRYMDYFFELPLCDKQRAQRKLGEHCGYASSFTGKISTKLPWKETLSFRFSAEKRSSHMVEEYFEKTLGDEFAHLGNVYQEYCNAMSTLSLGIMELLGMSLGISRESFKDFFQDNESIMRLNYYPPCQKPELTLGTGPHCDPTSLTILHQDTVGGLQVFVDGEWRSISPNVSAFVVNIGDTFVALSNGRYKSCLHRAVVNNKTPRKSLAFFLCPKEDKVVSPPSELVDSNNPRIYPDFTWAKLLEFTQKHYRADMNTLQIFSNWLQQKNS

SEQ ID NO: 29170 - protein, 488 aa, Saccharomyces cerevisiae
MAETERLMPNGGSRETKPLITGHLILGTIVACLGSIQYGYHIAELNAPQEFLSCSRFEAPDENISYDDTWVGQHGLKQCIALTDSQYGAITSIFSIGGLFGSYYAGNWANRYGRKYVSMGASAMCMVSSLLLFFSNSYLQLLFGRFLVGMSCGTAIVITPLFINEIAPVEWRGAMGSMNQVSINLGILLTQTLALKYADSYNWRWLLFSGSVIAVANILAWLKVDESPRWLVSHGFVSEAETALFKLRPGTYQQAKQEIQDWQRSHGHNRDPESSEETHSGPTLWQYVTDPSYKKPRTVILAILSCQQFCGINSIIFYGVKVIGKILPDYSIQVNFAISILNVVVTLAASAIIDHVGRRPLLLASTTVMTAMSLLISVGLTLSVSFLLVTATFVYIAAFAIGLGPIPFLIIGELSYPQDAATAQSFGTVCNWLATFIAGYLFPIGHGLMGGYVFAIFAAIAAMFATYVYKRVPETKGKTTYSEVWAGY

SEQ ID NO: 29171 - protein, 344 aa, Saccharomyces cerevisiae
MSNTVLVSGASGFIALHILSQLLKQDYKVIGTVRSHEKEAKLLRQFQHNPNLTLEIVPDISHPNAFDKVLQKRGREIRYVLHTASPFHYDTTEYEKDLLIPALEGTKNILNSIKKYAADTVERVVVTSSCTAIITLAKMDDPSVVFTEESWNEATWESCQIDGINAYFASKKFAEKAAWEFTKENEDHIKFKLTTVNPSLLFGPQLFDEDVHGHLNTSCEMINGLIHTPVNASVPDFHSIFIDVRDVALAHLYAFQKENTAGKRLVVTNGKFGNQDILDILNEDFPQLRGLIPLGKPGTGDQVIDRGSTTDNSATRKILGFEFRSLHESVHDTAAQILKKENRL

SEQ ID NO: 29172 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELGSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 29173 - protein, 384 aa, Saccharomyces cerevisiae
MSFSNSKDKSVVAVYKLVKAPIYSHCFSQDKSILAVTCETDCLVYRVSNNTPPVLFATLKDHDKTITAVDISIHGRIVTCSQDRNAYVWEPLSDGTYKPTLVLLRINRAATSVTWAPNGYKFAVGSSARIIAVCYYEHENNWWVSKHIKKPIKSTINCLSWHANGVLLAAGGTDGFMRVFSGFIKGLDSKESVAGSPWGQKFPFGCLIREWYQGSYIHDVEWRSQMERIAYVAHDGTLNVVDYQSPVQSVNAPEGLPYRSLVWINDHEIVCGGYSCHPVLFSEASEGWKFAKNLDKSDNNKSSALTASGNTDELSGNNDESSTFGISALRKFKELDLKGKVSTDVQESAHENAIVELRPFAESNGQITQVSSCGLDGKIVIYTI

SEQ ID NO: 29174 - protein, 348 aa, Saccharomyces cerevisiae
MTTEKTVVFVSGATGFIALHVVDDLLKTGYKVIGSGRSQEKNDGLLKKFKSNPNLSMEIVEDIAAPNAFDKVFQKHGKEIKVVLHIASPVHFNTTDFEKDLLIPAVNGTKSILEAIKNYAADTVEKVVITSSVAALASPGDMKDTSFVVNEESWNKDTWESCQANAVSAYCGSKKFAEKTAWDFLEENQSSIKFTLSTINPGFVFGPQLFADSLRNGINSSSAIIANLVSYKLGDNFYNYSGPFIDVRDVSKAHLLAFEKPECAGQRLFLCEDMFCSQEALDILNEEFPQLKGKIATGEPGSGSTFLTKNCCKCDNRKTKNLLGFQFNKFRDCIVDTASQLLEVQSKS

SEQ ID NO: 29175 - protein, 429 aa, Saccharomyces cerevisiae
MVDVEEKGQEVEYVDPTVNRVPNYEVSEKAFLLTQSKVSIEQRKEAAEFVLAKIKEEEMAPYYKYLCEEYLVNNGQSDLEHDEKSDSLNEWIKFDQELYNELCKKNESKIKELNEKIQKLEEDDEGELEQAQAWINLGEYYAQIGDKDNAEKTLGKSLSKAISTGAKIDVMLTIARLGFFYNDQLYVKEKLEAVNSMIEKGGDWERRNRYKTYYGIHCLAVRNFKEAAKLLVDSLATFTSIELTSYESIATYASVTGLFTLERTDLKSKVIDSPELLSLISTTAALQSISSLTISLYASDYASYFPYLLETYANVLIPCKYLNRHADFFVREMRRKVYAQLLESYKTLSLKSMASAFGVSVAFLDNDLGKFIPNKQLNCVIDRVNGIVETNRPDNKNAQYHLLVKQGDGLLTKLQKYGAAVRLTGSDRV

SEQ ID NO: 29176 - protein, 314 aa, Saccharomyces cerevisiae
MFKEEDSLRKGQNVAAWKTLLAGAVSGLLARSITAPMDTIKIRLQLTPANGLKPFGSQVMEVARSTIKNEGIRSFWKGNIPGSLLYVTYGSAQFSSYSLFNRYLTPFGLEARLHSLVVGAFAGITSSIVSYPFDVLRTRLVANNQMHSMSITREVRDIWKLEGLPGFFKGSIASMTTITLTASIMFGTYETIRIYCDENEKTTAAHKKWELATLNHSAGTIGGVIAKIITFPLETIRRRMQFMNSKHLEKFSRHSSVYGSYKGYGFARIGLQILKQEGVSSLYRGILVALSKTIPTTFVSFWGYETAIHYLRMY

SEQ ID NO: 29177 - protein, 400 aa, Saccharomyces cerevisiae
MPFVKGFEPISLRDTNLFEPIKIGNTQLAHRAVMPPLTRMRATHPGNIPNKEWAAVYYGQRAQRPGTMIITEGTFISSQAGGYDNAPGIWSDEQVAEWKNIFLAIHDCQSFAWVQLWSLGWASFPDVLARDGLRYDCASDRVYMNATLQEKAKDANNLEHSLTKDDIKQYIKDYIHAAKNSIAAGADGVEIHSANGYLLNQFLDPHSNKRTDEYGGTIENRARFTLEVVDALIETIGPERVGLRLSPYGTFNSMSGGAEPGIIAQYSYVLGELEKRAKAGKRLAFVHLVEPRVTDPSLVEGEGEYSEGTNDFAYSIWKGPIIRAGNYALHPEVVREQVKDPRTLIGYGRFFISNPDLVYRLEEGLPLNKYDRSTFYTMSAEGYTDYPTYEEAVDLGWNKN

SEQ ID NO: 29178 - protein, 413 aa, Rhodococcus sp. RHA1
MTSDIVVIGGGVAGVTAAQSLRSEGYDGRLVLIGKERELPYDRTALSKAVLAGDLADPPLLFPADWYDEWQIETVLDRTVLQVDVTRREVLLDGGPWLKVDRVHLATGASARVPSFSGSDLPGVATLRTADDVHRMRRDWEPGQRLVVVGGGLIGCEVATTARKLGLEVSILEASDELLQRVLGRRIGGWCRARLMELGISVVLNTGVAEFKGVDRITTVIGTDGRSFVADRAIVCVGAEPETAIAEQSGLACNRGILVNDSGGTAAEGVFAAGDVASWPLLTGGRRSLETYINSQREATAVASAMLGKAVHGPQLPLSWTEMAGHRIQMIGDIEGSGEYVMRGDPDDGPALLFRLSDGRVTAAVSVDAPRDFAMATRLVERGAQVGREVLGDTSMELRELNRAARERALIAE

SEQ ID NO: 29179 - protein, 111 aa, Oryza sativa
PSPNGESTVSCHQISKMPNLAFTIANRTFILTPEQYIVKLEQGGQTVCISGFMAFDIPPPRGPLWILGDVFMGAYHTVFDFGKDRIGVAKSAWRSVCRSLFQITEISLYIS

SEQ ID NO: 29180 - protein, 320 aa, Aeropyrum pernix K1
MTPPVGDVGLYTRVHSPAYLRHVLSTAESGLDWLDPDTYVGPGTLVALKRLGGASVEVYNIVRSGGEALLLGRPPGHHAGIRGRALGAPTAGFCIVNTAALIARMLSEQGKTVILDFDLHHGNGTQEIFYDDPDVYHVDVHQDPTTIYPGTGFPEDIGEGDAKGTKINIILPPNSGDDIYVSAARLALGILERLEPDYIVVSAGFDAYRGDNAFTVMRGGTAMYYLIGSELSRMARRGVAAVLEGGYGVGLRRALPAFAAGLANLENPYPDTEEESPPSVKRMYVAGLKRLAAAIKGLNRVVEEAVLEELERGGWEKRYG

SEQ ID NO: 29181 - protein, 348 aa, Kluyvera ascorbata
VAQRPDTHGYSTSRGIPRLRRAISRWYHDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVEMPKASMYVWAKIPDKYAAMGSLEFAKKLLQDAKVCVSPGIGFGDYGDTHVRFALIENRDRIRQAIRGIKAMFRADGLLPSEHKSAE

SEQ ID NO: 29182 - protein, 368 aa, Oryza sativa (japonica cultivar-group)
MAGSCSVASSNKSKLADEEFSPVGMRVLLIDESTTYLKIITKLLLNCGYKGLTVTNFEITYVWRVDEVTPKTAARDAVEELHENPWSYDMVLTEVHAPAGIDGFNLLQYAGTDMDLPVVVFSADDDKRTVLKCVNSGACDYLVKPLRHEELKNIWQHVYRRKLRSGGRRAAAAGNSSKGEIKKRFRWPKELHERFVSVVLQLGVDKATPNQILPLLNREDLTRDQRFRIALTKSKALPSCSTIPIGETVHGIPLALQAIGTGNNQHLIVPFNRITFVRPRGVEIGQNGVVGGLVTGNNNVVVPTATSIIARAFGREIVNGADLFDHGTLIRDSSSTSHDGAQNELGETNLAFELMAKKGSDVEPRIGG

SEQ ID NO: 29183 - protein, 395 aa, Oryza sativa (japonica cultivar-group)
MLAAVRRRRLLLLPLPLRFFSAAAAAASTTTDPKVVSYLISSCGLTPAAAARAAATSPWLPLASPDFASNADAVVALLRRYGFTDADISATVRAFSRILASDPARTLQPKLDYLRSVGITAPLLPRVVSLSPVILHRSIESHLAPLIASLREVLGSDSRIVTALRQMPFAMRCSPKATFLRTLPVLRDVHGLTPSELSKLVASQPGVILLGPGRAGEIVQAVKDAGVEPGSPMFVYIFAAFSKLKAPTLENKFAIYRSLGFGKDDIAVMLRRLPNAAGISEERLKRTVGFLTGKAGLRREDIVAYPNLLSRSLDSHARRCAVLAVLRREGKPEGQHRVPHVLVASLARFMKAYVRRYEGEVPDVLRAINGEIPFEGFGLGELEKKKPQRQEKIRR

SEQ ID NO: 29184 - protein, 479 aa, Brassica rapa
MANIAGQLKRGISRQLSSVSLRRTFSRQFTRQASHDPRRINMRFSFGRQSSLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGSMDVYNILKARGAKVPKTKRTPMVVANPREVPEYELNPQELQVRKADGISKSCQGIYQVAKWNGTKVSVKILDKDLYKDNETIEAFKHELTLLEKVRHPNVVQFVGAVTQNVPMMIVSEYHPKGDLGSYLQKKGRLSPSKVLRFALDIARGMNYLHECKPEPVIHCDLKPKNIMLDNGGLLKVAGFGLISFEKLSSDKSKVLNHGAHIDLSNYCVAPEVYRDEIFDRSADSYSFGVVLYEMIEGVQPFHPKPPEEAVKLMCLEGRRPSFKAKTKSCPEEMRELIEECWDVKAVVRPTFSEIIVRLDRIFVQCSKQGWWKDTFKFPWK

SEQ ID NO: 29185 - protein, 434 aa, Caulobacter vibrioides
AIYPVILCGGSGTRLWPASRSDHPKQFLKLVSDRSSFQETVLRVKDIPGVAEVVVVTGEAMVGFVSEQTAEIGAWATILVEPEARDSAPAVAAAAAYVEAQDPAGVVLMLAADHHIAQPEIFQQAALTATKAAEQGYIVTFGVQPTVPATGFGYIRPGAPLLDGSVREVAAFVEKPDQATAERYLLEGYLWNSGNFAFQAATLLGEFETFEPSVAAAAKACVAGLQLEAGIGRLDREAFAQAKKISLDYAIMERTQKAAVAPAAFAWSDLGAWDAIWEASTRDGDGNAQTGDVDLHGSSNVLVRSTGPYVGVIGVNDIVVVAEPDAVLVCHRKDSQAVKTLVDGLKAKGRSIASRKSASPNGTETLVSTDGFDVELRRVPAGETLMLPVSTLQVLEGVIEMDGDVYAAGAIIALDDSVQARAIGAATLLVTKPR

SEQ ID NO: 29186 - protein, 502 aa, Atriplex hortensis
MAFPIPARQLFIDGEWREPLLKNRIPIINPSTEEIIGDIPAATAEDVEVAVVAARKAFKRNKGRDWAALWSHRAKYLRAIAAKITEKKDHFVKLETLDSGKPRDEAVLDIDDVATCFEYFEYFAGQAEALDAKQKAPVTLPMERFKSHVLRQPIGVVGLISPWNYPLLMDTWKIAPALAAGCTTVLKPSELASVTCLEFGEVCNEVGLPPGVLNILTGLGPDAGAPIVSHPDIDKVAFTGSSATGSKIMASAAQLVKPVTLELGGKSPVIMFEDIDIETAVEWTLFGVFWTNGQICSATSRLLVHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 29187 - protein, 382 aa, Bacillus cereus
MSNAEEILGVVDEFAEKKLRPRASEFESNEELPYDVIQEISSYGVLGATIPKEYGGLSLDSLDYGRLTEIIGKACNSVRELLTVHVSLVGESIKRWGTEEQKRKWLPEMAKGNLLFSFALTEPEVGSDAKAVGTSYKQVNDHFILNGHKKWISFADIADCFLVFASSEGKVSAFIVERSMTGVSTNKMSKLLASNSSHIAEIHLQDVKVPAENLLGPIGGGWSYVVNTALDHGRYSIAWAGVAIAQEALEAMVAYSRRRKQGNKYICEYEAIQTILAEASVNIKAARSLCQEAGKKRQDRQTDAVIETTIAKYFASKMAMKVATDAVQVFGGNGFSREYPVERLFREAKVLEIIEGTSQVLQPIIAQHALRTCSQKGGLLRI

SEQ ID NO: 29188 - protein, 255 aa, Brassica oleracea
MGIYSKPVAVSLIVSFLLFLSASAERNDGTFRVGLKKLKLDRKSRIAARVGSKQLKPLRGYGLGDSGDADIVTLKNYLDAQYYGEIAIGTPPQKFTVVFDTGSSNLWVPSSKCYFSIACLFHSKYKSSRSSTYEKNGKSAAIHYGTGAIAGFFSNDAVTVGDLVVKDQEFIEATKEPGITFVLAKFDGILGLGFQEISVGNAAPVWYNMLKQGLYKEPVFSFWLNRNAEDEEGGELVFGGVDPNHYKGEHIYVPV

SEQ ID NO: 29189 - protein, 264 aa, Oryza sativa (japonica cultivar-group)
MNNDLGGLGGRPATSQANPFESALYGAGPGLIRSGLGAYGEKFLGSSSEFMQSNITQYLSNPQYYFQVNSQYVRNKLKVILFPFLHRGHWTRITEPVGGRLSYKPPIQDINAPDLYIPLMAFGTYVVIAGYALGVLGRFTPEALTLQFTKGLLGWFLQVILIRVLLYTLGSGEAPLLDIVAYAGYGFAGTSLAMLVRVFWSPSYYFVLPWFSICTGVFLVKTMKRVLLGAPRSYERHPSRNHYFLLFLAVVQFPMLFWLGNISG

SEQ ID NO: 29190 - protein, 260 aa, Oryza sativa (japonica cultivar-group)
MSSVLLFLLLLLLSGVSLSGCIRLGNGGYEEWRMGSATYIKESLGHPLNDGGGACGYGDLDIFRYGRYTAGVSGALFGRGSACGGCYEVRCVNHVLWCLRGSPTVVVTATDFCAPNLGLSDDYGGWCNFPKEHFEMSEAAFLRVAKAKADIVPVQFRRVSCDRAGGMRFTITGGASFLQVLITNVAADGEVAAVKVKGSRTGWIPMGRNWGQNWQCDADLRGQPLSFEVTGGRGRTVVAYSVAPPDWMFAQTFEGKQFVE

SEQ ID NO: 29191 - protein, 321 aa, Oryza sativa (japonica cultivar-group)
MAASAAAAAAVSQALRDRDVLDAVGTSAAALSLAGSSFIVLCYLLFRELRKFSFKLVYFLAVSDMFCSLFTIMGGPSNAFYCFAHDYSAHFFCVASFLWTTTIAFTLHRTVVKHKTDVEEFGSIFHLYVWGTSLATTVLRSIGSDYGRPGTWCWIQQGSMGKVLHLVTFYLPLWGAILYNGYTYFQVNRMINNATRMAVGISDRSIQSDVRADKKAFNRWGYYPLILIGSWAFATINRVHDFANPGHKIFWLSILDVGFAGLMGLFNSIAYGLNSSVRRAIAERLDMYLPERFKRSLPTLTRFKSQQENELTSLIVDASNT

SEQ ID NO: 29192 - protein, 321 aa, Oryza sativa (japonica cultivar-group)
MAAAAARQTVCVTGAGGFMASSHVELLLSRGNYAVRGTVRDPGDAKNDHLRALQGAEERLQLLKADLLDYDSVASAVAGCEGVFHVASPVPSGRSTNPEVEVIAPAVTGTLNVLKACHEAKVKRVVMVSSIAAVFSNPNWPKDKAFTEDSWSDEELCRKNQDWYYLSKTVAEREAFAYAAKTGLDIVTICPSLVIGPLMQSTVNASSKVLINYFKGDRDTVENRLRNVVDVRDVANALLLAYENPASGRYICSSAPIRVSDMINILKTLYPTYTYPKNFVDVEENTIYSFEKLQKLGWSFRPIEETLRDSVESYKAFGILD

SEQ ID NO: 29193 - protein, 321 aa, Oryza sativa (japonica cultivar-group)
MLGGDGRTKTVCVTGAGGFVASWLVKLLLSRGCYTVHGTVRDPGDAKNAHLMSLDGAAERLRLFKADLLDYGSVAAAIAGCDDVFHVACPVLLSAPNPEVDILAPAVTGTTNVLKACSEAKVGRVVVVSSVSAAMVNPNWSEGKAIDEDCWSDVDYCRATKNWYTLGKTLAEIEAFDYAKRSGLDLVTLCPSLVIGPLLQPTVNASSTVILGCLKGDCEVKIKLRNFVDVRDVADALLLLYETPGVSGRYICSSHARRMPHIIDLLKSWYPGYKFADKFVEVSDEPQFNSGKLEKLGWKIKPFEETLRDSVESYRAAGVLD

SEQ ID NO: 29194 - protein, 202 aa, Oryza sativa (japonica cultivar-group)
MGSGLSCNHRSSTLLRHHQPAAAPPAQVIAADGSLTEVAAAAASCPVSVSDVLGGNAGRLFLCSSDALYFDVDVPALDGGELLRPGQIYFLLPVSMLGRPLSGVDMAALAVRASDALVARARPRHQRGGGVKKVRIMPMLAANGCGGDDRDGEINEKLAHNCYISIYLLSIIYYLSIYLLSIYLSIYLLSIIYLSIYLSIIY

SEQ ID NO: 29195 - protein, 391 aa, Oryza sativa (japonica cultivar-group)
MVQHHQAAANDDHQAIPLLTPYKQAGRPGSKLDLSHRVLLAPMTRCRSYGNVPQPHAALYYTQRATRGGLLITEATGVSATAQGYPETPGVRTREHVEAWKPIVDAVHRKGALFICQLWHVGRVSNNGFQPDGLAPISSTDKAITPDGYGMVYSKPRRLRTDEIPQIVDDFRLAARNAVEAGFDGVEIHGANGYLLEQFMKDSSNDRTDEYGGSLENRCRFAVEVIDAVVGEIGAHSVGIRLSPFLDYMDCVDSDPEALGSYMVEQLNKHEDFLYCHMVEPRMAIVDGRRQIQHGLLPFRKQFNGTFIAAGGYDREEGNKAVADGYADLVAYGRLFLANPDLPKRFELDAPMNNYDRNTFYTQDPVVGYTDYPFLDEHHHDDDDDSNAPSA

SEQ ID NO: 29196 - protein, 374 aa, Oryza sativa (japonica cultivar-group)
MVNQAAMPLLTPYKQAGGKIDLSHRVLLSPMTRCRSYGNVPQPHAALYYTQRATSGGLLITEATGVSDTAQGYPETPGVWTREHVEAWKPIVDAVHRKGALFICQLWHVGRVSTNDYQPNGQAPISSSDIQITPDGSGIVYSKPRRLRVDEIPQIVDDFRLAARNAIEAGFDGVEIHGANGYLLEQFMKDSSNDRTDEYGGSLENRCRFAVEVIDAVVGEIGAHRVGIRLSPFLDFMDCVDSDPEALGSYMVEQLNKHEGFLYCHMVEPRMAIVDGRRQIQHGLLPFRKAFKGTFIAAGGYDREEGNKVIENGYTDLVSFGRLFLANPDLPKRFELDAPLNKYDRNTFYTQDPIVGYTDYPFLDEDQNNSVADA

SEQ ID NO: 29197 - protein, 380 aa, Oryza sativa (japonica cultivar-group)
MAREAEKDAAAAAEIPLLTPYKMGRFELSHRVVLAPLTRNRSYGNVPRPHAVLYYTQRATSGGLLVTEATGVSDTAQGYPDTPGIWTQQQVEAWKPIVDAVHRKGALFICQLWHVGRVSTNEYQPDGQAPISSTDRQITPDDSGIVYSKPRRLRTEEIPQIIDDFRRAARNAIEAGFDGVEIHGAHGYLLEQFMKDSANDRSDEYGGSLENRCRFVVEVIDAIVAEVGAHRVGIRLSPFIDYMDCVDSDPVALGSYMVQQLNKHPGFLYCHMVEPRMAIVEGRRKITHGLLPFRKLFNGTFIAAGGYDREEGNKVIADGYADLVAYGRHFLANPDLPKRFAINAPLNKYNRSTFYIQDPVVGYTDYPFLDEKDEGAATYA

SEQ ID NO: 29198 - protein, 382 aa, Oryza sativa (japonica cultivar-group)
MVQAQAAAKEAAAAAIPLMAPYKMGRFELSHRVVLAPLTRCRSYDHVPQPHAALYYSQRATNGGLLISEATGVSATGEGYPEIPGVWTRQQVKAWKPIVDAVHRKGALFFCQLAHVGRASTNDQQPNGQAPISSTDKQITPDDSHTVYSKPRRLRTDEIPHVVDDFRVAARNAIEAGFDGVEIHGAHGYLIDQFMKDSANGRTDQYGGSLENRCRFAVEVIDAVVAEVGADRVGIRLSPYIDFMDCFDSNPEALGSYMVRQLNKHPELLYCHMVEPRMATVEGRRKINHGLLPFRKQFNGTFIASGGYDREEGNKVVDDGYADLVAYGRLFLANPDLPRRFELNAPLNKYDGSTFYTHDPVVGYTDYPFLEEKKEDSATVIV

SEQ ID NO: 29199 - protein, 376 aa, Oryza sativa (japonica cultivar-group)
MVHAPAKEAIPLLTPYKMGQLELSHRVVLAPLTRCRSYGHVPQPHAAVYYSQRATNGGLLIAEATVISPTAQGYPDTPGIYTQQQIEAWKPIVDAVHRKGALFFLQIWHVGRVSTTDFQPNGQAPISSTDKQITPDDSGMVYSKPRRLRTDEIPQIVDDFRRAARNAIESGFDGVEIHGAHGYLLDQFMKDSANDRTDEYGGNLENRCRFAVEVIDAVVAEVGAHRVGIRLSPFDNYMDCFDSNPVALGSYMVQQLNKHPGFLYCHMVEPGMAIVEGRRKITHGLLPFRKQFNGTFIAAGGYDREEGNKVVADGYADLVAYGRLFLANPDLPRRFELDAPLNRYDRSTFYTQDPVVGYTDYPFLEEIDEESTTTYA

SEQ ID NO: 29200 - protein, 426 aa, Oryza sativa (japonica cultivar-group)
MARGLFACFGRGGEEAEEEAGKRPALRRRRTVNLRSLSLEDLSRTLAKTNLHAFTLDELKAATKNFSTSNFLGEGGFGPVYKGFVDGELRPGALESQHVAVKYLDSDGVQGHREWLAEVVYLGMLSHPHLVKLVGFCNQDDHRMLVYEYMPRGSLENHLFKNLLASLPWSTRLKIAVGAAKGLAFLHEAETPVIYRDFKASNILLDKDYTAKLSDFGLAKEGPQGDATHVTTRVMGTHGYAAPEYILTGHLTARSDVYSFGVVLLELLTGRRSVDKRRRGREQNLVDWARPYLRRADRLHRIMDPSLELQYSARAAHAAAKVAHQCLQSVPKSRPCMRDVVDALEPLLAVDDDVPMGPFVFTVGGEEAAAAAAGSSAAGDAGDDEPARGSRRGKKHVTSAVHAESPLRDGRYASRVKRPESPPSVI

SEQ ID NO: 29201 - protein, 354 aa, Oryza sativa (japonica cultivar-group)
MCVEELEGAERLDFGGVAELETTPADFEMEKVCENTVSLDFKQARSSSFVPVIRSGDWSDIGGRDYMEDAHVCISDLANNFGHNSVDDEIISFYGVFDGHGGKDAAHYVRDNLPRVIVEDADFPLELEKVVRRSFVQTDSQFAERCSHQNALSSGTTALTAMIFGRSLLVANAGDCRAVLSRRGTAIEMSKDHRTCCLNERKRIESLGGYVDDGYLNGQLAVTRALGDWHLEGLKEVGEPGGPLSAEPELKMITLTKEDEFLIIGSDGIWDFFSNQNAVDFTRKRLQEHNDLRLCCKQIVEEAIRRGASDNLTAVMVSFHQEAPPQLRVNRTGRVERSISAEGLHSLRVLLEGQ

SEQ ID NO: 29202 - protein, 1007 aa, Oryza sativa (japonica cultivar-group)
MWTPSRGSNAARRSGHRRIADYLADDQTTNTDTSDNESYTTAYGDEFFAAAAAAAGSGGGGMLPAFLADQGDLVEVMLELDEESMVVRSVTPTSATLYGGGGGQMPQPLPPPLRTPEGGGGARSLSRCSSTSSRIRKKFAWLRSPSPSPSPRPPTPAELQREAAMAARERRRIQARLNRSSTGAKRALKGLRFISRTTGTVQAAELWRRVEDRFNALARDGLLSRDDFGECIGMVDSKEFAVGIFDALARRRRQNLERITREELYDFWLQISDQSFDARLQIFFDMVDTNVDGRITREEVQELIVLSASANKLAKLKEQAEEYASLIMEELDPENLGYIELWQLEALLLQRDSYMNYSRPLSTASGAQWSQNLGGAAVAAGAAAATGGGAHAAVAARGGQQQQQQQEGRRGGWGVRKAAARVRVAAEENWRRAWVVALWFAAMASLFVWKFVQYRRTPAFRVMGYCLPTAKGAAETLKLNMALVLLPVCRNTLTWLRSSWARFFVPFDDNITFHKMIATAIVVGITLHAGNHLACDFPRLIASGPEEYRLVADAFGPEKPTYVGLLSGVEGITGVAMVVLMTVSFTLATHPFRKGEKGGSGGGAAATVLPTVARLPSPFNRLAGFNAFWYSHHLLGIVYALLIAHGYFLFLVRRWYLKTTWMYISVPLMLYVGERMLRALRSNAYAVKILKVCLLPGNVLTITMSKPYGFRYRSGQYIFLQCPTISPFEWHPFSITSAPGDDYLSVHIRTNGDWTQELKRIFVENYFSPHLNRRASFSELGATEPRSLPRLLVDGPYGAPAQDFRNYDVLLLVGLGIGATPFISILRDLLNNIKLAEELMDLAMETSRSEDSANSFSVSTASSNKKRAYRTSRAHFYWVTREPLSFEWFKGVMNEVAEMDKKGVIELHNYLTSVYEERDARTTLLSMVQALNHAKHGVDIVSGTRVRTHFARPNWKEVFTRIASKHPNSTVGVFYCGAPTLAKELKTLSHEMSHRTGTRFHFHKEYF

SEQ ID NO: 29203 - protein, 502 aa, Oryza sativa (japonica cultivar-group)
MIEQFVNFVIRPPRAEYNPDQYLWEPEFTLAGRKYKRIDLELTNGRDQTLKCSHYVPAVIPDNTALPCVIYCHGNSGCRADANEAAVILLPSNITLFTLDFAGSGLSGGEYVSLGWHEKQDLKCAVSFLRNNKEVSCIGLWGRSMGAVTSLLYGAEDPSIAGLVLDSAFSNLYDLMMELVDVYKIRVPKFTVKMAVQYMRRVIQRRAKFDIMDLDVVQFAPKTFIPALFGHASNDMFIQPHHTDRIHQAYAGDKNLIKFDGDHNSPRPQFYYDSVSIFFYNVLHPPQFPSVCSNKLDKYYNLGAFKVGAGTNESLLYEIINGLRAAGPDAGSSSAAAANFTNATKSVVELLTERVNQLSIKTDNDLDFLLDENHNLTEMDTHTAESHLEDKSHRQNEECCSYTSSNRESWGRCSSLGAASDGSSLGERPEIPSHKHKSMTLRALATPLRRIRRKPLAIPKERKNRSLWKRLKQERQEMGESLTQRFRLCLQGQAQHKRTKSS

SEQ ID NO: 29204 - protein, 425 aa, Oryza sativa (japonica cultivar-group)
MAFRNHDAAMVLFFFLLMVTTYANAHGHSKKPEEITQGVYGAAAAVAAGPGGTFDITKLGAVGNGRADSTGAVMAAWRSACAGAGKQTILIPKGDFMTGAMELRGPCNGAVTIQLDGNLLGSNDLSKYPGKKMPNWVEVRHVDNFVISGKGKLDGQGPGVWSKNSCAKNYNCKLLPNTLVLNTVNDGVVSGITLLNAKFFHMNIYRCKDIKISGVTINAPGDSPNTDGIHMGDSSKITIAATTIGTGDDCISIGPGTDGVNITGVTCGPGHGISIGSLGRYKDERDVRDVSVTRCVLRKTTNGLRIKSYEDSVSPVTVSKVSYDGVVMDHVDNPIIIDQKYCPNSICTSKGDSKVSVRDVTFRNITGSSNTPAVVQLLCSGKLPCSGVAMQDVRVLYGGSDKKTTAVCDHALGKSTGCLKELACL

SEQ ID NO: 29205 - protein, 179 aa, Mangifera indica
FGSVYRGEMDEGMTVAIKRANPQSEQGLKEFETEIEMLSKLRHRHLVSMIGYCDEQNEMILVYEYMANGTLRSHLFGSDLPPLTWKQRLHACIGAARGLHYLHTGAEGGIIHRDVKATNILLDENFVAKMADFGLSKDGPAFDHTHVSTAVKGSFGYLDPEYFRRQQLTQKSDIYSYGI

SEQ ID NO: 29206 - protein, 183 aa, Musa acuminata
FGVVYRGELHDGTTIAVKRTESARVGNEALGEFQAEIAVLSKVRHRHLVSILGYSVEDNERLLVYEYMPQGALSKHLFHWKQLGLEPLSWKKRLNIALDVARGIEYLHNFAKECFIHRDLKSANILLGDDYRAKVSDFGLAKLAPDGKNSVATRLAGTFGYLAPEYAVTGKVTTKVDVYSYGI

SEQ ID NO: 29207 - protein, 182 aa, Musa acuminata
FGVVYRGELKDTNEIVAVKQLDRNGFQGNREFLVEVLMLSLLHHPNLVKLLGYCADGDQRILVYEYMPLGSLEDHLLDVSADAKPLEWHTRMKIAAGAAKGLQCLHETANPPVIYRDFKASNILIDEDYNAKLSDFGLAKIGPVGDKNHVSTRVMGTYGYCAPEYALTGQLTKMSDVYSFGI

SEQ ID NO: 29208 - protein, 367 aa, Streptomyces coelicolor A3(2)
MDPVRLALTRSLVGALGLDREVEVVAARPAGESTLRLVHREDYIDAVRAASADPRSADGSYGLGTVDDPAFAGMHEVSALIAGQSVGAAEAVWRGDALHAVNFAGGLHHAMPGAASGFCVYNDAALAIARLLELGAERVAYVDVDVHHGDGVQAAFWEDPRVLTVSLHEHPATLFPQTGWPEETGADCAEGSAVNVALPAGTGDAGWLRAFHAVVPEVLADFRPQVLVTQHGADTHFEDPLAHLAVSLDAQRAVQVACHELAHEYAGGRWVALGGGGYAVVEVVPRSWAHLVGVAAGRPVEPETVIPEGWRQEVYARTRQLGPMRMTDGRWPVSYASWEAGYDPADRLDQAVRAARRAVFPLRGLLA

SEQ ID NO: 29209 - protein, 451 aa, Streptomyces coelicolor A3(2)
MTPQPSPQAGAAVKAADRAHVFHSWSAQELIDPLAVAGAEGSYFWDYEGKRYLDFSSGLVYTNIGYQHPKVVAAIQEQAARMTTFAPAFAVEARSEAARLIAERTPGDLDKIFFTNGGADAVEHALRMARLHTGRPKVLSAYRSYHGGTQQAVNVTGDPRRWASDSGTAGVVHFWAPFLYRSRFYAETEEQECARALEHMETTIAFEGPGTIAAIVLETIPGTAGIMMPPAGYLAGVREICDKYGIVFVLDEVMAGFGRTGTWFAADLYDVVPDLMTFAKGVNSGYVPLGGVAISAEIAATFAERPYPGGLTYSGHPLACAAAVATINVMAEEGVVEHAARLGAEVVEPALRELAERHPSVGEVRGTGMFWALELVRNRETREPLVPYNATGQAATPMSAFAASAKAHGLWPFVNMNRTHVVPPCNVSEAELKEGLAALDTALSVADEYTE

SEQ ID NO: 29210 - protein, 498 aa, Cyanidioschyzon merolae
MNKALDSDHPNQAVADVGLIGLAVMGQNLVLNMADHGFKVAVFNRTVSKVQEFLETVAKDRETIFGARTIQEFCALIKKPRKVILLVRAGPAVDDFIEKLQPHLDPGDVIVDGGNSYYQDSTRRMKHCAEHGLLFVGCGVSGGEEGARYGPSLMPGGTEAAWPLLRPVLQAIAARADGEPCCDWVGSGGAGHFVKMVHNGIEYGDMQLISEVYDVMRRGLGLSVEECGDIFAAWNETELCSYLIEITANILKYKDDETGKPLVSLILDKAEQKGTGRWTVESSLEHSVPVTLIAEAVFSRMLSSRKAERVRASKVLQGPPAQPPLNEQDRQNMIEKLRLALYASKIVSYAQGYMLMKEAAAAEDWNLNYGGIALMWRGGCIIRSRFLGKIREAYQDEPNLENLLLYRFFRDALLAAQQSWRDAVVFAVSRGITCPAISTALAFYDGYRAETLPASLLQAQRDYFGAHTYERIDKPENQYFHTNWTGTGGTTTSNAYSA

SEQ ID NO: 29211 - protein, 477 aa, Cyanidioschyzon merolae
MIAFVINSATKAAVSPLKGQICRGLPKNPSFAASTWLGQAALSTRPRSSQGRGRSGVRESAATRARAPVCVQTSDVAMRVRSIRDLQDAEIRGKRVFVRSDLNVPLDGKRITDDTRIRASVPTIKYLADKGAKVIVVSHLGRPKGGFEDKYSLAPVAERLSELLGKKVRMAKDCIGDAVATEVAAMSPGDVVLLENVRFYPEEEKNDPDFARKLAANADLYVNDAFGTAHRAHASTEGVTAFLKPAVAGFLLEKELDYLSNAIESPKRPFAAIVGGSKVSTKIAVLEKLLQKCDTIIIGGGMVFTFLRARGLKTGSSLVEEDKIELARVIEEEARKRGIELLLPLDVVVADKFANDANTKVVPVEEIPDGWMGLDNGPETTRMIQEKLRTMKTVLWNGPLGVFEMPNFAKGTFAIAETLAEITQNGCITIVGGGDSVAAMEQSGKADKVSHISTGGGAALELIEGRVLPGVAALQRA

SEQ ID NO: 29212 - protein, 479 aa, Sphingomonas sp. tfd44
MTYPDTRLFIGGRWQDAADGRSLAVQNPATGLEIGRVAHCGRADLDRALDAAQRGFEIWRDLTPAERSKIMRRAAGLMRERADEIARLLTQEQGKPLHEAKIEAMAAGDIIEWFAEEGFRLYGRLVPHRTDIAIRQMVIKDAVGPVAAFTPWNFPINQVVRKISAALAAGCSMIVKAPEETPASPAELIRAFQDAGLPDGVLNLVFGDPAEISNYLISSPIIRKITFTGSTPVGKLLASLAGKHMKRVSMELGGHAPAIVCEDADIGLAVKSLSASKFRNAGQVCIAPTRFLVHSSIKHAFADALAAAARDLRVGDGFADGTQIGPLANSRRLAAMAEFQQDAIEKGATLLTGGNRVGDVGNFWAPTVLSDVPLEARLFNDEPFGPVAGIRSFDRLEEAILEANRLSFGLAGYAFTKSLATADILARRVEVGMLWVNSPATPTAELPFGGIKDSGYGTEGGPEALDNYINPRAVVVANV

SEQ ID NO: 29213 - protein, 263 aa, Sphingomonas sp. tfd44
MKDEVFVVVGGGQAGGWIIKTLGVEGFSGRIVLIGDERHPPYERPPLSKNALRDAEAVSETALLSIENLAEAKVESWLGEEVVKIDRSAQTVRCASGRENRYDRLFLATGSRPRVPDWMAGQKSDRIHLLRTIDDAAALRSSLSGTKHLLIVGGGWIGLEVAATVRSLGIAVTVVEAAPRLCQRSVPEPVSDWLRSLHEGHGVAFVMGRSVDQLVEQPDGIMLELDDGTARMADRVLVCVGAIPNVALAELAGLDVSNGILVD

SEQ ID NO: 29214 - protein, 310 aa, Carica papaya
MENFPVINMEGLTGEERAATMKKSEFACENWGFFELVNHGIPIELLDTVERLKKGHYRKCMEQRFKEIMASKGLDGIQPEVTDMDWKSTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVIYPAPILVEKETEEKKTAYPKFVFEDYMKLYAGLKFQAKEPRLNAMKAAAKA

SEQ ID NO: 29215 - protein, 338 aa, Anisodus tanguticus
MEVISNHNNGSTTKIILKNGSICNGNVNGNSHSHEKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIETIDIVEIDDVVVDVSRKFFPYLAAGFDDPRVTLIIGDGAAFVKAAQPGYYDAIIVDSSDPIGPAKDLFERPFFEALAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 29216 - protein, 504 aa, Alcaligenes sp. AL3007
  misc_feature (1)..(1): Xaa can be any naturally occurring amino acid
  misc_feature (7)..(7): Xaa can be any naturally occurring amino acid
  misc_feature (102)..(102): Xaa can be any naturally occurring amino acid
  misc_feature (185)..(185): Xaa can be any naturally occurring amino acid
  misc_feature (203)..(203): Xaa can be any naturally occurring amino acid
  misc_feature (284)..(284): Xaa can be any naturally occurring amino acid
  misc_feature (310)..(310): Xaa can be any naturally occurring amino acid
  misc_feature (315)..(315): Xaa can be any naturally occurring amino acid
  misc_feature (324)..(324): Xaa can be any naturally occurring amino acid
  misc_feature (404)..(404): Xaa can be any naturally occurring amino acid
XQTVNEXLRRAATRAPDHCALAVPARGLRLTHAELRARVEAVAARLHADGLRPQQRVAVVAPNSADVVIAILALHRLGAVPALLNPRLKSAELAELIKRGEXTAAVIAVGRQVADAIFQSGSGARIIFLGDLVRDGEPYSYGPPIEDPQREPAQPAFIFYTSGTTGLPKAAIIPQRAAESRVLFXSTQVGLRHGRHNVVLGLXPLYHVVGFFAVLVAALALDGTYVVVEEFRPVDALQLVQQEQVTSLFATPTHLDALAAAAAHAGSSLKLDSLRHVTFAGATXPDAVLETVHQHLPGEKVNIYGTTEAXNSLYXRQPKTGTEXAPGFFSEVRIVRIGGGVDEIVANGEEGELIVAASDSAFVGYLNQPQATAEKLQDGWYRTSDVAVWTPEGTVRILGRVDDXIISGGENIHPSEIERVLGTAPGVTEVVVIGLADQRWGQSVTACVVPRLGETLSADALDTFCRSSELADFKRPKRYFILDQLPKNALNKVLRRQLVQQVSS

SEQ ID NO: 29217 - protein, 239 aa, Thermoplasma acidophilum
  misc_feature (1)..(1): Xaa can be any naturally occurring amino acid
  misc_feature (17)..(17): Xaa can be any naturally occurring amino acid
  misc_feature (62)..(62): Xaa can be any naturally occurring amino acid
  misc_feature (122)..(122): Xaa can be any naturally occurring amino acid
  misc_feature (126)..(126): Xaa can be any naturally occurring amino acid
  misc_feature (150)..(150): Xaa can be any naturally occurring amino acid
  misc_feature (215)..(215): Xaa can be any naturally occurring amino acid
  misc_feature (224)..(224): Xaa can be any naturally occurring amino acid
XSLIFLDYDGTLVPIIXNPEESYADAGLLSLISDLKERFDTYIVTGRSPEEISRFLPLDINXICYHGACSKINGQIVYNNGSDRFLGVFDRIYEDTRSWVSDFPGLRIYRKNLAVLYHLGLXGADXKPKLRSRIEEIARIFGVETYYGKXIIELRVPGVNKGSAIRSVRGERPAIIAGDDATDEAAFEANDDALTIKVGEGETHAKFHVADYIEXRKILKFIEXLGVQKKQEGHHHHHH

SEQ ID NO: 29218 - protein, 455 aa, Mycobacterium tuberculosis
MSAVALPRVSGGHDEHGHLEEFRTDPIGLMQRVRDELGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSATLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPAAVRYRRRTGVHHHH

SEQ ID NO: 29219 - protein, 336 aa, Streptomyces viridochromogenes
MRVVYTDPAWALDADGRPDPALAAVERSVLGPDIDIELGLFEDSYVTTGERFLKHVRGADALVIYRCQVTPELVDAVSPGCQVIARSGVGVDNLNGPLLAEHGLIGFNVPDYCGDEVSTHTLALLLGLERGISVQDRLVRADRWGIHRGGIPRRTSDRTVGIVGFGRIGRATARKLQAFYRQVLAVDPYVHADVMAGHGVHPVGSLDELLERCDAVVLHTALTDETRDLISGAALDRVKPGALLVNTARGALVDPGCVLRALESERLGGFASDVFSPEDPNQNPVARKLLERDDVIVSSHRAFLSAESEESLRRRVAEGVRSVLRDGTPPAEGRVA

SEQ ID NO: 29220 - protein, 398 aa, Streptomyces viridochromogenes
MTITSVRLRGILDSRARVTLEAEVTLDSGHTGTGSAPRAIAPGRLERRRGPEPVLGPVTAPPLAAALTDGAVDGQRQCDARLADVYEAGEAGSDLTLAVSLAHARAAAAARHLPLHAHLAEQYGLGHPGLPRLMVNVFSGGIHRDGPPRGFQQVMVLPATGRIHTDIEVADQVFTAAHRAVERRFGPVPLSASSGLLVPLESEEQLALLQAAVAEAGHTEVCTLGVDVAAEHLHTGSGRYRFGDREFTSGEFAEHLAGLAHRFRLTFLEDPFDPADDAGWDKLRGALPSATSVVGDDLFATDARRIAPGLADGILLKLSQAGTVSATLAAAAAARRAGMLLAVSHRSGETEDTAMCDLAVAVAAELIKVGGPRRGDRLAKYNQLLRLDESLAGLVTAP

SEQ ID NO: 29221 - protein, 466 aa, Streptomyces viridochromogenes
MFVNGALQPARRHTTVHDRWTGEPVGTVPRDGAEEAAAAVAALAAGRRATTPQQRSAVLTRAADMLTARAEEFSTLITAESGVCRKETLREVSRAAGNLRVAAAEAERIRGESIPLPDGTRLAVTLPEPVGVVLGITPFNRPLNQVVVKAAPALAAGCPLLLKPSEKTPLTALAFAELLVEAGCAKDMLAVVTGEPGEVGPPLAAHPDVAMVTFTGSVATGHAVAAQAAGKRQLLELGGNDPLFVLPDADLRRAAKLAADGSCATAGQSCRGIKRVFVWEEVADEFTALLEPAVAAKRAGDPRREDTDLGPLVSEEAALVVERRIARAVRDGARLVTGGERDGALVRPAVLDHVPPDTELVTEETFGPVAPVIRVRDADEAVRLSNGTAYGLQAGVLTRDSAAFWDIAARLRVGAVNLGEGPHFDSPHIPFGGVKSSGVGREGIRYAIAEMTVTKTVTLPGPYGTG

SEQ ID NO: 29222 - protein, 413 aa, Rhodococcus sp. RHA1
MPESTTVIVGASIGGVRTAQALRSEGYPGAIVLIGAEGELPYDKPPLSKSILAGDSTMAEITLLTTEQARELDLELRLGQPAIRLSTANQDVELADGTRVAFDNLVLATGARARPSPWGTPNGLHVIRTAADARALRRHFGTTDHLVIIGGGFIGAETAATAVELGIRVTLVDPEPVPMARVMGAEIGELFIDLHRRRGVDTRFGVGVESVHGEHRSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLAGSPTHTVIGEVTNKARFAVCYPDENGKLTGVVVVNWPKALVTARKAIALGVEYAEFAARLEAMTVSARTTVKETT

SEQ ID NO: 29223 - protein, 413 aa, Rhodococcus sp. RHA1
MPESTTVIVGASIGGVRTAQALRSEGYPGAIILIGAEGELPYDKPPLSKSILAGDSTMAEITLLTTEQARELDLELRLGQPAIRLSTANQDVELADGTRVASDNLVLATGARARPSPWGTPNGLHVIRTAADARALRRHYGTTDHLVIIGGGFIGAETAATAVELGMRVTLVDPEPVPMARVMGAEIGELFIDLHRRRGVDTRFGVGVESVHGEHGSFAIGLSDGSTLAADTVVVGIGAIPNDDWLESSGLEVSNGVVCDVYCRAIGHDNIYAVGDVCRFDNTRRGGSTRLEHWTNAVEQAVVVARNIARPDEKIRHEPVEYVWSDQYDWKIQTVGLVGSSTHTVIGEVTNKARFAVCYPDENGRLTGVVVVNWPKALVTARKAIALGVEYAEFAARLEAMTVSARTTVKETT

SEQ ID NO: 29224 - protein, 497 aa, Camellia sinensis
MASLTCSADQLAQLFGSNTTNAAAATYICDHFTAVSQKFSDAASAIDSTYLLFSAYLVFSMQLGFAMLCAGSVRAKNTLNIMLTNVLDAAAGAIFYYLFGFAFAFGSPSNGFIGSHFFALKSIPTSSFDYSFFLFQWAFAIAAAGITSGSIAERTQFAAYLIYSAFLTGFVYPVVSHWFWSGDGWASASNTNHLLFGSGVIDFAGSGVVHMVGGIAGLYGAFIEGPRIGRFANPGQSVTIKGHSASLVVLGTFLLWFGWYGFNPGSFTKIANPYTSGSYYGQWSAVGRTAVTTTLAGSTAALTTLFLNRVVSGHWNVTDVCNGLLGGFAAITAGCSVVEPWAAVICGLVAALVLIGCNKVAERVKFDDPLEAAQLHGGCGAWGVIFTALFASEKYVNEVYPGKSDRPYGLLMGGGGRLLAAHVIQIVVIVGWVSVTMGPLFFVLHKLKLLRISAEDEIAGMDMTRHGGFAYVYQYHDEDESNKLGMQMRKIDPEDKS

SEQ ID NO: 29225 - protein, 285 aa, Pisum sativum
MAKDVEVQEQGEYSAKDYQDPPPAPLIDLDELTKWSFYRALIAEFVATLLFLYVTILTIIGYSHQTDANAGGTDCDGVGILGIAWAFGGMIFILVYCTAGISGGHINPAVTFGLFVGRKVSLLRAVFYMAAQCAGAVCGTGLAKGFQKSFFDRYGGGANFIHDGYNKGTALGAEIIGTFVLVYTVFSATDPKRNARDSHVPVLAPLPIGFAVFMVHLATIPITGTGINPARSFGSAVILNQGKIWDDQWVFWVGPIIGATVAAIYHQYILRGSAIKALGSFRSNA

SEQ ID NO: 29226 - protein, 250 aa, Pisum sativum
MPIRNIAIGTPQEATHPDTLKAGLAEFISTFIFVFAGSGSGIAYNKLTDNGAATPAGLISASIAHAFALFVAVSVGANISGGHVNPAVTFGAFVGGNITLLRGIVYIIAQLLGSIVASALLVFVTASSVPAFALSAGVGVGPALVLEIVMTFGLVYTVYATAVDPKKGNIGIIAPIAIGFIVGANILVGGAFTGASMNPAVSFGPAVVSWSWANHWIYWAGPLIGGGLAGLIYEVLFINSTHEQLPTTDY

SEQ ID NO: 29227 - protein, 260 aa, Streptomyces coelicolor A3(2)
MDKVVATAGAAVADVADGASLAVGGFGLSGVPNVLIQALYERGTGGLSVVSNNCGAMESGLAVLLAAGRIARVTGSYIGANKEFARQYLGGELEVEMIPQGTLAERLRAGGAGIPAFYTPAGVGTQVADGGLPWRYDGSGGVALASPPKEVREFDGTQYVLERGIRTDFALVRAAKGDRHGNLVFAKSSRNFNPLAATAGRVTIAEVEELVEPGAIDPDAVHLPGIFVQRVVALTPEQATDKKIERRTISAPPARGTVTS

SEQ ID NO: 29228 - protein, 508 aa, Oryza sativa (japonica cultivar-group)
MAATPPSSQHRRPLSSSASAASLAGKPRGGGLLLGRYELGRLLGHGTFAKVYQARSADSGEPVAIKVLDKEKAMRHGLVPHIKREIAILRRVRHPNIVRLFEVMATKSKIYFVMELVRGGELFGRVAKGRLKEDTARRYFQQLVSAVGFCHARGVFHRDLKPENLLVDEHGDLKVSDFGLSAVADQFHPDGLLHTFCGTPSYVAPEVLARRGYDGAKADIWSCGIILFVLMAGYLPFHDQNLMAMYRKIYRGEFRCPRWFSKDLSSLLNRILDTNPETRITVKEVMESRWFQKGFRPVRFYVEDDQVHSLADGDNDMPELEPSEPPPPPPFPPPPPQQDDDGEESGWESDSSVASCPATLSSEERRQRPLGSLTRPASLNAFDIISFSKGFDLSGLFEERGSEVRFISAEPMQTIITKLEEIAKVKSFFVRRKDWRVSIEGTREGLKGPLTIGAEIFELTPSLVVVEVKKKAGDKEEYDDFCNRELKPGMQHLVHHMGSVPNIPSDTE

SEQ ID NO: 29229 - protein, 407 aa, Lycopersicon esculentum
MASLSRFIGKQCKLQCSDTLQRPSYGFCVRRSPTHLSMGMRNKDEIGRYNLFINQNQSKTSLVQSPCNRKIVCCEAASNVSGESSSTGMTQYEKIIETLTTLFPLWVILGTIIGIYKPSAVTWLETDLFTLGLGFLMLSMGLTLTFDDFRRCLRNPWTVGVGFLAQYFIKPLLGFTIAMALKLSAPLATGLILVSCCPGGQASNVATYISKGNVALSVLMTTCSTVGAIVMTPLLTKLLAGQLVPVDAAGLAISTFQVVLVPTVIGVLSNEFFPKFTSKIVTITPLIGVILTTLLCASPIGQVADVLKTQGAQLLLPVAALHAAAFFLGYQISKFSFGESTSRTISIECGMQSSALGFLLAQKHFTNPLVAVPSAVSVVCMALGGSALAVYWRNQPIPVDDKDDFKE

SEQ ID NO: 29230 - protein, 206 aa, Schizosaccharomyces pombe
MNANINRYDYLFKLLLIGDSGVGKSCLLLRFADDTYTESYISTIGVDFKIRTFELEGKTVKLQIWDTAGQERFRTITSSYYRGAHGIIIVYDVTDQDSFNNVKQWLQEIDRYAVEGVNRLLVGNKSDMVDKKVVEYSVAKEFADSLNIPFLETSAKDSTNVEQAFLTMSRQIKERMGNNTFASSNAKSSVKVGQGTNVSQSSSNCC

SEQ ID NO: 29231 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSAKNALNVEQAFMAMSASIKDRMASQPAANNARPATVQIRGQPVEQKTSCCSS

SEQ ID NO: 29232 - protein, 203 aa, Poa pratensis
MNPEYDYLFKLLLIGDSGVGKSCLLLRFADDSYLESYISTIGVDFKIRTVEQDGKTMKLQIWDTAGQERFRTITSSYYRGAHGIIIVYDVTDQDSFNNVKQWLNEIDRYASDNVNKLLVGNKCDLTDKKVVSYETAKAFADEIGIPFMETSLKNALNVGQAFMAMSASIKDRMASQPAANNARPATVQIRGQPVEQKGSCCSS

SEQ ID NO: 29233 - protein, 167 aa, Citrus limon
LTSISRRLWTISELPCTTPRSSVLSCSIPRGPGFELGFLKDGKPIQLKEGQEITVSTDYDFKGNEEMITMSYKKLPVDVKPGNTILCADGTITLTVLSCDPKSGTVRCRCENTAMLGERKNVNLPGVVVDLPTLTEKDKEDILRWGVPNNIDMIALSFVREGSDLAM

SEQ ID NO: 29234 - protein, 357 aa, Lycopersicon esculentum
MKKGSFAPNLKLSLPPPDEVALSKFLTESGTFKDGDLLVNRDGVRIVSQSEVAAPSVIQPSDNQLCLADFEAVKVIGKGNGGIVRLVQHKWTGQFFALKVIQMNIDESMRKHIAQELRINQSSQCPYVVICYQSFFDNGAISLILEYMDGGSLADFLKKVKTIPERFLAVICKQVLKGLWYLHHEKHIIHRDLKPSNLLINHRGDVKITDFGVSAVLASTSGLANTFVGTYNYMSPERISGGAYDYKSDIWSLGLVLLECATGHFPYNPPEGDEGWVNVYELMETIVDQPEPCAPPDQFSPQFCSFISACVQKHQKDRLSANDLMSHPFITMYDDQDIDLGSYFTSAGPPLATLTEL

SEQ ID NO: 29235 - protein, 335 aa, Lycopersicon esculentum
MALVRDRRHLNLRLPLPEPSERRPRFPLPLPPSSVPTVNSTASTTTATNTTTTTTASTTTISISELEKLKVLGHGNGGTVYKVRHKRTSAIYALKVVHGDSDPEIRRQILREISILRRTESPYVIKCHGVIDMPGGDIGILMEYMNAGTLENLLKSQLTFSELCLARIAKQVLGGLDYLHSHKIIHRDLKPSNLLVNREMEVKIADFGVSKIMGRTLDPCNSYVGTCAYMSPERFDPDTYGGNYNGYAADIWSLGLTLMELYMGHFPFLPPGQRPDWATLMCAICFGEPPSLPENTSEKFNDFMKCCLQKESSKRWSAHQLLQHPFIQSIDLKST

SEQ ID NO: 29236 - protein, 336 aa, Aeromonas punctata
MKAVGYKVPGPIAEDASLVDIDLPRPVAEGGDILVEVKAVSVNPVDYKIRSSTPPADGDWKVLGWDAAGIVQEVGPDVTQFAVGDEVYYAGSLIRPGTNAEFHLVDARIVGRKPASLDWAEAAALPLTTLTAWEAMFDRLDVTKPVPGAAAILIIGGAGGVGSIAIQIARQRTDLIVISTASRPETQEWVKGLGAHHVIDHSRPLAPQIAELNIGAPAFVFSTTHTEQHASDIAELIAPQGRFGFIDDPKALDVMLFKRKAVSIHHELMFTRSLYGTPDMDEQGKILNSLAVLVDDGKIRTTLTEKLSPINAANLKTVHALIESGAARGKIVLEGF

SEQ ID NO: 29237 - protein, 341 aa, Aeromonas punctata
MMTETVTNQAAWQKAPGQPLRIGVTALPHLAANEILIRNAAIAINPLDWILQDVALLPWLDYPAILGSDVSGEVAAVGGAVERFKVGDRVIGQAVGTTVNQPAQGAFQHHTIVLDHMAAPIPNNIAFADAAVLPLGLGTAASGLYGRTQLALAPPLHSPTARPEVVLVWGGSSSVGCNAIQLAVASGYRCVATASARNVGLLKELGASEVLDHSSPAIVEDVIEAMRGRSLAGTLHATGHMKDCFAVVARCEGSRRVAATLAPPDERSFGVEATHISGTSLKDDEVGPMIYREFLPQALAARTFVPAPPAKIVGQGLEMLQAALEALKAGVSAAKIVVTLP

SEQ ID NO: 29238 - protein, 314 aa, Pyrus communis
MATFPVVDLSLVNGEERVATLEKINDACENWGFFELVNHGISTELLDTVEKMTKDHYKKTMEQRFKEMVAAKGLDAVQSEIHDLDWESTFFLRHLPSSNISEVPDLEEDYRKTMKEFAVELEKLAEKLLDLLCENLGLEKGYLKKVFLGSKGPNFGTKVSNYPPCHKSDRPKGLRAHSDAGGIILLFQDDKVSGLQLLKDGDGVDVPPMHHSIVINLGDQIEVITNGKYKSVMHRVIAQSDGTRMSIASFYNPGDDAFISPAPAVLEKKTEDAPTYPKFVFDDYMKLYFGLKFQAKEPRFEAMKAKESPLVATT

SEQ ID NO: 29239 - protein, 419 aa, Oryza sativa (japonica cultivar-group)
MVETTTMMKVLVRVREFDVEKDLPAVEELERRCQVGLSGDMAAVHDHADDGDGAAAKEKKKTKTKTKKKKASMSLCVEQIGDPLARVRHAPEHVMLVAEYGEEEEKKKVVGVIKACVKTVSRGGKQEKPFVKVANLLGLRVSPSHRRLGIGTALVRRAEEWCVARGAEHATMATTESNAASLALFTGRFGYAPFRRPEFIGHPVHAHRLPVARGHRVFQLPPEVAAAAYARLLPPQDAEFLPADMPALLAHKLTLGTFVAVAADGASFAVLSVWDSTRSLSLRVSGAPALLRASLAALRALDRGAPWLHLPSIPDIFRPFGAYLLYGLRMSGPDGPALLRSLCHHAHNVARKNPACAVVAADISPDDPAAAAVPRWRRFCCDEDVWCIKNLNPDEHDADDWAAPPPPPGRHLFVDPREF

SEQ ID NO: 29240 - protein, 193 aa, Oryza sativa (japonica cultivar-group)
MGGPGASSTMSFEQAFLKNLLLSLQDCSTTKPLDAMSLHERKRAVKSSADFAMATARGGGARWPKAIVLQQQPASTTARARRCGRIVRRCCGRKTRSGAGGGGEMARRLQVRRRAMALRKVIPGGGDAMDEAALLREAMDYVVHLRAQVDVLRRVSEAVQLQRRYTSSTSLRDYSWSKCALKGEEDSSMNMKR

SEQ ID NO: 29241 - protein, 409 aa, Oryza sativa (japonica cultivar-group)
MALHAAPPPPPPFTAGRLPTTSRRPCFSAGRIFRCSLPAAAARPRNAAFLAPLRTSSAARSGSQALPKGWDTAAGVVEIDGTPGTSSSPHVVCFGELLIDFVPTVNGVSLAEASAFKKAPGGAPANVAVGIARLGGSSAFIGKVGDDEFGYMLADILKENNVNNQGLLFDAHARTALAFVTLRNDGEREFMFYRNPSADMLLEEKELDLDLIRKAKIFHHGSISLITEPCKTAHIAAAKAAKDAGVLISYDPNLRLPLWSSADDARDGILSIWETADVIKISEEEVSFLTKGEDPYDDSVIKKLMHPNLKLLLVTEGPEGCRYYSKEFNGRVGGLKVNAVDTTGAGDAFVAGILSQLSVDFSLLQDEGRLKEALKFANVCGALTVTERGAIPALPTRQQVVDALTKVVA

SEQ ID NO: 29242 - protein, 324 aa, Oryza sativa (japonica cultivar-group)
MMAKAEGGKMVCVTGAGGFIGSWVVKELLLRGYAVRGTARDPSSQKNSHLQKLEGAKERLCLNYADVMDYDSLSVAFNGCEGVFHVASPVSVDPRLVPVAVEGTKNVINAAADMGVRRVVFTSTFGAVHMDPNRSHDTVVDESCWSNLEFCKQKDWYCYAKTVAEMVAAEQASKRGIQLVVVLPAMTLGQMLQSTINPSIRHIADFLNGSRKTHRNAVAGYVDARDVARAHALVYEDPKAHGRYLCIASVLHRSELIQMIRELFPQYPITCNKCEDSKQMVQPFKFSNQRLRDLGLTFTPIKESLYNTLICLREKGHLPPYSSL

SEQ ID NO: 29243 - protein, 396 aa, Oryza sativa (japonica cultivar-group)
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHASVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWED

SEQ ID NO: 29244 - protein, 504 aa, Oryza sativa (japonica cultivar-group)
MAAELVHLLRYLFSVPMLFFIVPLLFLVCSPRRRRGRGSCRLPPSPWALPVVGHLHHLAGALQHRAMRDIARRHGPLVLLRLGRLPVVVASSADAAREVMRTSDVAFAARPVNRMIRVVFPEGSEGVIFAPYGETWRQLRKICTAELLSARRVHSFRSVREEEAGRMLRAVASAAAQTTVNLSELMSAYAADSSARAMIGRRLKDRDTFLAMVERGIKLFGEQSLPNLYPSSRLAVLLSTMPRRMKRHRERMTAYLDAIIEEHQESRASREDDEDLLDVLLRIQREGDLEVSRESIRSTIGDMFIGGSEPPAITLQWIMAELIRNPEVMQKVQDEVRQLLVGQHRVTEESLSKLGYMNLVIKETLRLHPPGPRLLLRVCRTTCQVLGFDVPKGTMVLVNMWAINRDPKYWSQAEEFIPERFENAGINFKGTNFEYMPFGAGRRMCPGMAFGLATLELALASLLYHFDWKLPDGVEIDMKEQSGVTTRRVHDLMLVPIIRVPLPV

SEQ ID NO: 29245 - protein, 504 aa, Oryza sativa (japonica cultivar-group)
MEQYLFLATLLILSLAFVKLRPRNNGENPPPGPWQLPVIGSLHHLAGALPHRALRDLATRHGELMLLRLGELPVVVASSPAAAREVMRTHDAAFATRPQTATLRALTRDGLGVAFAPQGEHWRCLRKLCVTELLGARRVRCLRRAREAEAAALVASLSTTTPEPVNVSSLVARYVTDAVVRAVVGDRISDRDAFLERLEEGVKVAAGFTLADVFPSSRLARALSGTARRAEAHSREMTRLMDGVIEEHRQRRAATGWRDEEDEDLLDVLLRIQKDGGLQIPLDMGTIRAIIIDLFSAGSETTGTTLQWAMAELMRNPAALRKAQAEVRGVLAGHSHVTEDALPDLHYLHLVIKETLRLHVAVPLLLPRECQEPRLRVLGYDVPERAMVLVNAWAICRDTAVWGPDAEEFRPERFDGGAVDFKGTDFEFVPFGAGRRMCPGVAFAVAIMELGLASLLFHFDWELAGGTAAGELDMAEGLGITARRKSDLWLHATVSVPVPNTETS

SEQ ID NO: 29246 - protein, 371 aa, Oryza sativa (japonica cultivar-group)
MQTTRSYRSKFLSPTAMYSSSSMKPSSPSQANQDADDAKTYKELYQRCTDLVSSWPSRQGLSYLQLFRHEKGWYNGVTPLVGTMVADELFAARPSDIVVPTLPKSGTTWIKALLYATVHRREHPADAAGDHPFNSLGPHECVKFLEYHLYRADEAPDLDALPDPRLFATHAPFDLLPRAVVAAAPPSGCKVVYVCRDPKDTLVSLLQFVNEYKSRNGRELVAVDAAVGFFCDGVSPFGPYWEHVLGYWRAHRERPERVLFLRYEEMKRDPAGHVRRLAEFAGVPFTSPEEDGGAVDAIVRLCSFDNMVGLEATKGGRTQLTTTTVPNSAFFRRGEVGDWANHLSPEMAQRIDAITEAKFAGFGLAPSLIEL

SEQ ID NO: 29247 - protein, 504 aa, Oryza sativa (japonica cultivar-group)
MAGGRAFRPSAPRRAAFAALLTLLLLATLSFLLSSPPPTHASHRSSYLGASPPSRLAAIRRHAADHAAVLAAYAAHARRLKEASAAQSLSFATMSSDLSALSSRLASHLSLPEDAVKPLEKEARDRIKLARLLAADAKEGFDTQSKIQKLSDTVFAVGEHLARARRAGRMSSRIAAGSTPKSLHCLAMRLLEARLAKPSAFADDPDPSPEFDDPSLYHYAVFSDNVLAVSVVVASAARAAADPSRHVFHVVTAPMYLPAFRVWFARRPPPLGVHVQLLAYSDFPFLNETSSPVLRQIEAGKRDVALLDYLRFYLPDMFPALQRVVLLEDDVVVQKDLAGLWHLDLDGKVNGAVEMCFGGFRRYSKYLNFTQAIVQERFDPGACAWAYGVNVYDLEAWRRDGCTELFHQYMEMNEDGVLWDPTSVLPAGLMTFYGNTKPLDKSWHVMGLGYNPSISPEVIAGAAVIHFNGNMKPWLDVALNQYKALWTKYVDTEMEFLTLCNFGL

SEQ ID NO: 29248 - protein, 389 aa, Oryza sativa (japonica cultivar-group)
MGAVASTVAARFAFFPPAPPSYGVEPPPSPSPAAAAEDGAVVELSGVPRRAGVEARRLPTGRGTEVVAMYVRQPGARLTLLYSHGNAADLGQMYELFVELSSHLNVNLMGYDYSGYGQSSGKPSEQNTYSDIEAAYRCLVETYGATEENIILYGQSVGSGPTLDLASRLPHLRAVVLHSPILSGLRVMYPVKHTYWFDIYKNIDKVPLVKCPVLVIHGTADEVVDCSHGRALWELSKIKYEPLWVKGGNHCNLELYPEYIKHLKKFVMAIEKLPPTKDESSGSSGPSDPCEIGSESMQSSRKSTDVKDKSRSSIDHRHSVDRREKPRGSIDRRDKSRKSIDHPDKPRASVDQPDRPRRSIDRFGGMMRSVTSVKLCNIDCFKVTYASGS

SEQ ID NO: 29249 - protein, 425 aa, Oryza sativa (japonica cultivar-group)
MTLRRRSGAGGTPPTTRSSSTPGSGGARAIGGVAAEVTDYSIATPIVTGTARWFRDSADLVAFREGGGRRRRRRHSFEYARYGNPTVEVLEDKISAMEKAEATIVTSSGMNAIVATLLAVVPPGGHVVATTDCYSEARAFIRDRLSKMGIRTTFVDLDDMEALQSVLDQGNVTMFYADSLTNPHLKCVDVRRVAELCHQRGALVCIDSTLASPINQKPLTLGADVVLHSHHQVIGAGWETPWVTDFTTGMGVGFLNWHPVDITSARGRLWTPLSPPDLEAYMIIRGLKTMALRVEAQNRTALRVARLLERHPKVERVNYPWLESSPWHGVARKQMTGAGGVISFEVASDMRGAMRFVDALELPFIATSLGGCESLVQQPAIMSYWGKSEAEKTENGIKDNLVRFSFGIEKFEDLKDDILQALEKI

SEQ ID NO: 29250 - protein, 451 aa, Oryza sativa (japonica cultivar-group)
MAAGDAARAPPAAEAQSLVESFCGVTSATPQEAAFFLESHNWALESAVRSFYDSADGDASAAAADAADPPPRQPPPPPPASDGADSDDEDYVVGGGDEDQDDEDYVGDGDGDGEGDDDDDEDAALAAEEAAASDERRRPLKRLKRGQNARGGSGSGKGNVRTLSDLGGGKDSAGSEDSEDDEYKPPQELYTGGEKSGMVVRDRSKRKNRADEIFKEAKRKGAKKGSFEARRKSKSFAGTGRLLTGESAEPVAPQSPESIVHNIYFWTNGFTVNDGPLRSFDDPANASFLKSIKNSECPSELEPADKKSQVNVNLVRKEEKCPEPVKRAAPFHGAAKTLGTPSDNNSTPPEATSAAAAASSTETASKTVTITVDDSLPSTSLQIRFVDGSRMVAHFNTSHTIADVRAFIDTTRPGEAGDYTLQAGFPPKPLDDMSKTIEEAGVANSVIIQTA

SEQ ID NO: 29251 - protein, 316 aa, Oryza sativa (japonica cultivar-group)
MVKKKVVKAGSFDLDAKLDKSWMEDITCPICLDFPHNAVLLRCTSYEKGCRPFICDTDQSRSNCLERFKGAHGLPTNMKVPSFNGAPLDSIHIISSNTTDRPACPLCRGDVIGWVVIDEARLHLNQKKRCCEESCCSYVGNFHELQKHTQQKHPNSRPSEIDPARRVDWENFQQSSDIIDVLSTIHAQVPNGIVLGDYVIEYGDDDAGDDYEVYHRVRGNWWTSCIFCKSFCRSSGGRSRARARERRSSGRRSSNRSSQESFTIEVPSGSVDIREIRFDEIDDEYIVTGAMPGIAASRRIASHYRDPRYGRRRSYY

SEQ ID NO: 29252 - protein, 458 aa, Oryza sativa (japonica cultivar-group)
MAAQSWRSFMCCGGGAAVHDDDDSAPRRRRIARRGDSPRSSSRMSFTSLSSSGTLSPEDLSLTLSGSNLYAFTYAELRAATGSFSRANYLGCGGFGPVYKGAVDDGLRPGLAAQDVAVKYLDLDCGTQGHKEWLAEVFFLGQLRHKNLVKLIGYCYEAEHRMLVYEYMSGESLEKHLFKTVNGSLPWMTRMKIALGAAKGLAFLHDADPPVIYRDFKASNILLDLDYNTKLSDFGLAKDGPQGDATHVTTRVMGTHGYAAPEYIMTGHLTAKSDVYSFGVVLLELLSGRKSVDRSRRPREQSLVDWARPYLKWADKLYKVMDPALECQYSCQGAEVAALVAYKCLSENPKSRPTMREVVKALEPVLGMDDFFPVGPFVFTVIVEDEKVVNMKVDMKVEVEEKKNTHQNHQDRHRQKYPDSAIHAGIVLHDRDGVIGGGYTGALRRHRRTASYNKERGA

SEQ ID NO: 29253 - protein, 271 aa, Oryza sativa (japonica cultivar-group)
MAAATSHSAIVHTQSHRWRPNQAAIWFWFCLCIEVFGGGAGESSLILIRHGESLWNEKNLFTGCVDVPLTPKGVEEAIEAGKRICSIPIDVIFTSSLIRAQMTAMLAMMQHRRKKVYSEETRKQSIPVITAWQLNERMYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRVRVFSNL

SEQ ID NO: 29254 - protein, 392 aa, Oryza sativa (japonica cultivar-group)
MIHLRRSFLSRLLHPPCPTPANPLPLHRLLSSAAAAAPIPPEPFAVEDYLVDSCGLTRARAKKASGKLSHLRSPSNPDAVLAFLSGLGLSRPDIAAVVVNDPLFICARVDKTLATRVAELTDLGLSRSQIARLIPVVRSLFRCKSLAPRLAFLLTVFGSFDRCLEVIKTNYGVLSSNVEAVIKPNLAVLKECGISIADRPSYAFASRVISRPTKHLEEAVVLANEFGAKQGTRVFTNAVMIFGILGQEKLAKKLEFFKKLGWSQDDLSLAVRSMPHILAMKEERMRRGMKFLTEDVGLEIPYIARRPALTMYSIERRLLPRHCLINVLKGNGLLKANYDFYNISVISNDDFMEKFVQPYVESVPGLGDAYASSCTGCGVHQLKLLSKRKTKC

SEQ ID NO: 29255 - protein, 460 aa, Oryza sativa (japonica cultivar-group)
MIQFRRRILTLLLQPASPRPIAGIFLPPCSLRRLLSTTAPVSPKPFAVEDYLVAGCGLTRAEAAKASAKISHLSSPSNPDAVIAFLSDLGLPRPQIAAAIAADPRLLCADVEKNLAKRVGELGDLGFSRSQIARLLPLAGWCFRSSSLATNLAFWLPVFGSFDKILKALRMNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDAWEIENGEDFLVRKKEGIVDYCQMILIDYAGANNAGELCCSAASAMMSPCVFWLLTIARILFDD

SEQ ID NO: 29256 - protein, 393 aa, Oryza sativa (japonica cultivar-group)
MIRLRERILSLLLQPASPRPIAGIFPPPCPLRRLLSTTAPVSPKPFAVDEYLVATCGLTRAQAAKASEKLSNLRSPSNPDAVLAFLSDLGLSRPDGIAAAVAADPRLLCADVGSSLARRVDELGGLGLSRSQIARLLPLAGRCFRSSSLATRLAFWHPVFGSFENILKALKMNAALLGSDLDKVAKPNLAFLAQCGINASDVTRTTLSLYSCRLFTVNPRFLQDAVARVEELGVARGWRTFHRVLSTVAFLSRETIASKMQLLDDLGFSQDDFLVIVRRAPQVLRLSDGRIRRSVEFLIRDVGLEQSYIAQRPTLLAYSLERRLLPRHCLLKVLKAKGLLNCDLSYYCIAAMSEEKFVQRFVDPFKDKIQGLADAYTSSCSGEANGVRSLVCL

SEQ ID NO: 29257 - protein, 393 aa, Oryza sativa (japonica cultivar-group)
MVHHLRRHMISLLLRPAYPHPTAAISPLSSLRRLLLFSTTAAPVSPEPFAVEDYLVATWGLTGAQARKASKKLSHLRSPSKPDAVLAFLSDLGLPPRKIAAVATADPRFLCADVESNLARRVDELGGLGLSRSQIARLVPLALTCFRSSSVGTNLGFWLQIVGSFDKILKALRMNSSLLGSDLEKVVKPNLELLKQCGMSDFATSFPLYTSRLFTANPIYLRDAVARVEELGLDRSSRMFRHGLIAVAFTSKESVARKIQVMEELGFSRDELLMIIRKAPQLVASSEEKIRQAAEFLKRDVGLEGRYIAHRPVLFLYSLERRLLPRHHLLKVLRMKGLLDCELDYYNTAAMSERKFVRKFVDPYKCHIPGLADAYTSSCAGETANGVASLLGV

SEQ ID NO: 29258 - protein, 396 aa, Oryza sativa (japonica cultivar-group)
MVDVDSRMAGLAHPAAHAAGLRRLSTRAAAGPPSASASPRHGLHSFDGVAAAVLSHLRKTGVVVLPGLSDAEFARVEAEMGFTFPPDLRAVLAMGLPSGAGFPDWRGRAWLRAAFDLPIAAASLQIAKGALWPRCWGRRPSDPDRARRLARSAIRRAPLLVPLFDRCYLPCRPCLAGNPVFFITDDRVLCCGLDILHFFTRESSFQPLDVSSPSATPSSGICTPHTRRSLDAVCGGQALRWIEFWSDAASDRRRRVSSSSEASTASSSSSSSGCPSPPPRSTPLWVDNYLDKLGSVLKKGGWRDREVDEMVEVTASGLFDGEEAPPADADAVLDALFLKTDRCSDSLRRAGWTSEDVSDAFGLDLRRRKEQPRPAVQIPPEIAAKVQRLAQAVARP

SEQ ID NO: 29259 - protein, 458 aa, Oryza sativa (japonica cultivar-group)
MAASFVIVIVISFFISLAFMCYVHYTSRQRRKLHGYGHEKAVRLPPGSMGWPYIGETLQLYSQDPNVFFASKQKRYGEIFKTHILGCPCVMLASPEAARFVLVTQAHLFKPTYPRSKERMIGPSALFFHQGDYHLRLRKLVQGPLGPDALRALVPDVEAAVRSTLASWDGNVSSTFHAMKRLSFDVGIVTIFGGRLDERRKAELRQNYAIVEKGYNSFPNSFPGTLYYKAIQARRRLHGVLSDIMRERRARGEPGSDLLGCLMQSRAGDDGALLTDEQVADNIIGVLFAAQDTTASVLTWIVKYLHDHPKLLEAVRAEQAAIRAANDGGRLPLTWAQTRSMALTHKVILESLRMASIISFTFREAVADVEYKGFLIPKGWKVMPLFRNIHHNPDYFQDPQKFDPSRFKVSPRPNTFMPFGNGVHACPGNELAKLEMLVLIHHLVTGYRVGDCWFQRRG

SEQ ID NO: 29260 - protein, 512 aa, Oryza sativa (japonica cultivar-group)
MADGYFYLGLALVSLLVVLFARRRRSAAAAHGDAGLRLPPGPWQLPVIGSLHHLAGKLPHRAMRDLARRHGPVMMLRLGEVPTLVVSSRDAAREVMRTHDAAFASRPLSASVRAATKGGRDIAFAPYGDYWRQLRKIAVTELLSARRVLSFRPIREEEVAATLRAVAAAAADGRTVELRAALCALVADSTVRAVVGERCAGLDVFLRQLDRAIELAAGLNVADLWPSSRLAGRLSGAVRQAERCRDTMFGVLDGIIQAHLEKTGGAGEDILDVLLRIHKEGGLEFPLDMDAVKCVVVDVISGGCETSATTLGWAFAELIRNPAAMKKATAEVRRDFEAAGAVSESALAVGELPYLRLVVRETLRLHPPLPLLLPRECREPCRVLGYDVPRGAQVLVNAWAIGRDERYWPGGSPEEFRPERFGDGEAAAAVDFKGADFELLPFGGGRRMCPGMAFGFANVELPLASLLFHIDWEASGVADPTEFDMTEAFGITARRKANLLLRPILRVPVPGV

SEQ ID NO: 29261 - protein, 504 aa, Oryza sativa (japonica cultivar-group)
MAAFLVYVLVLVPLAVVPFVYFNRVARRRGGDVRLPPSPWGLPVIGHLHHLVGALPHVAMRDLARRHGPLMLLRLGELPVVVASSAEAAREVMKTRDLDFATRPMSRMARLVFPEGGEGIIFAPYGDRWRELRKICTVELLSGRRVQSFRPVREEEAGRLLRAVAAASPGQAVNLSELLSAHAADSSVRAIMGDRFRDRDAFLAMLERGLKLFAKPALPDLYPSSRLAMLLSRMPRRMKQHHRDMVAFLDAIIQEHQENRSAAADDDNDLLDVLLRIQREGDLQFPLSSESIKATIGDMLVGGSETAATTLHWIMAELVRNPKVMQKAQDEVRRELIGHRKVTEDTLCRLNYMHMVIKEALRLHPPGSLLLPRECRRTCQVLGYDIPKGATVFVNVSAIGRDPKYWDEAEEFIPERFEHSDVDFKGTHFEYTPFGAGRRMCPGMAFGLANVELTLASLLYHFNWELPSGIHAENLDMTEEMRFTTRRLHDLVLIPVVHVPLPTI

SEQ ID NO: 29262 - protein, 445 aa, Oryza sativa (japonica cultivar-group)
MGSMAAAAEAAQEEETVVFRSKLPDIEIPSHLTLQAYCFEKLPEVAARPCLIDGQTGAVYSYGEVEELSRRAAAGLRRLGVGKGDVVMSLLRNCPEFAFTFLGAARLGAATTTANPFYTPHEIHRQASAAGARVIVTEACAVEKVRGFAADRGIPVVAVDGDFDGCVGFGEAMLDASIEPLDADEEVHPDDVVALPYSSGTTGLPKGVMLTHRSLVTSVAQQVDGENPNLYFRREDVVLCLLPLFHIYSLNSVLLAGLRAGSAIVIMRKFDLGALVDLTRRHGVTVAPFVPPIVVEIAKSPRVTADDLASIRMVMSGAAPMGKDLQDAFMAKIPNAVLGQGYGMTEAGPVLAMCLAFAKEPFEVKSGSCGTVVRNAELKIVDPDTGATLGRNQSGEICIRGEQIMKGSISLSFFPLHIIIGIISAKSIIHHLPRVYGHASACTTT

SEQ ID NO: 29263 - protein, 193 aa, Monacrosporium haptotylum
MADIRRKLVIVGDGACGKTCLLIVFSKGTFPEVYVPTVFENYVADVEVDGEHVELALWDTAGQEDYDRLRPLSYPDSHVILICFAIDSPDSLDNVQEKWISEVLHFCQGLPIILVGCKKDLRFDSKTMEELRKTSQKPVTPEEGEQVRGKIGAAKYLECSAKTNDGVREVFEHATRAALTTFKKKKSSKCSIL

SEQ ID NO: 29264 - protein, 194 aa, Monacrosporium haptotylum
MTTQSLKCVVTGDGAVGKTCLLISYTTNAFPGEYIPTVFDNYSASVMVDGKPISLGLWDTAGQEDYDRLRPLSYPQTDVFLICFSLVSPPSFENVKTKWFPEISHHAPNVPIILVGTKLDLRDDPKIQQSLKDKKMAPIQFTNGVAIAKDIGAVKYLECSALTQKGLKNVFDEAIRAVLSPPPKPTKSKKCTIL

SEQ ID NO: 29265 - protein, 348 aa, Mucor circinelloides
MSEETFTAWACKSKSAPLEPMEMTFCHWDDDMVQMDVICCGVCGTDLHTVDEGWGPTEFPCVVGHEIIGNVTKVGKNVTRIKVGDRCGVGCQSASCGKCDFCKKGMENLCSTHAVWTFNDRYDNATKDKTYGGFAKKWRGNQDFVVHVPMDFSPEVAASFLCGGVTTYAPLKRYGVGKGSKVAVLGLGGLGHFGVQWAKAMGAEVVAFDVIPDKVDDAKKLGCDDYVLMQKEEQMEPHYNTFTHILATKIVNKCWDQYFKMLKNNGIFMLCDIPEVPLSGMSAFVMAGKQLTIAGTFIGSPSVIQECLDFAAKHNVRTWVNTFPMEKINEAFEFVRQAKPRYRAVVMN

SEQ ID NO: 29266 - protein, 418 aa, Chlamydomonas reinhardtii
MLANLRSGIQGRTTSAPQKAAFAPTRRGCAHARTGGRRTTVVVRADGDFYDLLGVPRTADKKTIKQAYRQKARKYHPDVNKEPGAEDLFKKIGEAYEVLSDDNKKAIYDKYGEAGLRGGMGGMGGGPGVEFTNPFDLFESFFGGGMGGMGGMGGMGGGFSQRSRTRAVPGEDDKVDLQLDFLEAVFGCSRELDVDRLTGCDECETTGVRKGTTPSTCPQCQGTGQVVSAVRTPLGTFQQVSLCPRCEGSGQISQPCTKCQGDGRVRETKRISLKVPAGVDAGSRLRVRGEGNSGRRGGEPGDLYVYITIKDHPELRRDGITIHSDVEISYVDAILGTQVKVTTVDGPVELKIPPGTQPGTTLLMAKRGVPRLGSPNVRGDHMVHVRVRIPKALSADERKLVEELKELQSKTKVGPFRF

SEQ ID NO: 29267 - protein, 180 aa, Quercus robur
MAEIRDQYGNPIQLTDEHGNPEQLTDEHGHPMHLTGVATTKIHDEPDRDTTEGTLASTAVGVGGAKEHDQQLDQQKQQHELEVSRTSSSSSGSSEDDGQGEIEGQGGEVRRRKKKGLKEKIKEKLTCGKSKEEQSQTESFTSTATTTISTGATSPGAQPEHEKKSVIEKIKEKLPGHHSH

SEQ ID NO: 29268 - protein, 380 aa, Lotus corniculatus var. japonicus
MSTTAGQVIKCRAAVSWEAGKPLVIEEVEVAPPQAGEVRLKILYTSLCHTDVYFWEAKGQTPLFPRIFGHEAGGIVESVGEGVTHLKPGDHALPVFTGECGECPHCKSEESNMCDLLRINTDRGVMISDNQSRFSIKGKPIYHFVGTSTFSEYTVLHAGCVAKINPAAPLDKVCILSCGICTGFGATVNVAKPKPGSSVAIFGLGAVGLAAAEGARVSGASRIIGVDLVSSRFEGAKKFGVNEFVNPKDHDKPVQEVIAEMTNGGVDRAVECTGSIQAMISAFECVHDGWGVAVLVGVPNKDDAFKTHPVNFLNERTLKGTFYGNYKPRTDLPNVVEMYMRGELELEKFITHTVSFSEINKAFDYMLKGESIRCIIRMEE

SEQ ID NO: 29269 - protein, 403 aa, Papaver rhoeas
MDGTQEAAATDTVMGEAPSGVIAGEGPQPPPASEGGGGGGMENIPATLSHGGKFIQYNIFGNIFEVTAKYKPPIMPIGKGAYGIVCSALNSETSEQVAIKKIANAFDNKIDAKRTLREIKLLRHMDHENVVAIRDIIPPPDRGAFNDVYIAYELMDTDLHQIIRSNQALSEEHCQYFLYQILRGLKYIHSANVLHRDLKPSNLLLNANCDLKICDFGLARITSETDFMTEYVVTRWYRAPELLLNSSEYTAAIDVWSVGCIFMELMDRKPLFPGRDHVHQLRLLLELIGTPSEADLGFVNDNAKRYIRQLPRHPRQSLTEKFPHVHPSAIDLVEKMLTFDPRVRITVEDALAHPYLATLHDISDEPVCMTPFNFDFEQHALSEEQMKELIYREALAFNPEYQP

SEQ ID NO: 29270 - protein, 328 aa, Papaver rhoeas
IGRGAYGIVCAAINSETREEVAIKKIGNAFDNRIDAKRTLREIKLLRHMDHENIIAIKDIIRPPQRESFDDVYIVYELMDTDLHQIIRSTQQLTDDHCQYFLYQLLRGLRYVHSANVLHRDLKPSNLFLNANCDLKIGDFGLARTTSETDFMTEYVVTRWYRAPELLLNCSEYTAAIDIWFVGCILGEILTREPLFPGKDYVHQLRLITELLGSPDDSSLGFLRSDNARRYVRQLPQYPKQHFSARFSQMSQGAIDLLEKMLVFDPSKRITVEEALCHPYLKSLHDINDEPICARPFNFDFEQPSFTEVNIKEPIWRESVKFNPDPTH

SEQ ID NO: 29271 - protein, 181 aa, Leptospira interrogans
MGPPGAGKGTQAKILCERLSIPQISTGDILREAVKNQTAMGIEAKRYMDAGDLVPDSVVIGIIKDRIREADCKNGFLLDGFPRTVEQAEALDTLLKNEGKSIDKAINLQVPDAELLKRLLGRAEIEGRADDNEVTIKNRLDNYNKKTLPLLDFYATRKKLSQVNGVGSLEEVTSLIQKELA

SEQ ID NO: 29272 - protein, 464 aa, Azotobacter vinelandii
MAVYNYDVVVIGTGPAGEGAAMNAVKAGRKVAVVDDRPQVGGNCTHLGTIPSKALRHSVRQIMQYNNNPLFRQIGEPRWFSFADVLKSAEQVIAKQVSSRTGYYARNRIDTFFGTASFCDEHTIEVVHLNGMVETLVAKQFVIATGSRPYRPADVDFTHPRIYDSDTILSLGHTPRRLIIYGAGVIGCEYASIFSGLGVLVDLIDNRDQLLSFLDDEISDSLSYHLRNNNVLIRHNEEYERVEGLDNGVILHLKSGKKIKADAFLWSNGRTGNTDKLGLENIGLKANGRGQIQVDEHYRTEVSNIYAAGDVIGWPSLASAAYDQGRSAAGSITENDSWRFVDDVPTGIYTIPEISSVGKTERELTQAKVPYEVGKAFFKGMARAQIAVEKAGMLKILFHRETLEILGVHCFGYQASEIVHIGQAIMNQKGEANTLKYFINTTFNYPTMAEAYRVAAYDGLNRLF

SEQ ID NO: 29273 - protein, 131 aa, Eremothecium gossypii
MSGKGGKAGSAAKASQSRSAKAGLTFPVGRVHRLLRKGNYAQRIGSGAPVYMTAVLEYLAAEILELAGNAARDNKKTRIIPRHLQLAIRNDDELNKLLGNVTIAQGGVLPNIHANLLPKKSAKATKASQEL

SEQ ID NO: 29274 - protein, 447 aa, Eremothecium gossypii
MASQEEFYRTQIFGTVFEITNRYADLNPVGMGAFGLVCSAVDTYTQQPVAIKKIMKPFSTAVLAKRTYRELKLLKHLRHENLICLEDIFLSPLEDIYFVTELQGTDLHRLLQTRPLEKQFLQYFLYQILRGLKYVHSAGVIHRDLKPSNILINENCDLKICDFGLARIQDPQMTGYVSTRYYRAPEIMLTWQKYNVEVDIWSAGCIFAEMIEGKPLFPGKDHVHQFSIITDLLGSPPKDVIDTICSENTLKFVTSLPHRDPVPFTERFKNLKPDAVDLLEKMLVFDPKKRITAGDALTHPYLAPYHDPTDEPVADAKFDWNFNDADLPVDTWRVMMYSEILDFHQVPDSQINPNDTFDDQVAAATAAAEAARQQQQQKQQQQKQQQQRHQGVEHGAQHVQLQHGAKQLSADPLVGDSNGGIPLNVSAANETLNNFANQAAQYATDFE

SEQ ID NO: 29275 - protein, 502 aa, Agastache rugosa
MDLFLLEKTLLGLFAAIVVAAVVSKLRGKKFKLPPGPIPVPIFGNWLQVGDDLNHRNLTDYAKKFGDIFLLRMGQRNLVVVSSPELAKDVLHTQGVEFGSRTRNVVFDIFTGKGQDMVFTVYGEHWRKMRRIMTVPFFTNKVVQQYRHGWEAEVAAVVEDVKKNPDSATTGIVLRRRLQLMMYNNMYRIMFDRRFESENDPLFVKLRALNGERSRLAQSFEYNYGDFIPILRPLLKGYLRICKEVKDRRLQLFKDYFVDERKKLASTKPMDNDGLKCAIDHILDAQQKGEISEDNVLYIVENINVAAIETTLWSIEWGIAELVNNPEVQRKVREEMDRVLGVGVPVTEPDTHKLPYLQAVIKETLRLRMAIPLLVPHMNLHDAKLGGFDIPAESKVLVNAWWLANNPEQWKKPEEFRPERFLEEESKVEANGNDFRYLPFGVGRRSCPGIILALPILGITLGRLVQNFELLPPPGKSKIDTTEKGGQFSLHILNHSTIVMKP

SEQ ID NO: 29276 - protein, 130 aa, Bacillus subtilis
DYFVCVEGALKLKEISYIQAEGFAGGELKHGTIALIEQGTPVFALATQEHVNLSIRGNVKEVAARGANTCIISLKGLDDADDRFVLPEVNPALAPLVSVVPLQLIAYYAALHRGCDVDKPRNLAKSVTVE

SEQ ID NO: 29277 - protein, 464 aa, Aspergillus oryzae
MKSPIPDYLRQVLEKARPDDSGQLANYIDVLAKADPSKMAIALSTVDGNLYSAGDDEVEFSIQSISKAFVYAIAIEDAGLPRVLEKIGVEPSGDAFNKLSLQPGTNRPMNPMINAGAIAAHTLVAGESASAEERVDHILKVLSKLAGRQLKVDEEVYEAELKDANRNMAIGYMLKAAGIISCDPQDAVRGYIRQGSITTNVRDLAMMAATLANAGVNPITGEEIMPHQSARQVLSVMTTCGMYDAAGDWVSRVGMPAKSGVAGGIIGALPGQVGIAVFSPKLDERGNSFRGVKMFEQLSSEMGLHMMDISQVGRATVRTWTLTIAGGAKQPDEREQEVPVFGLRGAVRFAGSERLTRAIVRELTPPNPDDPGSGRHADASAVIFSLKDTYSLNYVALRIISEDMRRLLAADKNVVVIDPVKVLKIDGNPAFKEKSPCVVNDEAEARRYIGGQGCRAVSHSDEFY

SEQ ID NO: 29278 - protein, 320 aa, Fragaria x ananassa
MENFPVINMEKLNGEERNATMETIKDACENWGFFELVNHGIPTVFLDTVEKMTKDHYKNCLEQRFKEPVASKGLNAVNTEVNDMDWESTFYLKHLPRSNISEVPDLDEEYRKVMKDFALKLEKLAEELLDLFCENLGLEEGYLKKAFYGSQGSPTFGTKVSNYPPCPTPDLIKGLRSHTDAGGDILLFQDDKVSGLQLLKDGEWIDVPPMRHSIVINLGDQLEVITNGKYKSVEHRVIAQTDGTRMSIASFYNPGSDAVIYPAPSLVETETEEKNQVYPKFVFDDYMKLYAVLKFQAKEPRFEAMKTVEANPSLAAIATA

SEQ ID NO: 29279 - protein, 501 aa, Mycobacterium tuberculosis
MSFVVTIPEALAAVATDLAGIGSTIGTANAAAAVPTTTVLAAAADEVSAAMAALFSGHAQAYQALSAQAALFHEQFVRALTAGAGSYAAAEAASAAPLEGVLDVINAPALALLGRPLIGNGANGAPGTGANGGDGGILIGNGGAGGSGAAGMPGGNGGAAGLFGNGGAGGAGGNVASGTAGFGGAGGAGGLLYGAGGAGGAGGRAGGGVGGIGGAGGAGGNGGLLFGAGGAGGVGGLAADAGDGGAGGDGGLFFGVGGAGGAGGTGTNVTGGAGGAGGNGGLLFGAGGVGGVGGDGVAFLGTAPGGPGGAGGAGGLFGVGGAGGAGGIGLVGNGGAGGSGGSALLWGDGGAGGAGGVGSTTGGAGGAGGNAGLLVGAGGAGGAGALGGGATGVGGAGGNGGTAGLLFGAGGAGGAGGFGFGGAGGAGGLGGKAGLIGDGGDGGAGGNGTGAKGGDGGAGGGAILVGNGGNGGNAGSGTPNGSAGTGGAGGLLGKNGMNGLP

SEQ ID NO: 29280 - protein, 1102 aa, Rhodobacter sphaeroides f. sp. denitrificans
MNQNVSPSTVAVRRTDGIDRSQTDWYKDAIIYQLHIKAFQDANGDGIGDFAGLMQRLDYVQALGVTAIWLLPFYPSPLRDDGYDISDYRSINPSYGAMRDFKLFVQEAHKRGLRVITELVINHTSDQHPWFQRARRAKKGSAARDWYVWSDTDQKFPETRIIFLDTEKSNWTWDPVAGAYYWHRFYSHQPDLNFDNPRVLEEVLKIMRMWLEMGVDGLRLDAIPYLVEREGTNNENLPETHDVLKKIRANLDQHFPDRMLLAEANQWPEDTRPYFGEGDECHMGFHFPLMPRMYMALAQADRHPITDIIRQTPEIPEGCQWGIFLRNHDELTLEMVTAEERDYMWRFYAEDSRARINLGIRRRLAPLMKNDRRKIELLNQMLMSMPGTPIVYYGDEIGMGDNYYLGDRDGVRTPMQWSADRNGGFSRCNPQQLYLPTILDPVYGHQAINVEAQAADPSSLLNWTRRLIAVRKQHPAFGRGSMSLLYPRNRKVLAYVRSHEGTDILCVANLSDTAQAVELDLARFRGAVPVELTGRSEFPPVGDLPYMLTLPPYGFYWFILSDQQALPSWHQPMPETLPDFITLTTRDGRAETALTGRETRQFEADVLPNWLPLQRWFGAKEEKISAVKLAVLGSLSADHALVRLDADVGGEAQQYFLPASALWGEEQLRAGAPKLSFTLAKVRRGPQVGALIDGAYDEQMAQAMLEALREGRRLSGAGGEVVFEPGSGLAEIADPGEPRYLGAEQSNISIAFGDRLILKLYRRLRAGEQPDVEVARFLTEVAGYTHTPRYLGVVSLRPAEGEATVLAAAFAFVANMGDAWRGLFDALVRDLGEFGGWSTAEAPEVEKEGFSFPLTIPGLLGQRTAELHQAFATETDEAAFRMEPLRAEHLTGWAEGARREAETMLSVLERQRTHLPEEVLPLAEALLARRDDLLARLDRVTGFEPSGALTRIHGDYHLGQVLLAQDDVAIIDFEGEPRRTLEERREKSSPLRDVAGMLRSFDYAAAAALARHEESFGPASERAVERAEAWRQQAVADFLSAYEGASAGTASLPSDPALKEALLDLFLVQKAVYETSYELGSRPAWVGIPLRGLLELLDRTPA

SEQ ID NO: 29281 - protein, 491 aa, Malus x domestica
MTSILLGYDIGVMSGAAIYIEKDLKVTDTQIEILLGILNLYSLIGSAMAGRTSDWVGRRYTIVISGAIFFTGAILMGLSTNYTFLMCGRFVAGLGVGYALTIAPVYAAEVSPASSRGFLTSFPEVFVNVGILLGYISNYAFSFCALDVGWRLMLGVGAIPSVILAIGVLAMPESPRWLVMQGRLGDARQVLDKTSDSKEESMLRLADIKEAAGIPEDCNDDIVQVTGHSHGEGVWKELFVHPTPTVLHIVIAALGFHFFQQASGIDALVLYSPRVFEKAGITNSNQLLLCTVGVGLSKTVFTFVATFFLDRVGRRPLVLTSMAGMVASLVCLGTSLTIVDQHEGARMTWAVVLCLCCVLAFVGFFSTGIGPIAWVYSSEIFPLRLRAQGCGMGVAVNRVMSGVLSMTFISLYKAITMGGAFFLYAAIGAVGWIFFFTMLPETQGRTLEDMEVLFGKFHKWRKANKLLEKERQVARGDGGTSDPDNRVNLLA

SEQ ID NO: 29282 - protein, 226 aa, Oryza sativa (japonica cultivar-group)
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 29283 - protein, 362 aa, Oryza sativa (japonica cultivar-group)
MGMDYYKILGVDKAASDDDLKKAYRKLAMKWHPDKNPNNKKEAENKFKQISEAYEVLSDPQKRAVYDQYGEEGLKGQVPPPGAGGAGPGGATFFSTGGDGPNVFRFNPRNAEDIFAEFFGSSSPFGGMGGGMGGGMGGGPGMRTGGTRFSSSIFGDDIFGSAFGGGADGHHGMHGGGAGRALKAPAIERKLPCSLEELYKGTTKKMKISREIADASGKTIPVEEILTIDVKPGWKKGTKITFPEKGNEQPNVIPADLVFIIDEKPHPVFTRDGNDLVVTQKIPLAEALTGHTVHLTTLDGRSLTIPITSVINPGYEEVVRGEGMPIPKDPSKKGNLRVKFDIKFPARLTADQKSGVKRLLGQ

SEQ ID NO: 29284 - protein, 509 aa, Oryza sativa (japonica cultivar-group)
MGTRSVALVLLAAVLLQALLPASAAEGLVRIALKKRPIDENSRVAARLSGEEGARRLGLRGANSLGGGGGEGDIVALKNYMNAQYFGEIGVGTPPQKFTVIFDTGSSNLWVPSAKCYFSIACFFHSRYKSGQSSTYQKNGKPAAIQYGTGSIAGFFSEDSVTVGDLVVKDQEFIEATKEPGLTFMVAKFDGILGLGFQEISVGDAVPVWYKMVEQGLVSEPVFSFWFNRHSDEGEGGEIVFGGMDPSHYKGNHTYVPVSQKGYWQFEMGDVLIGGKTTGFCASGCSAIADSGTSLLAGPTAIITEINEKIGATGVVSQECKTVVSQYGQQILDLLLAETQPSKICSQVGLCTFDGKHGVSAGIKSVVDDEAGESNGLQSGPMCNACEMAVVWMQNQLAQNKTQDLILNYINQLCDKLPSPMGESSVDCGSLASMPEISFTIGGKKFALKPEEYILKVGEGAAAQCISGFTAMDIPPPRGPLWILGDVFMGAYHTVFDYGKMRVGFAKSA

SEQ ID NO: 29285 - protein, 465 aa, Oryza sativa (japonica cultivar-group)
MNSLQSFLALNPPAAAAALGGARLRPSRVTACLATPTPTPPPPTSAPLAPAAAAARRELSAASRAVVEDEARYIVGTYNRSRVVLVAGRGCKLYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 29286 - protein, 416 aa, Alternaria brassicicola
MGDLANRKVFKVFNQEFIVDERYNVTKELGQGAYGIVCAATNNQTGEGVAIKKVTNVFSKKILAKRALREIKLLQHFRGHRNITCLYDMDIPRPDNFNECYLYEELMECDLAAIIRSGQPLTDAHFQSFIYQILCGLKYIHSANVLHRDLKPGNLLVNADCELKICDFGLARGFSMDPEENAGYMTEYVATRWYRAPEIMLSFQSYTKAIDVWSVGCILAELLGGKPFFKGRDYVDQLNQILHYLGTPNEETLSRIGSPRAQDYVRNLPYMQKISFQSLFKNANPDALDLLDRMLAFDPSSRISVEEALEHRYLQIWHDASDEPSCPTTFDFQFEVVEEIPEMKKMILDEVSRFRQMVRVQPGAGAGANQAPQVPIPNNYDRAGYEDPRPQEAFNQGGWNGSDLERDLQGLDGRMR

SEQ ID NO: 29287 - protein, 454 aa, Trichoderma asperellum
MEAIFNVQTKFRLERGLSKIRAIRNENYKRHGTKSYVYLLNRFGFEPTKPGPYFQGVQFHQRGLAHPDFHEARGGRVHKKKHLRKKVTPEGSTDPNGTETGEVGAEDQQNDSEYLCEVTIGTPGQTLLLDFDTGSSDLWVFSTELSSTIQKGHTVFNPKNSSTFKALTGQKWQISYGDGSSASGDCGSDNVTVGGLTIKNQTVELASTLAQQFSQGTGDGLLGLAWPSINTVTTDGKPTPANTSRCQHITQDDVPSEAQLFTAAFYSERDANAQSFYTFGYIDNDLVTASGQDIAWTDVDNSQGFWMFPSTSSSINGKAISQSGNSAIADTGTTLALVSDEVCDALYKAIPGAKYDDQQQGYVFPMSTDVSSLPEFKVSVGDTQFVIQPEDLAFAPADNSNWYGGVQSRGNNPFDILGDVFLKSVYAIFDQGNQRFGAVPKIQATQNLNSSSNQ

SEQ ID NO: 29288 - protein, 296 aa, Saccharum officinarum
MATASSSFTAIFFSSAFAACFAEVCTIPLDTAKVRLQLQRKTPLPAPPAAAAAAGGGMLATIMCIAREEGVAALWKGVIPGLHRQFLYGGLRIGLYEPVKAFFVGGAAVGDVSLLSKILAALTTGVIAIVVANPTDLVKVRLQADGKANTVKRSYSGALNAYATIIRQEGIGALWTGLGPNVARNAIINAAELASYDQFKQMFLKLPGFTDNVFTHLLAGLGAGFFAVCIGSPVDVVKSRMMGDSTYRSTLDCFAKTLKNDGPGAFYKGFIANFCRIGSWNVIMFLTLEQVRRFFL

SEQ ID NO: 29289 - protein, 309 aa, Saccharum officinarum
MPGDHGSKVDISFAGRFTASAIAACFAEICTIPLDTAKVRLQLQKNVVAAAAGDAAPPLPKYRGLLGTAATIAREEGAAALWKGIVPGLHRQCIYGGLRIGLYEPVKSFYVGKDHVGDVPLSKKIAAGFTTGAIAISIANPTDLVKVRLQAEGKLAPGVPRRYTGAMDAYSKIARQEGIAALWTALGPNVARNAIINAAELASYDQVKQTILKLPGFKDDVVTHLFAGLGAGFFAVCVGSPVDVVKSRMMGDSAYKSTLDCFVKTLKNDGPLAFYKGFLPNFARLGSWNVIMFLTLEQVQKLFVRKPAS

SEQ ID NO: 29290 - protein, 1000 aa, Euglena gracilis
KAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTDASVAMMAVTGETSLNKLQLKDADVKGKRVFIRVDFNVPFDKKDPTKITNLARVQGALPTIQYCLENGAKSVVLASHLGRPDGKMPEKYSLAPVARALEGLISRPVTFLKDCVGPEVEAACDPAPGSVILLENVRFYAEEEGKGLDAEGNKVKASPEAVAAFPKSLAKVADVYVNDAFGTAHRAHSSMVGEGLPREASGFLVAKELDAFAKVLNNPVRPVLAILGGAKVSDKILLIENLLDKVDKMIIGGGMAFTFQKVLNNMAIGSSLYDEAGAKIVPEIMAKAKAKGVEIVLPVDFVTSSKFGEDGEIGTATLESGIPDGMLGLDCGPKTNALNAATIQASKTIIWNGPMGVFEMKKFEQGTKQMMDEIVKVTQQGATTVIGGGDTATACKVYGTEDKVTHVSTGGGASLELLEGKVLPGIAALTNA

SEQ ID NO: 29291 - protein, 414 aa, Euglena gracilis
MPGSALGPKLSIDDLDIKDKNVLVRVDFNVPMKDGKILDDFRMRSALPTLEKVINSGGKLIIMSHMGRPAETGYEAKYSLKPIADHLGTLLGKPVTFAADCMDAAAEVAKLTPGDVLVLENLRFYPHEGSKDKDQRLEMAKKLASYADLYVSDAFGTAHRDAASMTGVPEVMGQGASGYLMKKEIDYFSKALKEPEKPVVAIVGGAKVSDKIQLLENMLKTVNQMVIGGAMAYTFLKAQGKSTGKSKCETEAETKKGKIDIVELAGKLLSKAKEQGVEIYLPVDHRCSAEFKDVEPVITSDENIPDDLMALDIGPKTEELYCSVDFAKAKTAIWNGPMGVFELEHFKPGTWAVARPLADHSDSCCSIVGGGDSERREKSGYAPKLSHISTGGGASLELLEGKVLPGLAILTDKP

SEQ ID NO: 29292 - protein, 433 aa, Pisum sativum
MVHSFKYILIGGGVSAGYAAREFVKQGVHPGELAIISKEAVAPYERPALSKAYLFPESPARLPGFHTCVGSGGERLLPEWYSEKGIQLYLSTEIVSADLAAKFLKSANGEHFDYQTLVIATGSAVIRLTDFGVIGANAKNIFYLREVDDADKLYEAIKRKKNAKAVVVGGGYIGLELSAVLKLNDLDVTMVYPEPWCMPRLFTSEIAAFYEGYYANKGINIIKGTVAVGFTANSDGEVKEVKLKDGRVLEADIVIVGVGGRPQISLFKGQVEEQHGGIKTDSFFKTSVPDVYAVGDVATFPLKLYNDVRRVEHVDHARKSAEQAAKVIFAADVRKSVEEYDYLPYFYSRSFDLSWQFYGDNVGETVLFGDNDPASSKPKFGTYWIKEGKVVGAFLEGGTPDENKAIAKVARAKPAVEDVNQLAEEGLSFASKI

SEQ ID NO: 29293 - protein, 131 aa, Holcus lanatus
MARKGVSYVTAAELVSLVRDPRVAIIDVRDEERICDAHIAGSHHYASDGFAERLPEIAEATRAKETLVFHCALSQVRGPTCARMFSDYLSEAKEDSGVKSITILERGFNGWELSGRPVCRCKDAPCKGVCS

SEQ ID NO: 29294 - protein, 1495 aa, Penicillium digitatum
MSPQAETISTEAWSTDSADERPWSGTTNQLDPVFEKEGDSTDISERDRAQIGILARQLTTASTKTGVQGAVSNPFKGSNDPRLDPFSKEFNPKKWVETVLHLNSQNPERYLPRKAGFSFRNLSVHGFGSPVSYQKDFLNIFLQVADMVTGLINSKDQKIQILRNHNGLLRNGEMLLVLGRPGSGVSTFLKTIAGQTKGLYLDEASEFNYQGIPRKKIRGEFRGDVIYQAETDTHFPNLTVGQTLLYAALAKTPQNRLSGVSRDEYARHIRDVTMAVFGLTHTMNTKVGNDFIRGVSGGERKRVSIAEVCLAQSPIQCWDNSTRGLDSATALKFVQTLRLSADITSMATVVALYQASQQSYETFDKVAVLYEGRQIYYGPVELAKNYFVNLGYHCPDRQTTPDFLTSLTNPVERVARSGFEAKVPRSPDDFAKAWEESSLHKELMQDIVEFEKEHPVGGPAVDSFKKSRQAEKASWMTPNSPYTISVPLQVLLCIRRGFRRIQGDMTFFSITIGGNLVISLLLGSVFYMLEDTSASFQSRCILLFFALLFNALNSSLEILSLYAQRSIVEKHATYAFYHPLSEAVASMICDIPSKILSTIAFNIPLYYMANLRTESGHVITYLLIVFSSTLVMSMIFRTIGQSTRTIAEALTPAALMVIAMVLYTGFILPIRNMQGWLRWLHYINPLAYSYEALVANEFHGRNFECAGFIPAGPMYQNITAADRTCSVVGASAGSSVVRRRPLYCYELWVLLLQHVWRNFGILIAFIICFMIGYLLSAEYISSDVGKGEILLFQRSHFSAIKKTQKADEEVGSSGLHEKYRQDETNGEASTGITAQKNIFHWRDLCYEVSIKGKTRRITDHVNGWVKPGKLTALMGASGAGKTTLLDVLANRVTMGVVTGGIYNNGLPRDASFQRRIGYVQQQDLHLETATIREALEFSAFLRQPAHVSKAEKLQSVEEILDLLEMRSYADAVVGVPGEGLNVEQRKRLTIGVELAAKPDLLFFLDEPTSGLDSQTAWSILLLLRKLTDHGQAILCTIHQPSSMLFQQFDRLLLLAAGGRTVYFGDIGENSKTMTGYFERHGADHCDENDNPAEWMLRVIGAAPGSATKIDWPATWLGSQEYADVKEELISLERKDGVETNSSADPSLQFASPFHVQLWACTKRVFEQYWRTPSYLYSKLTMCFVTALFIGLSFLQTKVTELGLQHQMFAVFMLLVIFPFLAYQQMPNYILQRDLYEVRERPSKTYSWITFILAQVIVEIPWNSLAALITFIPFYYLIGMNHNAAPTHQTTERGGLMFLLIWGFLMHCGTFTTMVVASAATAEIGAILALLLFVFCLIFCGVMATPASLPGFWIFMYRVSPLTYIISGMMSTGLANIDVHCSDIETTLVQPPSGETCGSYLGAYLQIAGGAIYNPNATSDCQFCTIADSNVFLESVSSSYTDRWRNFGLIWAYVAFNVAATLILYWYVRVRGSPGLSHVVSWVQKASKHLSWKKAQ

SEQ ID NO: 29295 - protein, 1478 aa, Penicillium digitatum
MSLLGTINPNPARSQSVVSHNTPQLPGDHELDAINDPEKDDDEDTVQEDDENKEALVGQLARRLTRQSTRFSVNGALDNPFTNGDSESSINPSSPNFKVRDWMKMLLAIRSRDPDRYPDRTAGISFKNLNVHGFGSPTDYQKDVLNTLLEIGTMFRQLTGMKLQKIQILRNFDGLVKSGETLVVLGKPGSGCSTLLKTIAGEMNGIETSEDSVLNYQGISAKDMQNAFKGEAIYSAETDVHFPQLSVGDTLMFAALARAPRNRLEGVSTEQYARHMRDVVMAMLGLSHTVNTRVGNDFVRGVSGGERKRVSIAEATLSQSPLQCWDNSTRGLDSANALEFCKNLALMSKYSGTTACVAIYQASQSAYDVFDKVTVLYEGRQIFFGPTTEARKYFEDLGYECPDRQTTADFLTSVTSPSERVVRRGFEGRAPITPDDFAEAWKKSTARAKLLGEIEEYEKNYPIKGSSYDAFVDARRAAQAKSQRVKSPYTISVRKQISLCVTRGFQRLRGDYSLTATALIGNFIMSLIVGSVFVNLPNDTSSFYSRGALLFFAVLLNAFSSALEILTLYAQRPIVEKHARYAFHHPFAEALASMLCDVPYKIANSFTFNIPLYFMTHLRREGGPFFTFWIFSVLTTFTMSMIFRTIAASSRSLSQALVPAAVLILGMVIYTGFVIPTRNMLGWSRWMNYIDPVAYAFESFMVNEFRNRHFPCAAIVPSGGAYDSISMENRICSTVGAQSGSSDVSGTLYLEESYGYMTKHLWRNFGILIAFLLFFMSTYLFATEYISEKKSKGEVLLFRRGYQPAHAAGEGDLEKSSQPSAVAKTDESTPSTTAIQRQTAIFQWEDVCYDIKIKGEPRRILDHVNGWVKPGTCTALMGVSGAGKTTLLDVLATRVTMGVVTGQMLVDGNPTDQSFQRKTGYVQQQDLHLSTSTVREALVFSALLRQPATVSRQEKIAYADEVIKLLGMEAYADAVVGVPGEGLNVEQRKRLMIGVELAAKPQLLLFLDEPTSGLDSQTSWSILDLIETLTKHGQAILCTIHQPSAMLFQRFDRLLFLARGGRTIYFGEIGENSSTLSNYFERNGAHHLTPGENPAEWMLDVIGAAPGTHSDIDWPKVWRESPEFGQVKDHLSELKSTLSSKAAVDTSPNAFREFAAPFHVQLLECLKRVFAQYYRTPTYIWSKAALCILTSLYIGFSFFHAQNSIQGLQNQMFSVFMLMTIFGNLVQQIMPNFVTQRSLYEVRERPSKTYSWKAFMISNILVEMPWNTLMAALMYFCWYYPIGLYKNAEPTHAVSERGALMFLLIWSFLLFTSTFAHMVIAGIELAETGGNIATLLFSLCLIFCGVLATKEAMPGFWVFMYRVSPFTYLISAMLSTGVSGADAVCEAVEYLKFNPPANQTCGDYMSAYIKVAGGYLQNPMATTDCAFCTVSTTNMFLSRISSTFSEAWRNFGLMWVYIIFNIAGALFIYWLARVPKGK

SEQ ID NO: 29296 - protein, 330 aa, Oryza sativa
MVISSKGKVCVTGASGFVASWLIKRLLEAGYHVIGTVRDPSNREKVSHLWRLPSAKERLQLVRADLMEEGSFDDAVMACEGVFHTASPVLAKSDSNCKEEMLVPAINGTLNVLKSCKKNPFLKRVVLTSSSSTVRIMDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 29297 - protein, 341 aa, Fragaria x ananassa
MGLGAESGSVCVTGASGFVGSWLVMRLLEHGYTVRATVRDPANLKKVRHLLELPQAATRLTLWKADLDVEGSFDEAIKGCTGVFHVATPMDFESEDPENEVIKPTINGMLDIMKACLKAKTVRRVVFTSSAGAVAIEEHRKEVYSENNWSDVVFCRKVKMTGWMYFVSKTLAEQAAWKFAKENNIDFITIIPTLVIGPFLAPSMPPSLISGLSPLTGNEAHYGIIKQCQYVHLDDLCQSHIFLYEHPKAEGRYICSSHDATIHDIAKLLNEKYPKYNVPKKFKGIEENLTNIHFSSKKLKEMGFEFKHSLEDMFTGAVDACREKGLLPLPQEEETEKRRAG

SEQ ID NO: 29298 - protein, 342 aa, Fragaria x ananassa
MGLRAESGSVCVTGASGFVIGSWLVMRLLERGYTVRATVRDPANLKKVRHLLELPQAATRLTLWKADLDIEGSFDEAIKGCTGVFHVATPMDFESEDPENEVIKPTINGMLDIMKACLKAKTVRRVVFTSSAGAVAIEEHRKEVYSENNWSDVVFCRKVKMTGWMYFVSKTLAEQAAWKFAKENNIDFITIIPTLVIGPFLAPSMPPSLISGLSPLTGNEAHYGIIKQCQYVHLDDLCQSHIFLYEHPKAEGRYICSSHDATIHDIVKLLNENYPKYNVPKKFKGIEENLTNIHFSSKKLKEMGFEFKHSLEDMFTGAVDACREKGLLPLPQEEETEKRRAG

SEQ ID NO: 29299 - protein, 1046 aa, Oryza sativa (indica cultivar-group)
MQPPHSSYKTQSNRLPIPVLSLALVLLLNFTSPTSSCTEQEKNSLLNFLTGLSKDGGLSMSWKDGVDCCEWEGITCRPDRTVTDVSLASRRLEGHISPYLGNLTGLLQLNLSHNQLSGALPAELVFSSSLIIIDVSFNRLNGGLNELPSSTPARPLQVLNISSNLLAGQFPSSTWEVMKNLVALNASNNSFTGQIPTNLCTNSPSLAVLELSYNQLSGSIPSELGNCSMLRVLKAGHNNLSGTLPNELFNATSLECLSFPNNGLEGNIDSTSVVKLSNVVVLDLGGNNFSGMIPDSIGQLSRLQELHLDHNNMHGELPSALGNCKYLTTIDLRGNSFSGDLGKFNFSTLLNLKTLDIGINNFSGKVPESIYSCSNLIALRLSYNNFHGELSSEIGKLKYLSFLSLSNNSFTNITRALQILKSSTNLTTLLIEHNFLEEVIPQDETIDGFKNLQVLTVGQCSLSGRIPLWLSKLTNIELLDLSNNQLTGPIPDWIDSLNHLFFLDISNNSLTGEIPITLMGMPMIRTAQNKTYLDPSFFELPVYVDKSLQYRILTAFPTVLNLSQNNFMGVIPPQIGQLKMLVVLDFSYNNLSGKIPESICSLTSLQVLDLSNNHLTGSIPGELNSLNFLSAFNVSNNDLEGPIPTGAQFNTFPNSSFDGNPKLCGSMLIHKCKSAEESSGSKKQLNKKVVVAIVFGVFLGGTVIVLLLGHFLSSLRAAIPKTENKSNSSGDLEASSFNSDPVHLLVMIPQGNTEANKLTFTDLVEATNNFHKENIIGCGGYGLVYKAELPSGSKLAIKKLNGEMCLMEREFAAEVEALSMAQHANLVPLWGYCIQGNSRLLIYSYMENGSLDDWLHNREDETSSFLDWPTRFKIARGASQGLLYIHDVCKPHIVHRDIKSSNILLDKEFKAYVADFGLSRLILPNKNHVTTELVGTLGYIPPEYGQAWVATLRGDVYSFGVVLLELLTGRRPVSILSTSKELVPWVLEMRSKGNLLEVLDPTLHGTGYEEQMLKVLEVACKCVNCNPCMRPTIREVVSCLDSIGSD

SEQ ID NO: 29300 - protein, 1051 aa, Oryza sativa (indica cultivar-group)
MQPLHFPSYRYSSKLPTISSLSLGLLLLISLASLTSSCTEQEKGSLHQFLAELSQDGNLSMSWRNDRNCCVWEGITCNRNGAVTDISLQSKGLEGHISPSLGNLTSLLRLNLSHNSLSGYLPWELVSSSSISVLDVSFNRLRGELQDPLSPMTAVRPLQVLNISSNSFTGQFPSTTWKAMKNLVALNASNNRFTGQIPDHFCSSSPSLMVLDLCYNLFSGGIPPGIGACSRLNVLKVGQNNLSGTLPDELFNATSLEHLSVPNNGLNGTLDSAHIMKLSNLVTLDLGGNNFNGRIPESIGELKKLEELLLGHNNMYGEVPSTLSNCTNLKTIDIKSNSFSGELSKINFSTLPNLQTLDLLLNNFNGTIPQNIYSCSNLIALRMSSNKFHGQLPKGIGNLKSLSFLSISNNSLTNITDTLQILKNSRSLSTLLMGVNFNGELMPEDETIDGFENLQFVSIDDCSLIGNIPFWLSKLTNLQMLDLSNNQLTGQIPAWINRLNFLFYLDISNNSLTGGIPTALMEIPRLISANSTPYFDPGILQLPIYTGPSLEYRGFRAFPATLNLARNHLMGAIPQEIGQLKMLRTLNISFNSISGEIPQPLCNLTDLQVLDLSNNHLIGTIPSALNNLHFLSKLNVSNNDLEGSIPTGGQFSTFQNSSFVGNSKLCGSNIFRSCDSSKAPSVSRKQHKKKVILAITLSVSVGGIIILLSLSSLLVSLRATKLMRKGELANNRNEETASFNPNSDHSLMVMPQGKGDNNKLTFADIMKTTNNFDKENIIGCGGYGLVYKAELPDGSKLAIKKLNSEMCLMEREFTAEIEALTMAQHDNLVPLWGYCIHGNSRLLIYSYMENGSLDDWLHNRDDDASSFLDWPTRLKIAQGASLGISYIHDVCKPHIVHRDIKSSNILLDKEFKAYIADFGLSRLILPSKTHVTTELVGTLGYIPPEYGQSWIATLRGDIYSFGVVLLELLTGRRPVPLLSTSKELVPWVQEMRSVGKQIKVLDPTVRGMGYDEQMLKVLETACKCVNYNPLMRPTIMEVVASLDSIDADRNT

SEQ ID NO: 29301 - protein, 1047 aa, Oryza sativa (indica cultivar-group)
MQLLHYKKHSNKFPIPVLALALVLLINLASLTSSCTEQDRSSLLKFLRELSQDGGLSASWQDGTDCCKWDGIACSQDGTVTDVSLASRSLQGNISPSLGNLTGLLRLNLSHNMLSGALPQELVSSSSIIVVDVSFNRLNGGLNELPSSTPIRPLQVLNISSNLFTGQFPSSIWDVMKNLVALNVSSNKFTGKIPTRFCDSSSNLSVLELCYNQFSGSIPSGLGNCSMLKVLKAGHNKLSGTLPGELFNDVSLEYLSFPNNNLHGEIDGTQIAKLRNLVTLDLGGNQFIGKIPDSVSQLKRLEELHLDSNMMSGELPGTLGSCTNLSIIDLKHNNFSGDLGKVNFSALHNLKTLDLYFNNFTGTIPESIYSCSNLTALRLSGNHFHGELSPGIINLKYLSFFSLDDNKLTNITKALQILKSCSTITTLLIGHNFRGEVMPQDESIDGFGNLQVLDINSCLLSGKIPLWLSRLTNLEMLLLNGNQLTGPIPRWIDSLNHLFYIDVSDNRLTEEIPITLMNLPMLRSTSDIAHLDPGAFELPVYNGPSFQYRTLTGFPTLLNLSHNNFIGVISPMIGQLEVLVVLDFSFNNLSGQIPQSICNLTSLQVLHLSNNHLTGEIPPGLSNLNFLSAFNISNNDLEGPIPTGGQFDTFSNSSFEGNPKLCDSRFNHHCSSAEASSVSRKEQNKKIVLAISFGVFFGGICILLLVGCFFVSERSKRFITKNSSDNNGDLEAASFNSDSEHSLIMMTQGKGEEINLTFADIVKATNNFDKAHIIGCGGYGLVYKAELPDGSKIAIKKLNSEMCLTEREFSAEVDALSMAQHANLVPFWGYCIQGNLRLLIYSLMENGSLDDWLHNRDDDASSFLDWPTRLKIALGASQGLHYIHDVCKPHIVHRDIKSSNILLDKEFKSYIADFGLSRLVLPNITHVTTELVGTLGYIPPEYGQSWVATLRGDMYSFGVVLLELLTGRRPVPILSTSEELVPWVHKMRSEGKQIEVLDPTFRGTGCEEQMLKVLETACKCVDCNPLKRPTIMEVVTCLDSIGTEIKI

SEQ ID NO: 29302 - protein, 1049 aa, Oryza sativa (indica cultivar-group)
MHPLHSPCKKHSNKFPIPVLALALVMLINLASLTSSCTEQDRSSLLRFLRELSQDGGLAASWQNGTDCCKWDGITCSQDSTVTDVSLASRSLQGHISPSLGNLPGLLRLNLSHNLLSGALPKELLSSSSLIAIDVSFNRLDGDLDELPSSTPARPLQVLNISSNLLAGQFPSSTWAVMKNMVALNVSNNSFSGHIPANFCTNSPYLSVLELSYNQFSGSIPPGFGSCSSLRVLKAGHNNLSGTLPDGIFNATSLECLSFPNNDFQGTLEWANVVKLSKLATLDLGENNFSGNISESIGQLNRLEELHLNNNKMFGSIPSNLSNCTSLKIIDLNNNNFSGELIYVNFSNLPNLKTLDLMRNNFSGEIPESIYTCSNLTALRVSSNKLHGQLSKGLGNLKSLSFLSLAGNCLTNITNALQILSSSSNLTTLLIGHNFMNERMPDGSIDSFENLQVLSLSECSLSGKIPRWLSKLSRLEVLELDNNRLTGPIPDWISSLNFLFYLDISNNSLTGEIPMSLLQMPMLRSDRAAAQLDRRAFQLPIYISASLLQYRKASAFPKVLNLGKNEFTGLIPPEIGLLKVLLSLNLSFNKLYGDIPQSICNLTDLLVLDLSSNNLTGTIPAALNNLNFLSEFNISYNDLEGPIPTGGQLDTFTNSSFYGNPKLCGPMLVRHCSSADGHLISKKQQNKKVILAIVFGVFFGAIVILMLSGYLLWSIRGMSFRTKNRCNNDYTEALSSNISSENLLVMLQQGKEAEDKITFTGIMEATNNFNREHIIGCGGYGLVYRAELPDGSKLAIKKLNGEMCLMEREFSAEVETLSMAQHDNLVPLLGYCIQGNSRLLIYSYMENGSLDDWLHNKDDGTSTILDWPRRLKIAKGASHGLSYIHNICKPRIVHRDIKSSNILLDKEFKAYIADFGLSRLILPNKTHVTTELVGTLGYIPPEYGQAWVATLKGDVYSFGVVLLELLTGRRPVPILSTSKELVPWVQEMISEGKQIEVLDPTLQGTGCEEQMLKVLETACKCVDGNPLMRPTMMEVVTSLDSIDPDLKMQ

SEQ ID NO: 29303 - protein, 1065 aa, Oryza sativa (indica cultivar-group)
MQKQQQLHSSCKKCSNRCFIDFLRFNLAFALLLLLSLASPTSSCTEQERSSLLQFLSSLSSDGGLAVSWWNAADCCKWEGVTCSADGTVTDVSLASKGLEGRISPSLGNLTGLLRLNLSHNSLSGGLPLELMASSSITVLDISFNLLKEEIHELPSSTPARPLQVLNISSNLFTGQFPSATWEMMKNLVMLNASNNSFTGQIPSNFCSRSPSLTVLALCYNHLNGSIPPGFGNCLKLRVLKAGHNNLSGNLPGDLFNATSLEYLSFPNNELNGVINGTLIVNLRNLSTLDLEGNNINGRIPDSIGQLKRLQDLHLGDNNISGELPSALSNCTHLITINLKRNNFSGNLSNVNFSNLSNLKTLDLMDNKFEGTVPESIYSCTNLVALRLSSNNLQGQLSPKISNLKSLTFLSVGCNNLTNITNMLWILKDSRNLTTLLIGTNFYGEAMPEDNSIDGFQNLKVLSIANCSLSGNIPLWLSKLEKLEMLFLLDNRLSGSIPPWIKRLESLFHLDLSNNSLIGGIPASLMEMPMLITKKNTTRLDPRVFELPIYRSAAGFQYRITSAFPKVLNLSNNNFSGVIPQDIGQLKSLDILSLSSNNLSGEIPQQLGNLTNLQVLDLSRNHLTGAIPSALNNLHFLSAFNVSFNDLEGPIPNGVQFSTFTNSSFDENPKLCGHILHRSCRSEQAASISTKNHNKKAIFATAFGVFFGGIVVLLFLAYLLATVKGTDCITNNRSSENADVDATSHKSDSEQSLVIVKGDKNKGDKNKLTFADIVKATNNFDKENIIGCGGYGLVYKADLPDGTKLAIKKLFGEMCLMEREFTAEVEALSMAQHDNLVPLWGYCIQGNSRLLIYSYMENGSLDDWLHNRDDDASTFLDWPKRLKIAPGAGRGLSYIHDACKPHIIHRDIKSSNILLDKEFKAYVADFGLARLILANKTHVTTELVGTLGYIPPEYGQGWVATLKGDIYSFGVVLLELLTGRRPVHILSSSKELVKWVQEMKSEGNQIEVLDPILRGTGYDEQMLKVLETACKCVNCNPCMRPTIKEVVSCLDSIDAKLQMQNSVKT

SEQ ID NO: 29304 - protein, 1051 aa, Oryza sativa (indica cultivar-group)
MEKTMQPLHFSNKNHKNRFHMTYLGHALVLLLFLASPTSSCTEQERNSLVQFLTGLSKDGGLGMSWKNGTDCCAWEGITCNPNRMVTDVFLASRGLEGVISPSLGNLTGLMRLNLSHNSLSGGLPLELVSSSSIVVLDVSFNHMTGGLSDLPSSTPDRPLQVLNISSNLFTGIFSSTTWEVMKSLVALNASTNSFTGNIPTSFCVSAPSFALLELSNNQFSGGIPPGLGNCSKLTFLSTGRNNLSGTLPYELFNITSLKHLSFPNNQLEGSIDGIIKLINLVTLDLGGNKLIGSIPHSIGQLKRLEELHLDNNNMSRELPSTLSDCTNLVTIDLKSNSFSGKLTNVNFSTLPNLKTLDVVWNNFSGTVPESIYSCRNLTALRLSYNGFHVQLSERIENLQYLSFLSIVNISLTNITSTFQVLQSCRNLTSLLIGRNFKQETMPEGVIIDGFENLQVLSLANCMLSGRIPHWLSKFKNLAVLFLFNNQLTGQIPDWISSLNFLFYLDVSNNSLSGELPKALMEMPMFKTDNVEPRVFELPVFTAPLLQYQITSALPKVLNLGINNFTGVIPKEIGQLKALLLLNLSSNKFSGGIPESICNITNLQVLDISSNNLTGPIPAALDKLNFLSAFNVSNNDLEGSVPTVGQLSTFPNSSFDGNPKLCGPMLVHHCGSDKTSYVSKKRHNKKAILALAFGVFFGGITILFLLARLILFLRGKNFMTENRRCRNNGTEETLSNIKSEQTLVVLSQGKGEQTKLTFTDLLKATKNFDKENIIGCGGYGLVYKAELSDGSMVAIKKLNRDMCLMEREFSAEVDALSTAQHDNLVPLWGYCIQGNSMLLIYSYMENGSLDDWLHNRNDDASSFLNWPMRLKIAQGASQGISYIHDVCKPQIVHRDIKCSNILLDKEFKAHIADFGLSRLILSNRTHVTTELVGTFGYIPPEYGQGWVATLRGDMYSFGVVLLELLTGRRPVPILSSSKQLVEWVQEMISEGKYIEVLDPTLRGTGYEKQMVKVLEVACQCVNHNPGMRPTIQEVVSCLDIIGTELQTTKLN

SEQ ID NO: 29305 - protein, 1051 aa, Oryza sativa (indica cultivar-group)
MEKTMQPLQFSSKNYSNRFPITSFGLALALLLFLASPTSSCTEKESNSLIQFLAWLSKDGGLGMSWKNGTDCCAWEGITCNPNRTVNEVFLASRGLEGIISPSVGNLIGLMRLNLSHNSLSGGLPLELVSSSSIMVFDVSFNYLTGDLSDLPSSTHDRPLQVLNISSNLFTGNFPSTTWEVMKSLVALNASNNSFTGKIPTSFCASAPSFALLDLSYNQFSGGIPPGLSNCSTLKLLSSGKNNLTGAIPYEIFDITSLKHLSFPNNQLEGSIDGIIKLINLVTLDLGGNKFIGSIPHSIGQLKRLEEFHLDNNNMSGELPSTLSDCTNLVTIDLKKNNFSGELTKVNFSTLPNLKTLDVVWNKFNGTIPESIYSCSNLTALRLSFNNFRGQLSEKIGNLKSLSFLSLVKNSLANITSTFQMLQSSKNLTTLIIGINFMHETIPLDDSIDGFENLQVLSLYGCSLSGKIPHWLSKLTNLEMLFLHNNQLTGQIPIWISSLNFLFYLDITNNSLSGEIPTALMEMPMLKTENVAPKVFELPIFTSQSLQYRITSAFPKVLNLGINNFAGAIPKEIGQLKALLLLNLSSNKLSGQITESICNLTNLQMLDLSNNNLTGTIPEALNKLHFLSAFNVSNNDLEGLVPTVGQLSTFPSSIFDGNPKLCGPMLANHCSSAQTSYISKKRHIKTAVLAVAFGVFFGGIGILVLLAHLLTLLRGKRFLSKNRRYSNDGTEAPSSNLNSEQPLVMVPQGKGEQTKLTFTDLLKATKIFDKENIIGCGGYGLVYKAELSDGSMLAIKKLNSDMCLMEREFSAEVDALSMAQHDNLVPLWGYCIQGNSRFLIYSYMENGSLDDWLHNRDNDASSFLDWPMRLKIAQGASQGLAYIHDVCKPNIVHRDIKSSNILLDKEFKAYVADFGLSRLILPNKTHVTTELVGTLGYVPPEYGQRWVATLRGDMYSFGVVLLELLTGRRPIPVLSASKELIEWVQEMRSKGKQIEVLDPTLRGTGHEEQMLKVLEVACQCVNHNPGMRLTIREVVSCLDIIGTELQTTELN

SEQ ID NO: 29306 - protein, 425 aa, Lactobacillus curvatus
CKNLALNIESRGYTVAIYNRTGAKTEAVMQDHSEKKLVPSYTIEEFVQSLEKPRRIILMVKAGAGTDAVINELLPLLDKGDILIDGGNTFFGDTIRRNAELDKSGINFIGMGVSGGELGALEGPSMMPGGQKEAYELVAPILEQMSAKAEDGQPCVTYIGPNGAGHYVKMVHNGIEYGDMELISESYNLLRNVVGLSVEEIADVFKEWNHGELDSYLMEITADILTRKDDLETDKPIVDVILDAAGNKGTGKWSSQSALELGVPQSLITESVYARYISAMKDERVAASKILPAPTVAKLTEDKKELIEKIRQALYFSKIMSYAQGFEQMRVASDQYDWSLNYGEIAKIWREGCIIRARFLQKITDAFDKKADLNNLLLDDYFLDITKNYQGAVRDVAAMAIQQGVPAPGFSAAITYFDSYRSEVL

SEQ ID NO: 29307 - protein, 197 aa, Brassica napus
MSASRFAKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVPITTAQGEELRKLIDAPTYIECSSKSQENVKAVFDAAIRVVLQPPKQKKKKSKTQKACSIQ

SEQ ID NO: 29308 - protein, 197 aa, Brassica napus
MSASRFVKCVTVGDGAVGKTCLLISYTSNTFPTDYVPTVFDNFSANVVVNGATVNLGLWDTAGQEDYNRLRPLSYRGADVFILAFSLISKASYENVSKKWIPELKHYAPGVPIILVGSKLDLRDDKQFFVDHPGAVAITTAQGEELRKLIDAPTYIECSSKSQENVKAVFDAAIRVVLQPPKQKKKKSKAQKACSIQ

SEQ ID NO: 29309 - protein, 181 aa, Fagus sylvatica
MASSMISSATVATVSRATPAQATMVAPFTGLKSTAAFPATQKSNNDITSLASNGGRVQCMKVWPPLGLQKFETLSYLPPLSLESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPK

SEQ ID NO: 29310 - protein, 418 aa, Oryza sativa (japonica cultivar-group)
MMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 29311 - protein, 327 aa, Oryza sativa (japonica cultivar-group)
MPPNPTPPRRATTTTTRATSGVRRGEEEQGGMAVSASAGEEEEAFEEVDPTGRFGRYADVLGLGSVKKVYRGFDQEEGIEVAWNRVRLRALADRDPAMVERLHAEVRLLRSLHHEHIIGFHKVWLDRDAGVLNFITEVCTSGSLREYRDRHRHVSVKALKKWARQILLGLDHLHTHDPCIIHRDLNCSNVFINGNTGQVKIGDLGLAAIVDKTHVAHTILGTPEFMAPELYTETYTESVDIYSYGMCVLEMVTREMPYAECDSVVQIYHSVTRGVPPAALKRIRDPELRAFIERCIGQPRNRPSAAELLRDPFFAGIDDDDSTGTLG

SEQ ID NO: 29312 - protein, 366 aa, Oryza sativa (japonica cultivar-group)
MAAVNTVSSLPCSKAGAAVAGGAPRPSTCSVFYPPRCWSKRSSGNGVRAQASTTETTAAPAAEVTTKVEKVSKKQVDGVVTNKYRPKEPYTGRCLLNTRITGDDAPGETWHMVFSTDGEIPYREGQSIGVIPDGIDKNGKPHKLRLYSIASSAIGDFADSKTVSLCVKRLVYTNDQGEIVKGVCSNFLCDLKPGSDVKITGPVGKEMLMPKDPNATIIMLGTGTGIAPFRSFLWKMFFEEHDDYKFNGLAWLFLGVPTSSTLLYREEFERMKEIAPERFRLDFAVSREQTNAAGEKMYIQTRMAEYKDELWELLKKDNTYVYMCGLKGMEKGIDDIMIDLAAKDGIDWLDYKKQLKKSEQWNVEVY

SEQ ID NO: 29313 - protein, 441 aa, Oryza sativa (japonica cultivar-group)
MNIILELNHLKQVSLPTRPVVCKGLFIVIALIVLRAIVSPFLAVNPSEKEGFYDPTADLLPGIRRGKFIEVPQIIWGLNNQKIAFARACLTARFLNRSLLMPSLSASLFYKEVDLLRPITFDKVFDFTKFNARCQGFVRLARYSEVSNQTKPFKLQKGSGRRWTVEKDLDQLLQYRRGEADDSEVIEIIGKHPFLWPDHWPVKDYARIFDCLALVPEIETEVVKAISKIREAGIKARHEAGISHNKHVKDGTMNPPVPYIAVHMRIEKDWMIHCKKWEQRSNSKEICSSKEEIIHKVSQITDLRRPVVVYLAVADSLLEDDSITSGWRVGMVAFEKKRLGVTDIYNRQPYLIKSAIDFEVCARADVFVGNSFSTFSNLVVLSRTQRLYNMGEASSCGENVGLSSYAYNVIGDDGGPQRWMTDMSDTSLQNLSYGTNNISCH

SEQ ID NO: 29314 - protein, 349 aa, Oryza sativa (japonica cultivar-group)
MGVDYYKLLQVERGATEEELKKAYRKLAMKWHPDKNPNSKKEAEAKFKQISEAYEVLSDSQKRAVYDQYGEEGLKGQVPPPGAGGPGGSSYYGGDGSTFRFNPRSADDIFAEFFGFSSPFSSMGGMGGMGGGVDRGMRGSKFGMYDNDIFGSFSQFPGEASMHAPQRPQKAAPIENRLPCNLADLYKGTTKKMKISREILDSSGRTMVVEEILTIDIKPGWKKGTKITFPEKGNESPHVIPADIVFVIDEKPHDLFTREGNDLVMTQKISLAEALTGCTVQVTALDGRNLTVPINNVVYPGYEEVVLREGMPIPKDPSKKGNLRIKFNIKFPSRLTSEQKSEIKRLLAS

SEQ ID NO: 29315 - protein, 406 aa, Oryza sativa (japonica cultivar-group)
MIRKKASPHCLHDVSGSCPHLSILLHSSRRPESAPVPCLLPMEAKIPLLTPHTMGRFHLAHRVVHAPLTRSRCYNNLPQEHVQLYYSQRATNGGLLIAEATGVSETAQGYPNTPGIWTKEQVEAWRTVVDAVHQKGGVFFCQIWHVGRASTNDYQPNGQTPIPCTDKKITPTVLKDGTVEEFSAPRRLREDEIPQIVDDFRIAARNCIEAGFDGVEIHCAFGYLIEQFMKDGVNDRTDKYGGSIANRCRFALEVIQAAIDEIGSDRVGVRLSPYSNCLDCWDSDPDALGLYMIQAMSKLGVLYCSMVEPEVVKVDGKVQIPYKLWHFRKVFAGTFIVAGGYNREEGNRAVSQGYTDLVAYGKWFLANPDLPRRFELNAPLNKYDRSTFYTSDPVIGYTDYPFLSPL

SEQ ID NO: 29316 - protein, 491 aa, Oryza sativa (japonica cultivar-group)
MAPAMVAAMGEKPKPAVVLGGMVSGLREVYESGRTKDLEWRQSQLKALIRLLTDKEEEIFAVLHDDLGKHRGESFRDELGILVKSIKYTLQNLKKWAASERAESPLVAFPATAMVVPEPLGVVLVFSCWNLPLGLALEPLSGAIAAGNAVVLKPSELAPSTAAFLAANIPRYLDSRAVKVVLGGPNVGEELMEHRWDKVLFTGSARIGRIIMAKAVKHLTPVALELGSKCPCIVDWLDSKRDRQIAVNRIIGAKWSTCAGQACIAIDHVIVEERFAPILIELLKSTLKRFMAKPGGMARILNAKHFERLSGYLEDNRVAASVVHGGYMDPKKLNIEPTLLLNPPADSDVMTEEVFGPILPIITVKKIEDCIAYLKSKPKPIAMYAFTNNERLKRRIVEETSSGSVTFNDAVVQYALESVPFGGVGHSGFGQYHGKYSFELFSHKKAVFKRSFLIEFMFRYPPWDERKIGTLRHVFSYNYFLLFFNLLGFRR

SEQ ID NO: 29317 - protein, 167 aa, Oryza sativa (japonica cultivar-group)
MAVDRGLLLLVVSAAVLVGLASASPFISDSVFLGSVGSTGRSLLQAKKNCPVNFEFQNYTIITSKCKGPRFPAKQCCDAFKEFACPFNEYINDESNDCASTMFSYINLYGKYPPGLFANECREGKLGLSCEGVSQKDSVVSSAGQQAQSSLLAFIMLTFGLAALWFH

SEQ ID NO: 29318 - protein, 168 aa, Oryza sativa (japonica cultivar-group)
MAALPLATAELCDANAHLIMNGELRALQPVFQVYGRRQVFAGPIVTLKVYEDNVLVREFLEEKGQGRVLVVDGGGSLRCAILGGNPVQQAQNNGWAGIVVNGCIRDVDEINGCDIGVRALNSHPMKANKKGIGEKHVPVTIAGTRICDGEWLYADTDGILISRTELTV

SEQ ID NO: 29319 - protein, 339 aa, Oryza sativa (japonica cultivar-group)
MSSNNSMEANNGDDEKKQEQVVCVTGAGGFIGSWVVKELLLRGYRVRGTARDPRKNAHLLDLEGAKERLTLCRADVLDFASLRAAFAGCHGVFHIASPVSKDPNLVPVAIEGTRNVMKAAADMGVRRVVFTSSYGAVHMNPNRSPDAVLDESCWSDPEFCQREDIYCYAKMMAEKTATEEASRRRLQLAVVVPCVTVGPILQPSVNFSCHHVVRYLTGAAATYPNAVAAYADVRDVARAHVLVYEHHGARGRYLCIGTVIHRAELLRMLKELFPQYPVTSKCEDEGNQMVKPYKFSNQRLRDLGLEFTPLRKSLHEAIECLQRKGHLPVVTVAQQRACL

SEQ ID NO: 29320 - protein, 427 aa, Oryza sativa (japonica cultivar-group)
MRCLPFLHGDSKEEDPVNKSASVRSLSTTSTERDVRSGSDFNSLNVSDMSAESIRRTQYPSFTDRPSNLRVFSFSELKNATRNFSRSLMVGEGGFGCVYRGVIKNSDEPTERTEIAVKQLNRKGLQGQKEWLTELNVLGIVEHPNLVKLIGYCAEDDERGVQRLLVYEYMPNGSVDDHLSSRSNSTLSWPMRLKVALDAARGLKYLHEEMEFQVIFRDLKTSNILLDENWNAKLSDFGLARHGPSEGLTHVSTAVVGTLGYAAPEYMQTGRLTAKSDIWGYGVLLYELITGRRPIDRNRPKGEQKLLDWVKPYISDIKRFPIIIDPRLEGHYNLKSMTKLASVANRCLVRLPKSRPKMSEVYEMVQKIVASIETGTPQPPLHYHGSVSEPGSKRPKKGSLKRRFQEFKFGCRQIVWRSWKPEIIKTC

SEQ ID NO: 29321 - protein, 343 aa, Oryza sativa (japonica cultivar-group)
MANLGGGAMPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 29322 - protein, 352 aa, Bipolaris oryzae
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRISVEDALKHPYLEPYHDPDDEPGADPIPEEFFDFDKNKDNLTKEQLKLLIYQEIMR

SEQ ID NO: 29323 - protein, 277 aa, Arabidopsis thaliana
MKYIRSNSLKRLFSFKRRSFDSDSSENSSPLAASSTKCVEGFQETDQFQRPKWKCFSFQEIYDATNGFSSENLVGRGGFAEVYKGILGKNGEEIAVKRITRGGRDDERREKEFLMEIGTIGHVSHPNVLSLLGCCIDNGLYLVFIFSSRGSLASLLHDLNQAPLEWETRYKIAIGTAKGLHYLHKGCQRRIIHRDIKSSNVLLNQDFEPQISDFGLAKWLPSQWSHHSIAPIEGTFGHLAPEYYTHGIVDEKTDVFAFGVFLLELISGKTDNQRWRD

SEQ ID NO: 29324 - protein, 250 aa, Arabidopsis thaliana
MEFSPRFVIAFRGTVTKVDSISRDIEHDIHVIRNGLHTTTRFEIAIQAVRNIVASVGGSSVWLAGHSLGASMALLTGKTIARTGFFPECFAFNPPFLSAPIEKIKDKRIKHGIRIAGSVITAGLALAKKATQHYSQNDRALPAPPDPFEALSDWFPRLYVNPGDHLCSEYVGYFEHRNKMEEIGIGFVERVATQHSLGGMLLGGQEPVHLIPSSVLTVNLSSSRDFKQAHGIHQWWREDNKFETKVYQYK

SEQ ID NO: 29325 - protein, 188 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYTGVLKPEYYM

SEQ ID NO: 29326 - protein, 381 aa, Arabidopsis thaliana
MDLVRLRDIGSISPQRRRKWLILLAVFGVSGYGVYRVYNSQYIAKKTKRLMKLFSGIVSFAEMVIDSAETISIVSRDLKEFLESNSHEIPNSLKQLSKITKSKEFTDSLARVSGAVAIGVFRGYNSDPNVEKESNLSVVDRVFSEEGAGFVSVVVGSFAKNLVLGFYSGEIEIGSDDSLKPRWMNLLSDDKCRELLADCIERFTSSAVSVYIDKTVGVNTYDQIFAGLTNPKHRDSARDVLVSVCNGALETFMRTSHDVFTSSGEKTDSSLRKSENRENGWAEALSTTLAVPSNRKFMFDVTGRVTLETMRSILEFVILKTSQSFKRSLDVIHEEVTERGRQVVGYVGAKSSVIITVCLAVYFHIFNRFVRGPPVCLSQQF

SEQ ID NO: 29327 - protein, 507 aa, Arabidopsis thaliana
MFRLLRSICKTCPTEESLRLFTGYLQFLTEIPKTWVLKYIEKMDHVSSLPEGVLCNIFSFLTTKEAALTSILCKRWRNLLAFVPNLVIDDSVFLHPEEGKEERYEIQQSFMEFVDRVLALQGNSPIKKFSLKFRTDFASHRVNAWISNVLARGVSELDVLVILYGAEFLPLSPKCFKSRNLVTLKINSLGIDWLAGDIFLPMLKTLVLHSVKLCVDKFFFRALPALEELVLFAVSWRDRDVTVSNASIKTLTIKFNYYLGTLSLDTPSLVSFCFSDHVAKDYPLAKMEKLSEARISLLVTEYQIERARAPNIYWVEDDVVLRLVNVGKLMKGIRNVQYLNLSPNTLEVLSKCCESMPLFNNLKSLTIESNERRGWQAMPVLLRNCPHLETLVLEGLLHHVTEKCRNACDCVSQEEKGRSLTSCQVKVLEIKGFQGTTKEMHTIKHFLEHFPCLREIKIHMEENGPTQLRVPEVSQYIAEMMEHYEKSSSCNVQLLVGGYLCKKWTTQ

SEQ ID NO: 29328 - protein, 243 aa, Arabidopsis thaliana
DPEKDMIKPAIQGVINVLKSCLKSKSVKRVIYTSSAAAVSINNLSGTGIVMNEENWTDVEFLTEEKPFNWGYPISKVLAEKTAWEFAKENKINLVTVIPALIAGNSLLSDPPSSLSLSMSFITGKEMHVTGLKEMQKLSGSISFVHVDDLARAHLFLAEKETASGRYICCAYNTSVPEIADFLIQRYPKYNVLSEFEEGLSIPKLTLSSQKLINEGFRFEYGINEMYDQMIEYFESKGLIKAK

SEQ ID NO: 29329 - protein, 337 aa, Arabidopsis thaliana
MKLVNNTVCQMIMGRSCSEENGEAERVRGLVTKTDALTKKFILAGILRKPLQKIGISLFKKELMDASCKFNEVLEKILVEYKEKVEEHHQGTDMMDKLLEVYGDEKAEYKITRDHIKSLFVDLFFAGTDTWTHAIQWIMAEIINNSYILERLREEIDSVVGKTRLIQETDLPNLPCLQATVKEGLRLHPPVPLVLRTFKEGCTIGGFYVPEKTTLVVNGYAMMRDPEYWEDPQEFKPERFLASSRSSQNDEIRDELLKYLPFGNGRRACPGANLADISVGTAIGVMVQCFDWEIKGDKINMDEAPGKITLTMAHPLNCTLVPRTLIPVTSTVQIPSS

SEQ ID NO: 29330 - protein, 381 aa, Arabidopsis thaliana
MTCCFSCLNPRTKDIRVDIDNARCNSRYQTDSSVHGSDTTGTESISGILVNGKVNSPIPSGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 29331 - protein, 414 aa, Arabidopsis thaliana
MERIIGGKYKLGRKIGGGSFGEIFLAAHIDTFEIVAVKIENSKTKHPQLLYEAKLYRTLEGGSGVPRIRWFGVDGTENALVMDLLGPSLEDLFVYCGRKFSPKTVLMLADQMLTRIEYVHSKGYLHRDIKPDNFLMGLGRKANQVYLIDFGLAKRYRDANTNRHIPYRENKNLTGTARYASCNTHLGIEQGRRDDLESLGYVLLYFLRGSLPWQGLKAVDKKQKYDKICEKKISTPIEVLCKSHPVEFASYFHYCHTLTFDQRPDYGFLKRLFRDLFSREGYEFDYIYDWTIIKYQQSQKTRSQSQAVPGSSNARAIPMDTSNHRGGTKISHEAQVSDRVRPANASGPSPQINTAVGRSLGFDQVHKNMNMPSSTSLSPAGTSKRNVRPETSNSGFGSGNKTGGWTSPFMSPGK

SEQ ID NO: 29332 - protein, 290 aa, Arabidopsis thaliana
MPRYDDRYGNTRLYVGRLSSRTRTRDLERLFSRYGRVRDVDMKRDYAFVVFGDPRDADDARHYLDGRDFDGSRITVEFSRGAPRGSRDFDSRGPPPGAGRCFNCGVDGHWARDCTAGDWKNKCYRCGERGHIERNCKNSPKKLRRSGSYSRSPVRSRSPRRRRSPSRSLSRSRSYSRSRSPVRRRERSVEERSRSPKRMDDSLSPRARDRSPVLDDEGSPKIIDGSPPPSPKLQKEVGSDRDGGSPQDNGRNSVVSPVVGAGGDSSKEDRSPVDDDYEPNRTSPRGSESP

SEQ ID NO: 29333 - protein, 386 aa, Arabidopsis thaliana
MDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 29334 - protein, 323 aa, Oryza sativa (japonica cultivar-group)
MEAEAAAKRARESGDAAAAGAGEQAGISAVIPGWFSEISPMWPGEAHSLKVEKVLFQGKSDYQNVMVFQSSTYGKVLVLDGVIQVTERDECAYQEMITHLPLCSIKDPKKVLVIGGGDGGVLREVSRHSSVEQIDICEIDKMVVDVSKQFFPHLAVGFEDPRVSLHIGDGVAFLKNAPEGTYDAVIVDSSDPIGPAQELFEKPFFQSVARALRPGGVVCTQAESIWLHMHIIEDIVANCRQVFKGSVNYAWTTVPTYPSGVIGFMLCSTEGPTVDFQHPIFNIEDNEFSTKSKGPLKFYNSEIHSASFCLPSFAKRVIGSKAN

SEQ ID NO: 29335 - protein, 481 aa, Oryza sativa (japonica cultivar-group)
MTSAVLAGRNEVHHHHHHHWADARVPLMPKHATNPNPRRHHRPSPSIPPPPPPQRPPAATVAPSVPDPSPSGHVTIRPSELSRREAQVLRARLTGELSRVRALLSDIDGWEARRRRPAEPPRQRGHVSPPPALQAAMRKRCTQILTRLRKQKISVWFNSPVDVERLKLHDYHAIIRNPMDLGTVKENLAFGRYPSHEAFATDVRLTFSNALRYNPADHHVHRYASNLLATFEGLYKEALSWFEQECQRLEPPMPLALPPPPQPPVPMPMQAPPRIGGGGRRPKPKAREPNKREMSDEEKHKLRVEIGNLPEEKMGNVLQIVQKRNTDPALMGEVVELDFDEMDVETLWELDRFVVNCKKALSKSRRTVAMNGDAVDATAIVPTEDDTVQVNVHHQPSVVEIGDSENDTPEKRVSEVDMVDEYVDIGDEMPTANYQSVEIERDAQVASSSSGSDSGSSASSDSDSRSSGDSDSDGDDAQSPD

SEQ ID NO: 29336 - protein, 491 aa, Thalictrum flavum subsp. glaucum
MEVLSAAMVSLFFIFLFIFFILCDSRNKDLPPGPRPSPIVGNLLQLGEKPHAEFAKLAEKYGELFTLKLGSQTVVVASSPAAAAEILKTRDKILSGRYVFQSFRVYEHVLNSIVWSECNENWKLLRKVCRTELFSPKMIESQAYIREAKALDMVRFLRKKENQEVKIVEVVFNTLVNIFGNLIFSKDVFDLEDPTGGSAELKEHLWKLLDMGNSTNPADYFPIMGKFDLFGQRREVAKVLKQIYDVWGVMLKERRSITGHRENDFANVLLNAGLDDQKINALLMELFGAGTETTASTIEWAITELTNNLRVISKLRAELINVVGHKTVKESNIPHLPYLQAIVKETLRLHPPTPLLLPRRALETCKVMNYTIPKECQIMVNAWAIGRDPKTWDDPLTFKPERFMNSTVDYKGNDFELIPFGGGRRICPGLPLASQFLSLIVATLVQNFDWSFPQGMTPNEVPMDEKFGLPLQKDPPLLIVLKARTSMKLQD

SEQ ID NO: 29337 - protein, 492 aa, Thalictrum flavum subsp. glaucum
MELVSLWLVSATLALVVAITILIPMVTSSSSFSQMKWPTGPNKLPIIGNLHQLGGDVLHVALAKLAQVHGSVMTVWIGNWRPIIVISDIDKAWEVLVNKSSDYGARDMPEITKIASASWHTISTSDAGAFWQTVRKGLQSGAMGPLNIAAQSQFQERDMKRLIQALRDEAAQNNNIVKPLDHIKKNTVRLLTRLIFGQTFDDDKFVESMHFEIDDIIRISGYARLAEAFYYAKYLPSHKKAEREAYLVKCRVEDLVSPLLSSNPPTNSYLYFLLSQRFSEEVIIFCIFELYLLGVDSTSSTTTWALAYLIREQAIQEKLYQDTRMTLGDVDLVKIEDVSKLKYLQAVVKETMRMKPIAPLAIPHKTAKDTTLMGSKVAKGTRIMVNLYALHHNQNIWTNPYKFMPERFLQGEDGSASNKAMEQSFLPFSAGMRICAGMDLGKLQFAFALANLVNAFKWSCVEEGKFPDMSEELSFVLLMKTPLEAKITARKF

SEQ ID NO: 29338 - protein, 430 aa, Heterocapsa triquetra
MIKSLFAREILDSRGNPTVEVDLVTESGISVRAAVPSGASTGIHEACELRDGDKGRYLGKGVKKAVEAVNTVLASALKGADVSEQKALDAKMCELDGTPNKGKLGANAILGVSLAAAKAAAEAKGVPLYKHFGDLAGNPGPVVLPVPCFNVVNGGSHAGNKLAFQEYFIIPVGAETFTEAMRIGAECYHTLKGIIKKKYGGDATLIGDEGGFAPPCDAREGVELVMEAIEKAGYKDKCKIGMDVAASEFKVEGQDCYDLGTWYPDGEKDAPGLKMTGAELADFYAKLCQDFPIITIEDPFDQDDWASWKLFTEKVGGPCQVVGDDLTVTNVTRVKKAIDDKACNALLLKVNQIGSVTESIDAVKLCKQSGWGVMTSHRSGETEDVTIADLAVGLCTGQIKTGAPCRSERNAKYNQLMRIEEELGDKAVYA

SEQ ID NO: 29339 - protein, 101 aa, Bacillus cereus ATCC 10987
MKPNFSKGLLPAVVIEEDTKEVLMLAYMNEEAYEKTIETKRTWFYSRSRRSLWNKGETSGNVQHVQSLYLDCDQDSIVVVVKQVGPACHTGEKTCFHYKII

SEQ ID NO: 29340 - protein, 166 aa, Arachis hypogaea
MSDQTRTGYGGGGSYGSSYGGGGTYGSSYGTSYDPSTNQPIRQAIKFMTASTIGVSFLILSGLILTGTVIGLIIATPLLVIFSPILVPAAITLALAAGGFLFSGGCGVAAIAALSWLYSYVTGKHPAGSDRLDYAKGVIADKARDVKDRAKDYAGAGRAQEGTPGY

SEQ ID NO: 29341 - protein, 494 aa, Sorghum bicolor
MAAADVPRPSFIGGDWREPCLPVCQPSTEATIGDIPAGTAEDVEMPVARGRVSDGGALVACLWGRASQLSHTIAAKIKDRKSESLALLETLDSGKPLDEASADMDDVAACFEYYADLAEALDGKQRSPISLPMENFKSYVLKEPLGVVGLITPWNYPLLMATWKVAPALAAGCTAVLKPSELASVSCLELGAICMEIGLPPGVFNVITGLGLKLVLHYPHIPCGIRLLLLGSTETGKRIMTSAAQMVKPVSLELGGKSPLIVFDDIRDIDKAVEWTMFGILPNAGQVCSAASRLLLHEKMAKKFLDRLVHGAKNIKVSDPLEEGGRLGSVVSEGQYEKIKKFISTARSEGATILYGGARPQHLKRGFFLEPTIITDVSTSMQIWREEVFGPVICVKEFRRESEAVELANDTQYGLAGAVISSDQERCRAISKALQSAIDNCSQPCFVQAPWGGNKRMFGRELGEWGLDNYMTVKQVTKYCSDEPWGWYQPPSKL

SEQ ID NO: 29342 - protein, 401 aa, Oryza sativa (japonica cultivar-group)
MAPNAAVLVRPHIAGVHHLPTGRRLPRLAPPQAVSPPFSRQKGSVVAASGRVWASASGSFEKDRIGDDDVLASPQIVEESKVDLLKILKSANTIIPHVVLGSTILALVYPPSFTWFTTRYYAPALGFLMFAVGVNSSVKDFIEAIQRPDAIAAGYVGQFIIKPFLGFLFGTLAVTIFNLPTALGAGIMLVSCVSGAQLSNYATFLTDPHMAPLSIVMTSLSTATAVFVTPTLSYFLIGKKLPVDVKGMMSSIVQIVVAPIAAGLLLNRYLPRLCSAIQPFLPPLSVFVTALCVGSPLAINIKAVLSPFGLATVLLLFAFHTSSFIAGYHLAGTWFRESADVKALQRTVSFETGMQSSLLALALANRFFPDPLVGVPPAISVVLMSLMGFALVMVWSKRTKE

SEQ ID NO: 29343 - protein, 427 aa, Oryza sativa (japonica cultivar-group)
MAMDMAAAAARVGLVDFACLRPPPRLRIPVAGLLEHFKLIGCFDDGSVEFMTKVIEASGMGNETYFPPSLHHIPPAATHGEAIREAHMLFFPALDDLFAKTGVPPSSVGAVVVNCSGFCAAPSLSAIIANRYGMPSDVRTCNLSGMGCAAGAIGVDVAAGLLRAHAAMSYAVVVSAEIVTVGWYSGKDKSKLLLNCYFRTGCSAALVTTKRGGGGVKYRLVSVTRTNQTANDRSYRSGYRDEDDEGITGFTLGHGVGRMVSELLRAHLLTLSLSILPWREKLRYVAALLRHRRHDKKAGSGGGIPMPDFRAAAEHFCLPSSGRPMIWRLGQGLGLGEGEMEAALMAFHRFGNQSAASLWYQLAYMEAKGRVRRGDTVWQLAVGSGLKANSLVWERVADDDHFATERHGRTTLGPWADCIHKYPVTEG

SEQ ID NO: 29344 - protein, 483 aa, Oryza sativa (japonica cultivar-group)
MAHRDHLLAAAHGALAAATLVACVLAEAAVLALRRGDGAAGMLCYYLVPVSAMLLLYRSRRRAAAARVGLVDFACLRPPPRLRIPVAGLLEHFKLIGCFDDGSVEFMTKVIEASGMGNETYFPPSLHHIPPAATHGEAIREAHMLFFPALDDLFAKTGVPPSSVGAVVVNCSGFCAAPSLSAIIANRYGMPSDVRTCNLSGMGCAAGAIGVDVAAGLLRAHAAMSYAVVVSAEIVTVGWYSGKDKSKLLLNCYFRTGCSAALVTTKRGGGGVKYRLVSVTRTNQTANDRSYRSGYRDEDDEGITGFTLGHGVGRMVSELLRAHLLTLSLSILPWREKLRYVAALLRHRRHDKKAGSGGGIPMPDFRAAAEHFCLPSSGRPMIWRLGQGLGLGEGEMEAALMAFHRFGNQSAASLWYQLAYMEAKGRVRRGDTVWQLAVGSGLKANSLVWERVADDDHFATERHGRTTLGPWADCIHKYPVTEG

SEQ ID NO: 29345 - protein, 401 aa, Oryza sativa (japonica cultivar-group)
MASKRSVGTLTESDLKGKKVFLRADLNVPLDDSQKITDDTRIRASVPTIKFLMGKGAKVILASHLGRPKGVTPKYSLKPLVPRLSELLGVDVVMANDCIGEEVQKLAATLPDGGVLLLENVRFYKEEEKNDPEFANKLASVADLYVNDAFGTAHRAHASTEGVTKYLRPSVAGFLMQKELDYLVGAVANPKKPFAAIVGGSKVSTKIGVIESLLAKVDILILGGGMIYTFYKAQGYAVGKSLVEEDKLELATSLIEKAKSKGVSLLLPTDIVVADKFAADAESKTVPASAIPDGWMGLDIGPDSIKTFSETLDTTKTVIWNGPMGVFEFEKFAAGTDAIAKKLADITAKGVTTIIGGGDSVAAVEKAGLADKMSHISTGGGASLELLEGKTLPGVLALNDA

SEQ ID NO: 29346 - protein, 449 aa, Oryza sativa (japonica cultivar-group)
MSRATRVAGRLMPEISLLRRGRKSAARGGDDAEVEVSVPANFVCPISLEMMRDPVTAPTGITYDRESVEGWLARGHDTCPVTGRPVRLADLVPNHATRRMIQDWCVANRARGVERVPTPRVPVGEDDAEEVVAGVSAAARRGDAAACGAAAATARALGRESERNRRCLAGAGAAHALSSAFGLLAGEEPVVEGAVAGALGEILAALTVFFPLDEECRSCIASPPSLKSLASLLSHGGELAARVSAAVVLRELASSGDRHALEAIARAHGMCDALVGLVTSPVSSQATKAALVTAYYLVSSGDRAAARFAELGVVPAAVELLVDADKGTSEKALAVLDAALCADAGVESARAHALTVPVLVKKMFRVSDMATDFAVSALWRLCRAGAGAAPCRAEALRVGAFQKLLLLLQVGCAGVTKERASELLKMLNGSRGSVECIETVDFKGLKRPF

SEQ ID NO: 29347 - protein, 508 aa, Oryza sativa (japonica cultivar-group)
METAELCCLLALLPLVYCLLTLFHGSRESDLRLPPGPWRLPLIGSLHHLFGRTLPHRALRDLARLHGPLMLLSFGQAAPVVIASTAIAAREIMRTHDDNFSTRPLSTVLKVCTRYGAGMTFVPYGEHWLQVRKICSLELLSPRRILKFRSIREEEVARLVLAIASSSTPTPTPPAPVNLSKLLSNYMTDATVHIIMGQCFRDRDTLVRYVDEAVRLASSLTMADLFPSWRLPRVMCATTLHRAEVFVESVMEFMDRVISEHLEKRSCQGGDREEDLIDVLLRLQAEGNLEFELSTSIIKAIIFELLAGGSEAPITTLQWAMAELMRNPDVMSRAQAEVREAYKEKMKVTEEGLTNLPYLHCIIKETLRLHTPGPFVLPRKCQEQCQILSYDVPKRATVVVNIWAICRDAEIWDEPEKFMPDRFEGSAIEHKGNHFEFIPFGAGRRICPGMNFALANMELALASLLFYFDWSLPEDVLPGDLDMTETMGLTARRKEDLYVCAIPFVQLP

SEQ ID NO: 29348 - protein, 342 aa, Oryza sativa (japonica cultivar-group)
MGVVGWRVRSMVQHLGWNCRRGLSSAAVQSQLENVGFIGLGNMGAHMARNLVMAGYKVTVHDVNENTMKKFSDDGIPTKLSPLEVSKSSDVVITMLPSSAHVLDVYNGRNGLLANGGCLGPWLYIDSSTVDPQTSRKISMDISRCTLKEKKAYAEKPMMLDAPVSGGVPAAEAGKLTFMVGGSEEAYLAAKPLLLSMGKKTIYCGGAGNGSVAKICNNMAMAISMLGVSEAFALGQNLGIKASVLTDIFNCSSARCWSSDTYNPVPGVMMDVPSSRNYDGGFTSKLMTKDLDLAMASASGVGFNCPFGSQALEIYRKLCADGCELKDFSCAFRHNYAGKDEN

SEQ ID NO: 29349 - protein, 490 aa, Oryza sativa (japonica cultivar-group)
MEDGVSTYTVDEALISMGFGKFQAFVLAYSGMAKISEAMEMMLLSFVGQSVQAEWELSAQAESLITSVVFVGMLVGAYSWGIVSDNYGRRVGFNFTALVTGGAGLLSAFAPNYLSLIVLRFMVGVGLGGGPVLSSWFLEFIPAPNRGTWMVIFSAFWTIGTIMEASLAWAVMPSLGWRWLLAFSSLPSFALLLFYPLTLESPRYLCMKGRTADAVQVLETMARLNRVALPSGHLMSGHRMELHELTDSSETSQLLSAKKTNPAAHSSKTEIGGRNAILKLLSPNLIRSSLLLWTVFLGHAFLYYGLVLLTSELSHGNKICGSEGIVTMQTNHSNDANLYRNVFITSFGEVPGLILSAAIVDKIGRKLSMSSMLYISCLCIAPLMVPQTESLTTIFLFGARICISASFIVLHIYAPEIYPTAVRATGVGFASSIARFGGILCPLVAVGLVHACHQTAAILIFITVMLVSGVAVSYFPLETSGRKLSDHIAA

SEQ ID NO: 29350 - protein, 226 aa, Oryza sativa (japonica cultivar-group)
MGSDVIQAKLVVYLGISNILESTIGAAFFSQVLIMDEATVKLDIWDTAGQERYHSLAPMYYRGAAAAVVVYDISSTDSYIRARKWVDELQRQGNPHLVMALVGNKVDLEEKRQVGTQEAMEYAERNGLFFIETSAKTSQNVTELFYELGKHYRNNSVGFNSLMHRRLIITSTCCCQLIGWSKCDLTALPGWFSTTAGAAATTAAAGHGGSVAPADAPLPTPEIRHP

SEQ ID NO: 29351 - protein, 315 aa, Oryza sativa (japonica cultivar-group)
MSSWLFRRSGPSGFSWASTADQVTAGLSAAGLTAIVTGASSGIGAETARVLAIRGAHVVMAVRNLAAAQPVRDAILADAPAASLDLMELDLASMDSVRAFASDFAAKGLPLNILINNAGVMATPFSLSKDGIELQFATNHVGHFLLTHLLLETMKKTSRESNVEGRIVNVSSEGHRFAYREGIRFAKINDESEYNSIGAYGQSKLANILHANELARRFKDEGVNITANSLHPGSIITNLLRHHSILDVLHRTLGKLVLKNAQQGAATTCYVALHPQVKGVSGKYFSDSNVNEASEKGNDMELAKRLWEYSIELIT

SEQ ID NO: 29352 - protein, 198 aa, Oryza sativa (japonica cultivar-group)
MFAHRLVDLLHSLLYLPRRLTISDITAHRWSKRTAVASALLSPLLLAAITAPHHSNHPPVLLTAAAAAATTDADSPPMSRSSCLPVLWSYVLTRELVSLLVSIGVAAGVAAGMLGVTVLAWGNSRPTLPPRRLDVPRRRHRRRIPRRSHRCLCIPRCRCAASHPTPTRAVLSERERERDKTAMDWVEGGNPSGIESLG

SEQ ID NO: 29353 - protein, 469 aa, Takhtajania perrieri
SVGFKAGVKDYKLTYYTPDYETKDTDILAAFRVTPQPGVPPEEAGAAVAAESSTGTWTTVWTDGLTSLDRYKGRCYHIEPVAGEEDQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFKAVDTLDVL

SEQ ID NO: 29354 - protein, 164 aa, Clostridium perfringens
LEDAQSIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAYRN

SEQ ID NO: 29355 - protein, 151 aa, Clostridium ramosum
IAETKAFVEAVDAKVSDSADWGIATPYLALQAAKEGTKKLLVAAENCHFKDSGAYTGEVSVEMLKEIGVEWVILGHSERRQYFGETDETVNAKMLQVLKNDMTPIVCVGETLEEYEAGTTKDVVKTQTVAAFKDVCPKCAGRTVIAYEPIW

SEQ ID NO: 29356 - protein, 152 aa, Clostridium innocuum
KNWKMHKTMKETKEFMEAVDAAAASENAVFGIGAPYTALSAAVAGAKNLVIAAENCHWEDSGAFTGEISVPMLQEVGVTHCIIGHSERREMFNDTDETVNKKAKRLIDAGITPILCIGETEAQYDAGDSEKVIRDQLTGSLADMCPKCVGNM

SEQ ID NO: 29357 - protein, 149 aa, Clostridium difficile
WKMHKTIKEALEFVNEVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLKDDL

SEQ ID NO: 29358 - protein, 152 aa, Clostridium butyricum
KMHKTVDEAVKMIEELKALVKDATCDVVVCPTFVCLDAVKKAVAGSNIKVAAQNMHFEESGAFTGEVAPGMLEAMGIDYVVLGHSERREYFNETDEALNKKVKAAFAHNITPILCCGETLEQRENGTTNAVVGAQIKADLEGLSKDLAEGVV

SEQ ID NO: 29359 - protein, 150 aa, Clostridium sporogenes
NWKMHKTVKEAVELVKELKPLVKDAKCDVVVCPTYVCLPAVLEEVKGSNIKVGAQNMHFEESGAYTGEIAPKMLEELGVHYVIIGHSERRQYFNETDETVNKKVKKAFEHNLIPIVCCGESLEEREGNITEKVLEGQIKVGLKELNKEQV

SEQ ID NO: 29360 - protein, 128 aa, Clostridium clostridioforme
DVDVVFCVPAIDIIPAMEAAKGTNIYIGAENMYYEEKGAYTGEISPNMLVDAGVKYVIIGHSERREYFAETDETVNKKVLKAFEHGITPIVCCGETLTQREQGITIDWIRQQIKIAFLNVTADQAKTA

SEQ ID NO: 29361 - protein, 148 aa, Clostridium bifermentans
TIAEAVEFVNEIKGKVNNTDVEAVICAPFTLLKDLKEATKGTPIKIGAQNMHYADNGAFTGEISAPMLKELDIDYVVLGHSERRQYFNETNETVNKKVLKALEAGIDPILCIGETLEEREADKTKDVCKVQTEKALENVTAEYMKKVV

SEQ ID NO: 29362 - protein, 153 aa, Clostridium sordellii
WKMHKTIAEAVEFVEEIKGKVNNTDVEAVICAPFTLLKDLKEATKGTDIKIGAQNMHYADNGAFTGEVSAPMLNELNIDYVVLGHSERRQYFNETNETVNKKVLKALEAGIDPILCIGETLEEREADKTKDKCRLQVEKALENVSKDDMKSCY

SEQ ID NO: 29363 - protein, 153 aa, Clostridium septicum
NWKMHNTPEEAVKVITELKPLVKDANCDVVICPTFVCLDAALKAAAGSNIKIGAQNMHFEEKGAFTGEVAPGMLEAMGVDYVVLGHSERREYFNETDEALNKKVKVAFAHNLTPILCCGETLEQRENGTTNAVVGAQIKADLEGLSKELAEKL

SEQ ID NO: 29364 - protein, 154 aa, Clostridium cadaveris
NWKMHNTVDETVKVINELKPLVKDAKVDVVLCVPFTSLDAALKAVKGSNIKIGAQNMHFEEKGAFTGEIAPGMLEAMGVDYVVLGHSERRQYFNETDEALNKKVKAAFAHNLLPILCCGETLEERENGTTNAVVGAQIKADLEGLSKELAEKVV

SEQ ID NO: 29365 - protein, 139 aa, Clostridium tertium
KVIEELKPLVKDATCDVVVCPTFVCLDAVLKAVEGSNIKVAAQNMHFEEKGAFTGEVAPGMLEAMGVNYVVLGHSERREYFNETDEALNKKVKAAFAHNLTPILCCGESLEQRENGTTNEVVGAQIKADLEGLSNELAE

SEQ ID NO: 29366 - protein, 251 aa, Streptomyces sp. 2065
MDKVVATADEAVADVPDGATLAVGGFGLSGVPNVLIQALFERGVGSLGVVSNNCGAMESGLAVLLSAGRIARVTGSYIGANKEFARQYLAGELEVEMIPQGTLAERLRAGGAGIPAFYTPAGVGTQVAEGGLPWRYDGSGGVTLASPAKEVREFDGTEYVLERGIRTDFALVRAAKGDRHGNLVFNKSTRNFNPLAAMAGKVTIAEVEELVEPGEIDPDAVHLPGIFVQRVVALTPRQAADKRIEQRTVSS

SEQ ID NO: 29367 - protein, 250 aa, Hordeum vulgare subsp. vulgare
MPVSRIAVGSHREVYEVGALKAALAEFISTLIFVFAGQGSGMAFSKLSPDGVATPAGLISAAIAHAFALFVAVSVGANISGGHVNPAVTFGAFVGGNITLFRGLLYWVAQLLGSTAACFLLRFSTGGLPTGTFGLTGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 29368 - protein, 441 aa, Oryza sativa
MNIILELNHLKQVSLPTRPVVCKGLFIVIALIVLRAIVSPFLAVNPSEKEGFYDPTADLLPGIRRGKFIEVPQIIWGLNNQKIAFARACLTARFLNRSLLMPSLSASLFYKEVDLLRPITFDKVFDFTKFNARCQGFVRLARYSEVSNQTKPFKLQKGSGRRWTVEKDLDQLLQYRRGEADDSEVIEIIGKHPFLWPDHWPVKDYARIFDCLALVPEIETEVVKVISKIREAGIKARHEAGISHNKHVKDGTMNPPVPYIAVHMRIEKDWMIHCKKWEQRSNSKEICSSKEEIIHKVSQITDLRRPVVVYLAVADSLLEDDSITSGWRVGMVAFEKKRLGVTDIYNRQPYLIKSAIDFEVCARADVFVGNSFSTFSNLVVLSRTQRLYNMGEASSCGENVGLSSYAYNVIGDDGGPQRWMTDMSDTSLQNLSYGTNNISCH

SEQ ID NO: 29369 - protein, 441 aa, Saccharum officinarum
MNIILELNHLKQVSLPTRPVVCKGLFIVIALIVLRAIVSPFLAVNPSEKEGFYDPTADLLPGIRRGKFIEVPQIIWGLNNQKIAFARACLTARFLNRSLLMPSLSASLFYKEVDLLRPITFDKVFDFTKFNARCQGFVRLARYSEVSNQTKPFKLQKGTGRRWTADKDLDQLQQYRRSKADDSEVIEIVGKNPFLWPDHWPVKDYAKIFDCLVLVTEIETEVVKVISKIREAGQRARHEAGSSHSKQRRDSSTNPPVPYVAVHMRIEKDWMIHCKKWEQRSKSHEICSSKEEIIHKVSQITDLHRPVVVYLAVADSLLEDDSITSGWRVGMVAYEKKKLGVTDIYDRQPYLIKSAIDFEVCSRTDVFVGNSFSTFSNLVVLSRTERLYNLGKASSCGENIGLSSYAYNVMGDDGGPQRWMTDMSDTSLQRLSYGTNNVSCH

SEQ ID NO: 29370 - protein, 168 aa, Panax ginseng
MPRSRINGNFIDKTFSIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAMALTPGNYIEAHNWLKITRRFE

SEQ ID NO: 29371 - protein, 478 aa, Panax ginseng
MSPQTETKASVGFKAGVKDYKLTYYTPDYDPKDTDILAAFRVTPQPGVPAEEAGAAVAAESSTGTWTTVWTDGLTSLDRYKGRCYKIEPVAGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYITGGFTANTTLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKEIKFEFEAVDILDVV

SEQ ID NO: 29372 - protein, 504 aa, Panax ginseng
MTIHLLDFHTNRGQENSMERWWFNSILFKKEFEHRCGLSKSTGSLGPIENTSESEDPNINDMKKNIHSWGGRDNSNYSNVDHLFGVKDIRNFISDETFLVRDSNGNSYSIYFDIENHIFEIDNGHSFQSELESSFYSYQNSSYRNNGSNSDDPHYDHYMYDTQYSWNNNINSCIDNYLQSQIFIETDIVSGSDNYSNSYIYSSICGEIAGSGIRTRTDGSDLTIRESSNDLDVTQKYRHLWVQCENCYGLNYKKSFKSKMNLCEQCGYHLKMSSSDRIELLIDPGTWDPMDEDMVSLDPIEFHSEEEPYKDRVDSYQRKTGLTEAVQTGIGQLNSIPVAIGVMDFQFMGGSMGSVVGEKITRLIEYATKKFLPLIIVCASGGARMQEGSLSLMQMAKISSALYDYQSNKKLFYVPILTSPTTGGVTASFGMLGDIIIAEPNAYIAFAGKRVIEQTLNKTVPEGSQAAEYLFQKGLFDLIVPRNPLKSVLSELFQLHAFFPLNQN

SEQ ID NO: 29373 - protein, 415 aa, Streptomyces hygroscopicus
MTPVAEGGLPHGSVPSLSHTRQWRPGVVQEVAPAGVLDLGPGYIEPALLPVRLLRGAYEQALAEYGAAALGYGHDPGAQPLRDRLAARAAAADGLPCDPDQVLLTSGTSQALYLLATSLAAPGDTVLTEELCYDLGQRIFRDCSLRLRQVAMDGSGMLPDALDRALTEGARAGAKTAFVYLTPTHHNPTGHTMPLARRRLLLEVAARHDVLIVEDDAYTELSLIPDRTPPPSLAALAGYRRVVRLCSFSKTLGPGLRLGWLLADRELAGRLATHGLFVSGGSLNHTTSLAVSTLLASGAYDRHLDAFRAQLRARRDALVGALRAMLDDGVELRTPEGGFFLWLRAGDGADERELLDGAARAGVRIAAGSRFGTTQGAGLRLAFSFNPPALLEQAAKRLTTAWSGSTPDLEIGVRS

SEQ ID NO: 29374 - protein, 478 aa, Vitreoscilla sp. C1
MYKKSTIRIFATTSHKMNIDKEINMTNTTLNATANHLHPFSDNQQLKEKGVRVITKADGIYIYDDAGNKIIDGMAGLWCVNIGYGRKELADIARDQMNELAYYNTFFKTSHPAVINLSAKLASIAPAGFNHVFYTGSGSESVDSMIRMVRHYWDSVGKPSKKTLIGRWNGYHGSTIGGVSMGGMKGMHKQGGFPIEGIVHIEQPWFYGLHEEGETAEQFGIRAANWLEEKILEIGADNVAAFVGEPIQGAGGVIIPPSTYWPRIQEICQKYDILLVADEVICGFGRTGEWFGHETFGFQPDIFTTAKGLSSGYLPIGAVFVGDKVVEGILKGGDFNHGFTYAGHPVAAAVALKNVEILDDEGIIKNVHDKTGPYMQAKWREMLSQFKYVDDVRGVGLIQGFTLVKNKATREMFPNEGETGTMLRDIFFSNNLIMRACGDHIVASPPLTITKEEIDLMLATAEKCLQEFETAMDSKLGA

SEQ ID NO: 29375 - protein, 241 aa, Vitreoscilla sp. C1
MEINFLHGDALDLADQVFLFKRTVREAAFNHKMYATFMAKPMEGEPGSAMHIHQSLTCNKTGKNAFSNEDGSPSEIFFYFIAGLQKYLPEAMPFFAPYVNSFRRLTKYTAAPTNVEWGYDNRTVGLRVPRSSPQGRRVENRLPGVDCNPYLVLACSLACGLLGIQQKLQPSAPNSSNAYELPFQFPVTPEESIDRLRACTEIQEILGKRFVEMYIGIKESEIAEYFRVISPWERKFLLLYV

SEQ ID NO: 29376 - protein, 467 aa, Vigna radiata
MRLLSTIATCNSHGQDSSYFLGWQEYEKNPYDELHNPKGIIQMGLAENQLSFDLLESWLAKNPDVAGFKRDGKSIFRELALFQDYHGLPSFKKALVDFMSEIRGNKVTFDPNHIVLTAGSTSANETLMFCLAEQGDAFLLPTPYYPGFDRDLKWRTGAEIVPIQCTSSNNFQITEPALKQAYEEARKRNLRVKGVLVTNPSNPLGTTMSRSELNLLVDFIKEKKDTHLISDEIYSGTVFSSPGFVSVMEILKERNDTEEIWNRVHVVYSLSKDLGLPGFRVGAIYSENDTVVAAATKMSSFGLVSSQTQYLLSAMLGDKKFARNYIVENQKRLKRRQRMMVSGLQKAGISCLESNAGLFCWVDMRHLLHSNTFEAEMELWKKIVYQVGLNISPGSSCHCTEPGWFRVCFANMSEETLTLAMKRLKNFVVESTCTQRSALFNGTSKRKSLTKWVFRLSSRDHREQEER

SEQ ID NO: 29377 - protein, 224 aa, Streptococcus pneumoniae
MPKTLTEKLNAIKATGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFIYAVAINGVTGKSGNYRADLDKHLAQLHQVADIPVLTGFGVSSQADLERFN

SEQ ID NO: 29378 - protein, 224 aa, Streptococcus pneumoniae
MPKTLTEKLNAIKAAGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDITLIPLVSLTTGIERQKELIEGAEGFVYAVAINGVTGKSGNYRADLDKHLAQLHQVADIPVLTGFGVSSQADLERFN

SEQ ID NO: 29379 - protein, 224 aa, Streptococcus pneumoniae
MPKTLTEKLNAIKAAGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLANTDIALIPLVSLTTGIERQKELIAGAEGFVYAVAINGVTGKSGNYRADLDKHLAQLHQVADIPVLTGFGVSSQADLERFN

SEQ ID NO: 29380 - protein, 224 aa, Streptococcus pneumoniae
MPKTLTEKLNAIKVTGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFVYAVAINGVTGKSGNYRADLDKHLAQLHQVADIPVLTGFGVSSQADLERFN

SEQ ID NO: 29381 - protein, 224 aa, Streptococcus pneumoniae
MPKTLTKKLNAIKAAGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFVYAVAINGVTGKSGNYRADLDKHLAQLHQVADIPVLTGFGVSSQVDLERFN

SEQ ID NO: 29382 - protein, 224 aa, Streptococcus pneumoniae
MPKTLTEKLNAIKATGKGIFVPYIMAGDHEKGLDGLGETIHFLEDLGVSAIEVGIPFSDPVADGPVIEEAGLRSLAHGTSTQALVETLKTIKTEIPLVIMTYFNPLFQYGVENFVKDLADTAVKGLIIPDLPHEHANFVEPFLADTDIALIPLVSLTTGIERQKELIEGAEGFVYAVAINGVTGKSGNYRADLDKHLAQLHQVADIPVLTGFGVSSQADLERFN

SEQ ID NO: 29383 - protein, 224 aa, Streptococcus pneumoniae
MPKTLTEKLNAIKAAGKGIFVPYIMAGDHEKGLDGLGETIHFLEDLGVSAIEVGIPFSDPVADGPVIEEAGLRSLAHGTSTQALVETLKTIETEIPLVIMTYFNSLFQYGVENFVKDLADTAVKGLIIPDLPHEHANFVEPFLADTDIALIPLVSLTTGIERQKELIEGAEGFVYAVAINGVTGKSGNYRADLDKHLAQLHQVADIPVLTGFGVSSQADLERFN

SEQ ID NO: 29384 - protein, 224 aa, Streptococcus pneumoniae
MPKTLTEKLNAIKAAGKGIFVPYIMAGDHEKGLDGLAETIHFLEDLGVSAIEVGIPFSDPVADGPVIEEAGLRSLAHGTSTQALVETLKTIETEIPLVIMTYFNPLFQYGVENFVKDLADTAVKGLIIPDLPHEHANFVEPFLADTDIALIPLVSLTTGIERQKELIEGAEGFIYAVAINGVTGKSGNYRADLDKHLAQLHQVADIPVLTGFGVSSQADLERFN

SEQ ID NO: 29385 - protein, 224 aa, Streptococcus pneumoniae
MPKTLTEKLNAIKAAGKGIFVPYIMAGDHEKGLDGLGETIHFLEDLGVSAIEVGIPFSDPVADGPVIEEAGLRSLAHGTSTQALVETLKTIKTEIPLVIMTYFNPLFQYGVENFVKDLADTAVKGLIIPDLPHEHANFVEPFLADTDITLIPLVSLTTGIERQKELIEGAEGFVYAVAINGVTGKSGNYRADLDKHLAQLHQVADIPVLTGFGVSSQADLERFN

SEQ ID NO: 29386 - protein, 224 aa, Streptococcus pneumoniae
MPKTLTEKLNAIKATGKGIFVPYIMAGDHEKGLDGLAETIHFLEDLGVSAIEVGIPFSDPVADGPVIEEAGLRSLAHGTSTQALVETLKTIETEVPLVIMTYFNPLFQYGVENFVKDLVDTAVKGLIIPDLPHEHANFVEPFLADTDIALIPLVSLTTGLERQKELIEGAEGFVYAVAINGVTGKSGNYRADLDKHLAQLHQVADIPVLTGFGVSSQADVERFN

SEQ ID NO: 29387 - protein, 475 aa, Acalypha rhomboidea
  misc_feature (1)..(10): Xaa can be any naturally occurring amino acid
XXXXXXXXXXVGFKAGVKDYKLTYFTPDYQTKDTDILAAFRVTPQPGVPPEEAGAAVAAESSTGTWTTVWTDGLTSLDRYKGRCYDIEPVPGEENQFIAYVAYPLDLFEEGSVTNMFTSIVGNVFGFKALRALRREDLRIPIAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKVLRMSGGDHIHAGTVVGKLEGEREITLAFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTS

SEQ ID NO: 29388 - protein, 475 aa, Rhus copallina
  misc_feature (1)..(10): Xaa can be any naturally occurring amino acid
  misc_feature (251)..(251): Xaa can be any naturally occurring amino acid
  misc_feature (443)..(443): Xaa can be any naturally occurring amino acid
XXXXXXXXXXVGFKAGVKDYKLTYYTPEYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMXKRAVFARELGAPIVMHDYLTGGFTANTSLAHYCRDNGLLLHIHRAMHAVIDRQKNHGIHFRVLAKALRMSGGDHIHSGTVVGKLSGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNXIIREASKWSPELAAACEVWKEIKFEFEAMDTL

SEQ ID NO: 29389 - protein, 171 aa, Lycopersicon esculentum
ARKVSLIRAVLYMVAQCLGAICGVGFVKAFMTHPYNALGGGANFVQSGYNNGTALGAEIIGTFVLVYTVFSATDPKRSARDSHIPVLAPLPIGFAVFMVHLATIPITGTGINPARSFGAAVIADNKNVWDDQWIFWVGPFVGALLAAAYHQYILRAAAIKALGSFRSNATN

SEQ ID NO: 29390 - protein, 1501 aa, Saccharomyces kudriavzevii IFO 1802
MSSIKNTRDGSNNVATRSSSASYAASEESFSGAAHDKEKQNDTPADKLTRMLTGPARDTVSHVSATVSDMSPDVVSKVESFADALSRHTTRSGAFNMDAGGDDGFDAHAIFESFVRDADEQGIHIRKAGVTIENISAKGVDASALEGATFGNILCLPLSIFRGIKAKKHQKMREIICNVNALAEAGEMILVLGRPGAGCSSFLKVTAGEIDQFAGGVSGDIAYDGIPQKEMMKRYKADVIYNGELDVHFPYLTVKQTLDFAIACKTPALRVNNVSKEEYIASRRHLYATIFGLRHTYNTKVGNDFVRGVSGGERKRVSIAEALAAKGSIYCWDNATRGLDSSTALEYAKAIRIMTNLLKSTAFVTIYQASENIYETFDKVTVLYSGKQIYFGLINEAKPYFAKMGYLCPPRQVTAEFLTALTDPNGFHLIKPGYENKVPRTAEEFETYWLNSPEFAQLRNDIAAYNEKVNTEKTKEVYNESMAQEKSKFTRKKSYYTVSYWQQVNLCTQRGFQRIYGNKSYTVINVCAAIIQSFITGSLFYNTPSSTSGAFSRGGVLYFALLYYSLMGLANISFEHRPILQKHKGYSLYHPSAEAIGSTLAAFPFRMIGLTCFFIILFFLSGLHRTAGSFFTIYLFLTMCSEAINGLFEMVSSVCDTLSQANSISGILMMSISMYSTYMIQLPSMHPWFKWISYVLPIRYAFESMLNAEFHGRHMDCADTLVPSGGNYSSLSDDYKVCAFVGSKPGQSYVLGDDYLKNQFQYVYKHTWRNFGILWCFLIGYIVLKVVFTEYKRPVKGGGDALIFKKGSKRFVAPVDEESPDNINDIDAKEQFSSESSGANDEVFDELEAKGVFIWKDVCFTIPYEGSTRMLLDNVSGYCVPGTMTALMGESGAGKTTLLNTLAQRNVGIITGDMLVNGRPIDASFERRTGYVQQQDIHIAELTVRESLQFSARMRRPQRLPDSEKMEYVEKIIRVLGMEEYAEALVGEVGCGLNVEQRKKLSIGVELVAKPDLLLFLDEPTSGLDSQSSWAIIQLLRKLSKAGQSILCTIHQPSATLFEEFDRLLLLKKGGQTVYFGDIGKNSAAILGYFEQNGARKCDHDENPAEYILEAIGAGATASVKEDWHEKWLNSPEYKQSQDKVQELINDLSKQETKSEFGDQPSKYATSYIYQFRYVLIRTSTSFWRSLNYIMSKMMLMMVGGLYIGFTFFNVGKSYVGLQNAMFAAFISIILSAPAMNQIQARAIASRELFEVRESQSNMFHWSLVLITQYLSELPYHLLFSTVFFVSSYFPLRIFFEASRSAVYFLNYCIMFQLYYVGLGLLILYMSPNLPSANVILGLCLSFMLSFCGVTQPVSLMPGFWTFMWKASPYTYFVQNLVGIMLHKKPVVCKKKELNYFNPPNGSTCGEYMKQFLEKSTGYIENPDATSDCAYCIYEVGDNYLTHISSKYSYLWRNFGIYWIYIFFNIIAMICVYYLFHVRQSSFLSPAFIIKKIKNARKKKQ

SEQ ID NO: 29391 - protein, 183 aa, Coffea canephora
GAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQIPRGLKYIHSAKVIHRDLKPSNLLVNANCDLKIIDFGLARPNTKNEVMTEYVVTRWYRAPELLLNSSDYTAAIDVWSVGWIF

SEQ ID NO: 29392 - protein, 183 aa, Coffea canephora
LVIGAYGIVCSALNSETTEHVALKKIANAFDNRIDAKRTLREIKLLRHMDHENVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 29393 - protein, 161 aa, Coffea canephora
RRLRMLLITGSMRRGLCERSSFFAIWIMKTSVVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 29394 - protein, 183 aa, Coffea canephora
LVIGAYGIVCSVLNSETNEMVAVKKIANAFDNYMDAKRTLREIKLLRHLDHENVIAIRDVIPPPLRREFSDVYIATELMDTDLHQIIRSNQSLSEEHSQYFLYQILRGLKYIHSAKVIHRDLKPSNLLVNANCDLKIIDFGLARPNTENEVMTEYVVTRWYRAPELLLNSSDYTAAIDVWSVG

SEQ ID NO: 29395 - protein, 473 aa, Oryza sativa (japonica cultivar-group)
MVGNLWQIKPVRCRGFLEWAERYGPIVSVWFGSSLNVVVSTSELAKEVLKENDQLLADRPRNRSTQRFSRNGMDLIWADYGPHYIKVRKLCNLELFTPKRLEALRPIREDEVTAMVESVHRAVTQPGSEHKPIVVRNHLAMVAFNNITRLAFGKRFMNANGDIDEQGREFKTIVNNGIKIGASLSVAEYIWYLRWLCPLNEELYKTHNERRDRLTKKIIDEHAKALKESGAKQHFVDALFTLREQYDLSDDTVIGLLWDMITAGMDTTVISVEWAMAELVRNPRVQKKLQEELDRVVGRDRVMSETDFQSLPYLNAVVKESLRLHPPTPLMLPHKASTNVKIGGYNIPKGANVMVNVWAIARDPKVWSNPLEYRPERFIEENIDIKGSDFRVLPFGAGRRVCPGAQLGINLVASMIGHLLHQFEWSLPEGTRPEDVNMMESNGVVTFMSTSLQVIAKPRLDNPDLYKRFPVEM

SEQ ID NO: 29396 - protein, 181 aa, Oryza sativa (japonica cultivar-group)
MIFTFYKAQGLSVGSSLVEEDKLELATSLLAKAKEKGVSLLLPSDVIIADKFAPDANSQVVPASAIPDGWMGLDIGPDSVASFSSTLETTQTVIWNGPMGVFEFDKFAVGTEAIAKKLADLSGKGVTTIIGGGDSVAAVEKVGVADVMSHISTGGGASLELLEGKELPGVIALDEAVTVAV

SEQ ID NO: 29397 - protein, 146 aa, Oryza sativa (japonica cultivar-group)
MPRGGFSGSISSPRIDVAIDMGNPFLNRTVDGFLKIGAVGACKVAAEDTFDCLHRGDVSKHKLEHMLKKMCKEGAYWGTVAGVYVGMEYGVERIRGRHDWKNAMIGGALSGALISAASNNHKDKIIKDAITGGAVATAVEFINYLT

SEQ ID NO: 29398 - protein, 448 aa, Oryza sativa (japonica cultivar-group)
MRSPRLRRNPPPATAAAAAPAPDQFRPGDLVEVLPDEPGYRGAHFPASVTASHANPRGYTVAYDGSGCPLGEVVAASQLRPRPPDAPRGVPPAEHAVVDAFKGGAWWVGVALGGGRAAAGGRVAVCFPETREVVEFDAADVRPHLEWVAGEWLSPENMGISKTMPYKKGTQVEVAKLEGNSVVAWFSAAVEKAIWKNSLLVDYNCSKNDGSVLPKEIVDLKHIRPHPQHASAIIFCINDEVEGFQGNGWWLGVITDVHPEFRYTFKAAHSGKEIQLDQKALRLRYDWTHDQWQQVTQMIPGLFYMLLPTFHNNVTKKFAKGSKVEVTSNDDGFHGAWFQGTALKYVNNKILVEYDALKADDEITPLTEAIEVQHVRPCPPDIPVTSGFNLLDEVDACWNDGWWVGVISKVNSGDRSSTEETEFGHEQLRLHCDWVGGRWMRASLGLEA

SEQ ID NO: 29399 - protein, 391 aa, Oryza sativa (japonica cultivar-group)
MQYLFDEDGRRYLDAFGGIATVCCGHCHPDVVEAMVNQAKRIQHSTVLYLNHAIADFAEALAAKMPGDLKVVFFTNSGTEANELALMIARLYTGCHDIISLRNGYHGNAAGTMGATAQCNWKFNVVQTGVHHALNPDPYRGAFGSDGEKYARDVQEIIDFGTTGRVGGFISEAIQGVGGIVELAPGYLPAVYNMVRKAGGLCIADEVQAGVARTGSHFWGFESHGVIPDIVTMAKGIGNGIPIGAVVTTPEIAQVLTRRSYFNTFGGNPVSTAGGHAVLKVLEKEKLQENAFVVGSYLKERLNKLKEKHDIIGDVRGKGFLLGVELVTDRQKKTPAKVEIGHVMNHMKDMGVLVGKGGFYGNVFRVTPPLCFTKEDSDFFIEAMDISLSKL

SEQ ID NO: 29400 - protein, 351 aa, Oryza sativa (japonica cultivar-group)
MRPPRGRGFGRGGGGRGDGGGRGGGGGRGFGRVGDSGGRGGRGGRGGRTPRGRGGGRGGGGRGGMKGGSKVVVVPHKHDGVFIAKAKEDALCTKNMVPGESVYGEKRISVQNEDGTKVEYRVWNPFRSKLAAAVLGGVDNIWIAPGTRVLYLGGASGTTVSHVSDIVGPSPRYAILPFANQVILQTGLVYAVEFSHRSGRDLVNMAKKRTNVIPIIEDARHPARYRMLVGMVDVIFSDVAQPDQARILALNASYFLKNGGHFVISIKIITLIEVEIGEILDVILGIGLKLFEQANCIDSTMPAEAVFASEVEKLKADQFKPSEQVTLEPFERDHACVVGGYRMPKKQKGTS

SEQ ID NO: 29401 - protein, 483 aa, Oryza sativa (japonica cultivar-group)
MNTFLELEPFSTPLFEIPDDADFEYTSMLAADDFSLMDGDFLADQPPAPAEVVAGGGDASGKRSFHANDGEAMCVVSRSSKRRKKAPTNSTSPSNRDGSGGGGGGEGNEPTAERRGSRRVWVRERSTEWWDRMRDPAACPEADFRRAFRMPRAVFDKLCDDLAAAVAKVDTTLRSAIPVPQRVAVCLWRLATGDPLREVSRRFGLGISTCHNIIVQVCAAITAVLLTRVVRWPDSHAAAASRFQALSWIPGVVGAVHTEHFRIVAPREHAGKYYDHRLTGRNNKATYSVAMQAVVDADGAFTDVCIGHPGSLSDAAILAKSALYARCEAGLLLGHDKLGWQQPLWLVGGASYPLTSWMLVPYTQPNLTWAQDRLNARVADARAAAVGAFRRLRARWQCLRRAEVKLPELANMLGACCVLHNLCERSGHGLDADLLDLLDDELVDDGVVAGGGNTVRSPAAEQVRDRIAHGLLDQYVGNASLSG

SEQ ID NO: 29402 - protein, 208 aa, Oryza sativa (japonica cultivar-group)
MVNTAAVAAAKGSRGSGLPLASLNHISIVCRSLQESLTFYTDVLGFFPVRRPGSFDFDGAWLFNYGIGIHLLQAEDPDSLPGKTEINPKDNHISFQCESMVAVERRLKELGIPYIQRCVEEGGIYVDQIFFHDPDGFMIEICNCDNLPVVPLGADQPLVMAACKRAAVIKQQQQASSSPATAAAAAQCAVPSSTKAIHVGEEAHISCA

SEQ ID NO: 29403 - protein, 242 aa, Pisum sativum
MFFIYLKLQGYAAREFVKQGVHPGELAIISKEAVAPYERPALSKAYLFPESPARLPGFHTCVGSGGERLLPEWYSEKGIQLYLSTEIVSADLAAKFLKSANGEHFDYQTLVIATGSAVIRLTDFGVIGANAKNIFYLREVDDADKLYEAIKRKKNAKAVVVGGGYIGLELSAVLKLNDLDVTMVYPEPWCMPRLFTSEIAAFYEGYYANKGINIIKGTVAVGFTANSDGEVKEVKLKDGRVL

SEQ ID NO: 29404 - protein, 304 aa, Dracunculus vulgaris
MGGHDSGRSDISFGGRFASSAFAACFAELCTIPLDTAKVRLQLQKKSVAGDGVSLPKYRGMLGTVATIAREEGLSALWKGIVPGLHRQCLFGGLRIGLYEPVKSLYVGEGFVGDVPLSKKILAGLTTGALAITVADPTDLVKVRLQAEGKLPPGIPRRYSGALNAYSTIVKQEGLGALWTGLGPNIARNAIINAAELASYDQVKQTILKIPGFSDNIFTHILAGLGAGFVAVCIGSPVDVVKSRMMGDSTYKSTLDCFIKTFKNDGPLAFYKGFIPNFGRLGSWNVIMFLTLEQVKKVFIKEAP

SEQ ID NO: 29405 - protein, 387 aa, Butyrivibrio fibrisolvens
MDFQLDQKHEMARSLFREFAEKEVKPLAIETDETEVFPRETVTKMGKSGFLGIPVPKEYGGQGCDPLTYVMCVEELAKVCGTTSVIVSAHTSLCVDPILTYGTYGTEDRSTFRTLLQVRSLVLSVLQSLALVQTLQGVQTKAVLSEDGKTWTLNGSKCFITNGKEADVYIIIAYTDIVEDKKGRKQKKFTAFIVEKDTPGFTFGTKEHKMGIRGSATYELIFQDCVIPAENQLGARGKGFPIAMHTLDGGRIGIAAQALGLAEGALERTIAYVKERKQFGRSIAQFQNTQFQLANLATEVEAAQLLVYKAAEAKRTQDRYSVEAAKAKLFAAETAMDVTTKCVQLLGGYGYIREYEVERMMRDAKITEIYEGTSEVQRMVISGSLLA

SEQ ID NO: 29406 - protein, 389 aa, Butyrivibrio fibrisolvens
MDFTLDKKHEMARQLFREFALNEVKPMAQEIDETEQFPRENVEKMMKYGFMGIPIPKEYGGQGCDVLTYIMCVEELSKVCGTTGVIVSAHTSLCCDPILTYGTEEQKQKFLVPLASGKKLGAFALTEPGAGTDAQGAQCRAEEDGDSWVLNGSKCFITNGKEADIYIIFAVTDIVEDAKGRKSKKFSAFIVEKGTPGFTFGTKEKKMGIRASSTYELIFQDCRIPKENILGPRGKGFGIAMHTLDGGRIGIAAQALGIGEGSIDATIDFVKERKQFGRPIAAFQNTAFQLADMKARMDAAKYLVYKAACTKDQYMEDHKTSYSIEAAEAKLFAAEAAMAVTTKAVQLHGGYGYTREYDVERMMRDAKITEIYEGTSEVQRLVISGAMLK

SEQ ID NO: 29407 - protein, 406 aa, Azoarcus sp. T
MDFSLSEEQMMLKEVARRFTANELMPLEKVLLEREMRMWTDGYTLLPAADHARLMNMTREMGFWGIEVDEKLGGQGLGMFAKTLVVEEMSKSLIGFSHHGFTLPPDAPNLYYLDECGTPAQREKYLRRYCRGEIESAMMATEPGAGSDISGLTTTAVRVDGQWVINGSKIFISKCDKDDLFFICIAVTDREAATKRRLTAFILDKDTPGLRIGAEIPVIGAMPTWTVYLDNVRVGDDAVLGEVGDAFIPLQNRFGVRRIELAAHCTGMAERLIQMMIEQANLRKTFGEPLAERQTVQNWIADSTVELEQVRLQLYYTAWKSDQGHKDLRIEASSLKIAATEMLTRVADRAIQLHGGLGLSRELGIEYVSRMVRIWRIVEGASEIHRMSIAKKLLADGRTYSPFMAA

SEQ ID NO: 29408 - protein, 154 aa, Escherichia coli
STGDMLRAAVKSGSELGKQAKDIMDAGKLVTDELVIALVKERIAQEDCHNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYS

SEQ ID NO: 29409 - protein, 154 aa, Escherichia coli
STGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYS

SEQ ID NO: 29410 - protein, 193 aa, Escherichia coli
GIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 29411 - protein, 193 aa, Escherichia coli
GIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQEYRD

SEQ ID NO: 29412 - protein, 186 aa, Carica papaya
FGSVYKGFIDDKLRPGLKAQPVAIKLLDLDGSQGHKEWLTEVIFLAQLRHPHLVKLIGYCCEEEHRLLVYEYMPRRSLENQLFRRYSVSLPWSTRMKIAHGAAKGLEFLHEAENLVIYRDFKASNILLDADYNPKLSDFGLAKDGPEGDDTHVSTRVMGTQGYAAPEYIMTGSHLTAKSDIYSFGI

SEQ ID NO: 29413 - protein, 159 aa, Haemophilus influenzae
MFRAAIKAGTELGKQAKALMDEGKLVPDELTVALVKDRIAQADCANGFLLDGFPRTIPQADALKDSGVKIDFVLEFDVPDEVIVERMSGRRVHQTSGRSYHIVYNPPKVEGKDDVTGEDLIIRADDKPETVLDRLAVYHKQTSPLIDYYQAEAKAGNTQ

SEQ ID NO: 29414 - protein, 156 aa, Haemophilus influenzae
NRSNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDENEVAKHFAALSTNAKDVEKFGIDTN

SEQ ID NO: 29415 - protein, 218 aa, Triticum aestivum
MAPRVPSSLLLVGAALLLGLAAGAARASNEEGDALYALRMRLSDPNGVLQSWDPTLVNPCTWFHVTCDTASRVVRLDLGNSNVSGSIGPELSRLVNLQYLELYRNNLNGEIPKELGKLKNLISLDLYANKLTGRIPKSLSKLSSLRFMRLNNNKLAGSIPRELAKLSNLKVIDLSNNDLCGTIPVDGPFSSFPLRSFENNSRLNGPEPQGLVSYDFGC

SEQ ID NO: 29416 - protein, 116 aa, Bacillus mycoides
KRKLAAKVFRHTAAYDALISNYLTEQMGEESPETVTVTFEKKQDLRYGENPHQKATFYKAPFAATSSVAYAEQLHGKELSYNNINDADAALSIVKEFTEPAVVAVKHMNPCGVGVG

SEQ ID NO: 29417 - protein, 116 aa, Bacillus weihenstephanensis
KRKLAAKVFRHTAAYDALISNYLTEQMGEESPETLTVTFEKKQDLRYGENPHQKATFYKAPFAATSSVAYAEQLHGKELSYNNINDADAALSIVKEFTEPAVVAVKHMNPCGVGVG

SEQ ID NO: 29418 - protein, 116 aa, Bacillus pseudomycoides
KRKLAAKVFRHTAAYDALISNYLTEQMGEESPETLTVTFEKNQDLRYGENPHQKATFYKAPFAATSSVAYAEQLHGKELSYNNINDADAALSIVKEFTEPAVVAVKHMNPCGVGVG

SEQ ID NO: 29419 - protein, 145 aa, Bacillus anthracis
ESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 29420 - protein, 145 aa, Bacillus cereus
ESVNKKTIAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 29421 - protein, 145 aa, Bacillus thuringiensis serovar sotto
ESVNKKTLAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 29422 - protein, 145 aa, Bacillus thuringiensis serovar kurstaki
ESVNKKTIAAFEHGLTPIVCCGETLEERESGKTFDLVAGQVTKALAGLTEEQVKATVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 29423 - protein, 145 aa, Bacillus weihenstephanensis
ESVNKKTLAAFEHGLTPIVCCGETLEERESGKTFDLVAGQVTKALAGLTEEQVKVTVIAYEPIWAIGTGKSSSSADANEVCAHIRKVVAEAVSPEAAEAVRIQYGGSVKPENIKEYMAQSDIDGALVGGASLEPASFLGLLGAVK

SEQ ID NO: 29424 - protein, 145 aa, Bacillus pseudomycoides
ETVNKKTLAAFEHGLTPIVCCGETLEERESGKTFDLVAGQVTKALAGLTEEQVKATVIAYEPIWAIGTGKSSSSADANEVCAHIRKVVAEAVSPAAAEAVRIQYGGSVKPENIKEYMAQSDIDGALVGGASLEPASFLGLLGAVK

SEQ ID NO: 29425 - protein, 239 aa, Lactobacillus sakei
MDNSIMVQALGELVGTFILVLLGDGVVAGVSLAKTKANGAGWIAITLGWGFAVTLGVYASAFMGPAHLNPAVTLAFAIIGKVSWSVVLPFIIAQMIGAFLGAVVVWIQYYPHWQATDDQSAILGTFATGPAIRSPFANLMSEIIGTFVLVFALLALTRGQFTEGLNPLVVGVIITAIGLSLGGTTGYAINPARDLGPRIAHAVLPIANKGDSDWQYSWIPVIGPFVGGILGALLFVLLP

SEQ ID NO: 29426 - protein, 311 aa, Isatis indigotica
MAIAFKSGVCFLQSAKPQIGIRHSSPDSSLSFKRLTPIAALSTSSPTLGLADTFKELKKQGKVAFIPYITAGDPDLSTTAEALKVLAASGSDIIELGVPYSDPLADGPVIQAAATRALENGTNLDNILDMLDKVLPQVSCPVSLFTYYNPILKRGLGKFMSSIRDVGVQGLVEPDVPLEETEMLRKEALNNNIELVLLTTPTTPTERMKRIVDASEGFIYLVSSIGVTGARASVSGKVQSLLKDIKEATDKPVAVGFGISQPEHVKQIAGWGADGVIVGSAMVRLLGDAKSPTEGLKELERLTKSLKSALL

SEQ ID NO: 29427 - protein, 237 aa, Pichia anomala
VGGHEGAGVVVAKGANVTNFEIGDYAGIKWLNGSCQSCEYCEKSFESNCPKADLSGYTHDGSFQQYATADAVQAAKIPKDADLAEVAPILCAGVTVYKALKTADLDAGQWVAVSGAGGGLGTLAIQYAKALGLRVLAIDGGDEKGELVKSLGAEVYIDFTKTKDIVKDIIEATNGGPHGVINVSVSEKAIEQSTEYVRPCGTVVLVGLPAGAVARAQVFGAVVKSVSIKGSYVGNRA

SEQ ID NO: 29428 - protein, 247 aa, Pichia anomala
NGSCMTCEYCQNAFESNCAKADLSGYTHDGSFQQYATADAVQAAQIPKGTDLAQISPILCAGITVYKALKTANLKAGDWVAISGAGGGLGSLAVQYAKAMGYRVLGIDVGADKGELAKSLGAEEYVDFKASKNVVEEIQEKTKGGPQGVINVSVSDAAISQSTQYVRPTGSVVLVGLPPKSVIHSDVFSHVVKSISIKGSYVGNRADSREAIEFFTRSLVHSPIKVVGLSELPKVYELMDQGKILGR

SEQ ID NO: 29429 - protein, 198 aa, Shigella boydii
RRELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVA

SEQ ID NO: 29430 - protein, 204 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFSF

SEQ ID NO: 29431 - protein, 200 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 29432 - protein, 202 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 29433 - protein, 202 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 29434 - protein, 201 aa, Shigella boydii
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 29435 - protein, 197 aa, Shigella boydii
ELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAM

SEQ ID NO: 29436 - protein, 199 aa, Shigella boydii
ELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 29437 - protein, 201 aa, Escherichia albertii
LKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 29438 - protein, 202 aa, Escherichia albertii
LKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFSF

SEQ ID NO: 29439 - protein, 199 aa, Shigella boydii
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29440 - protein, 198 aa, Escherichia albertii
ARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 29441 - protein, 199 aa, Escherichia albertii
ARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 29442 - protein, 197 aa, Shigella boydii
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29443 - protein, 192 aa, Shigella boydii
TMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 29444 - protein, 194 aa, Shigella boydii
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29445 - protein, 182 aa, Shigella boydii
LFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 29446 - protein, 191 aa, Shigella boydii
KARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMI

SEQ ID NO: 29447 - protein, 205 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQ

SEQ ID NO: 29448 - protein, 206 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQG

SEQ ID NO: 29449 - protein, 206 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 29450 - protein, 205 aa, Escherichia coli
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSIQGT

SEQ ID NO: 29451 - protein, 192 aa, Escherichia coli
LTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMI

SEQ ID NO: 29452 - protein, 180 aa, Ricinus communis
MAETPSKRQRSNETYAEDVEESKRHKSYNQILSLLEEEEEEPTQDISSLITTLQQELDDPLSCPSTETGRESPFATITSAIEDYPSSSSSSSSSSSSMLLKEDEEDDKDRVIRHLLEASDDELGIPNTETGSGFDDGYEGFVSSANGFSGVDGFSLCDGLWEIEDANANYYALLQSELFM

SEQ ID NO: 29453 - protein, 415 aa, Eremothecium gossypii
MSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 29454 - protein, 326 aa, Candida albicans
MTGSSSQFQQLEKLGEGTYATVYKGRNRATGALVALKEISLDSEEGTPSTAIREISLMKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQHPHQPIIDQQY

SEQ ID NO: 29455 - protein, 248 aa, Kluyveromyces lactis
MARTFFIGGNFKMNGSKASIKEIVDRLNGASIPSNVEVVIAPPAIYLDHAVALNKRKEVKISAQNAYSKASGAYTGENSVEQIKDVGAEWVILGHSERRTYFNETDEIVAEKTKFALDSGVKVILCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 29456 - protein, 251 aa, Aspergillus oryzae
MPRQFFVGGNFKMNGTAESITAIIKNLNEAKLDETTEVVVSPPALYLTLAQQVADEKKKVAVSSQNVFDKPNGAFTGEISVSQLQDAKIPWTIIGHSERRVILKETDEFIARKVKAAIDGGISVIFCIGETLEEREADKTIEVVTKQLNAAAKELTKEQWSKVVIAYEPVWAIGTGKVATTQQAQEVHAAIRKWLADAISPEASENTRIIYGGSVSEKNCRELAQERDVDGFLVGGASLKPAFVDIINARL

SEQ ID NO: 29457 - protein, 478 aa, Arabidopsis thaliana
MATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQITYWVFVVMWLQIRFLHDPSKDTGYVGSALSSNMIRFFKNSDDTWSHEAIENWILPEMPGLITDFLISLDDRFFYFVNWLHGDIRQYNIEDPKNPVLTGQIWVGGLLQKGSPYKAVGEDGNTYQFDVPQIKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 29458 - protein, 477 aa, Arabidopsis thaliana
DLPPSPPSLPIIGHLHLLLSVLLHRSLQKLSTKYGSILYLRVFRFPVVLISSASIAYEIFRAHDLNISYRGFTPTDDSLFAGSFSFISAPYGDYWKFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWRTTEEKINMDEAVVGLSLTMAHPLKIIPVARTSNSLTSSLQKCL

SEQ ID NO: 29459 - protein, 202 aa, Carica papaya
FGGVYRGVYDAQDVAVKVLDWGEDGFATAAEAAALRTSFRQEVAVWHKLDHPNVTKFIGASMGTSNLKIPPKDATSDGHNPLPSRACCVVVEYLPGGTLKKFLIRNRRKKLAIKVVIQLALDLSRGLSYLHSKKIVHRDVKTENMLLDTHRTLKIADFGVARVEAQNPRDMTGETGTLGYMAPEVLDGKPYNRKCDVYSYGV

SEQ ID NO: 29460 - protein, 180 aa, Carica papaya
FGSVYRGQLPNGQKIAVKRLSVGSGQGDLEFKNEVLLVAKLQHRNLVRLLGFCLERSERILIYEFMPNASLDYFLFHPTKRERLDWDNRYKIIGGIARGLLYLHEDSRLRIIHRDLKASNVLLDAEMLPKIADFGMARMSELDETQGNTSRIVGTYGYMAPEYAMHGQFSVKSDIYSYGI

SEQ ID NO: 29461 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHSVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDVFKTHPMNLLNERTLKGTFFGNYKPRTDLPGVVEKYMNKELEVEKFITHS

SEQ ID NO: 29462 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKAVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29463 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 29464 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29465 - protein, 303 aa, Populus tremula
DVYFWEAKGQTPLYPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECGHVGWGVAVLVGVPSKDDEFKTHPMNLLNERTLKGAFFGNYKPRTDLPGVVEKYMNKELEVEKFITHS

SEQ ID NO: 29466 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVAELINPKDHDKPVQQVIIEMTDGGVDRSIECTGNVQAMISAFECVHDGWDVAVLVGVPSKDDEFKTHPMNLLNERTLKGTFFGNYKPRTDLPGVVEKYMNKDLEVEKFITHS

SEQ ID NO: 29467 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNEGTLKGTFFGNYKPRTDLPGVVEKYMNKELEVEKFITHS

SEQ ID NO: 29468 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHGKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29469 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKDLEVEKFITHS

SEQ ID NO: 29470 - protein, 303 aa, Populus tremula
DVYFWEAKGQTPLFPRIYGHEAGGIVESVGPGVTDLQPGDHVLPVFTGECGDYRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29471 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVLIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29472 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTGLINPKDHDKPVQQVIIEMTDGGVDRSIECTGNVQAMISAFECVHDGWGVAVLVGVPSKDDEFKAHPMNLLNERTLKGTFFGNYKPRTDLPGVVEKYMNKELEVEKFITHS

SEQ ID NO: 29473 - protein, 303 aa, Populus tremula
DVYFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29474 - protein, 303 aa, Populus tremula
DVNFWEAKGQTPLFPRIYGHEAGGIVESVGPGVTDLQPGDHVLPVFTGECGDCRHCKSEESNMCDLLRINTDRGVMLTDGKSRFSINGKPIYHFLGGSTFSEYTVCHIGTVAKINPAAPLDKVCILSCGISTGLGAALNVAKPQKGHTVAVFGLGAVGLAAAEGARLSGASRIIGVDLNPSRFKEAKKFGVTELINPKDHDKPVQQVIIEMTDGGVDRSIECTGNVQAMISAFECVHDGWGVAVLVGVPSKDDEFKTHPMNLLNERTLKGTFFGNYKPRTDLPGVVEKYMNKELEVEKFITHS

SEQ ID NO: 29475 - protein, 218 aa, Psychrobacter sp. 273-4
MMRIILLGPPGAGKGTQAQFISKEYDMPQISTGDMLRAAIKEGSELGKQAKDVMNAGGLVSDDLIINLVQERIAKPDCVNGCILDGFPRTIPQAQALADANVTIDHVIEISVPDDEIVKRLSGRRQHAGSGRVYHIDHNPPQQEGIDDVTGEALIQREDDKESTIRDRLAIYHEQTSTLVGFYQDKAKEGGDAPKYDKFDGTQGIDDVKQQIFSALKS

SEQ ID NO: 29476 - protein, 438 aa, Psychrobacter sp. 273-4
MYAEETNNVTAIKDIRAREILDSRGNPTIEADVILADGTIGRAAAPSGASTGSREALELRDGDKSRYMGKGVKKAVANVNSQIRSALMDKNVTAQQAIDDAMIALDGTDNKDNLGANAILAVSLAVAKAAAKSQSLPLHQYIADLRNQTSLTMPVPMMNIINGGEHADNTVDIQEFMIEPVGFSSFSEALRAGTEIFHSLKSVLKSQGLNTAVGDEGGFAPNLRSNEEAITVIMQAIEQVGYTAGKDIHLALDCAATEFYKDGKYILAGEGNKSFDSQGFSDYLVGLARQYPIISIEDGLDESDWDGWKYLTEQIGDKVQLVGDDLFVTNPAILQEGIDKHIANAILIKFNQIGTLSETLDAIYLAKKNGYATIISHRSGETEDSTIADLAVGTAAGQIKTGSLCRSDRVAKYNQLLRIEQQVRASYRGREEFIGLRG

SEQ ID NO: 29477 - protein, 376 aa, Psychrobacter sp. 273-4
MSDKFIKSKAAIAWGPNQPLSIEEVDVMLPRKGEVLVKIIASGVCHTDAFTLSGEDPEGVFPAILGHEGGGIVEQIGEGVTSVQVGDHVIPLYTAECGECKFCTSGKTNLCSAVRETQGKGLMPDGTTRFYKDGQPIYHYMGCSTFSEYTVLPEISLAKVSKEAPLEKVCLLGCGVTTGMGAVMNTAKVEEGATVAVFGLGGIGLAAVIGAKMAKASRIIGVDINEDKFELAKKLGATDCINSKDYDKPIQEVIVEMTDGGVDYSFECIGNVDVMRSALECCHKGWGESVIIGVAGAGKEISTRPFQLVTGRVWKGSAFGGVKGRTELPGYVERYLEGEIPLNDFITHTMPLENINEAFDLMHKGESIRTVIHFDM

SEQ ID NO: 29478 - protein, 480 aa, Psychrobacter sp. 273-4
MSELKKSLGTLDVIALAFGAMVGWGWVVLAGGWILSAGTWGAMLAFFIGGLAVILIGVTYAELAASMPITGGEHTYTHRALGVNVSFICSWSILFGYFSVVAFEAVALPTVVEYFIPNYNQGYLWTIAGWDVYATWVGVGMLGSVIVTWLNIRGMEVSAWFQKTAVLGILFVGTLLFIGAVLYNPDTSTAIQSPAFIGGVGGMMAVIVMVPFMFVGFDVIPQAAEEIDLTRPNIGKFLIISIVVAVMWYVGIAWSVGTTLPLVQAESSTLATADAMTNAWQGKWAGILLVIGGVLGILSSWNAFLIGGSRLLYAMSKARMLPAFLGKLHPKYKTPSNAILLIGGLATLAPLFGRKMLVWIVDAGGFGIVIAYTCVAISFLVLRYREPDMVRPFKIPAGKLVGMVTIVLSVGLLMLYMPGMPSALTAVEWWIFFGWTMLGIVLYGYARVKYPGISESIMAEELRELKIVNQLWLKDNSTKK

SEQ ID NO: 29479 - protein, 419 aa, Psychrobacter sp. 273-4
MTTNQSLLARRKAILPTGLGVAFPIFAEKAKNSEVWDVEGNRYIDFVGGISVLNTGHSHPKITQRVHEQLDKFTHTAAQMINYECYVDLAEKLCEKAPISGDTKAFFLTTGAEAVENCIKIARAKTGRPGVISFVGGWHGRTLMCMSLTGKVLPYKKNFGPMPGPVFHALFPAEELNVTEEQALHSLEMIFQADIDPSEVAAIIIEPVQGEGGFHQVTPSFAKSLRDICDEYGIVLIFDEVQCGFARTGTLFACEQLGVEPDLMTSAKSLAGGYPISAVIGRADIMDAPQIGGLGGTYSGNPLACVAALAVMEVIEEENLLERSIEIGDKIESFLKDLNLSSIGHIRHKGAMLAFELIDNEGKPDVEATTNLKAKSFEQGLLLASCGMYGNAIRVMVPLTVEDEVLQEGLDIIKGILTA

SEQ ID NO: 29480 - protein, 488 aa, Psychrobacter sp. 273-4
MLKTTLNLSNPDLIKQQCLIKDGWYAANDEATIEVSNPFNGDVIGTVPSLTTADVNDAVTYSHEAQITWAAKTPQERAQLLQKWADLIDANKEDLAIIMTAEQGKPLAESRGEIGYANSFIRWFAEEGKRVYGDVIPATNSQLRYVVLKQPVGVCAAITPWNFPAAMITRKAAPALAAGCTIIIKPATETPFSALALGALAEQAGIPAGVIQVVTGKSSTIGDILTGDARIHKLSFTGSTEVGRTLMAQCAPTIKKLSLELGGNAPFIVFDDADLEKAADGLIASKYRNAGQTCVCANRVYVQDSIKDEFLGIFIKKVAELKVGNGMEEGVNVGPLINEKALQKVQALLKDALDKGATLIAGGSTNNASALAYNPTVITDISADMDIASEEIFGPIAPVFTFSSEEEVIRAANDTIYGLAAYFYSSDYARAWRVTEGLEYGMVGHNTGMLSTEVAPFGGVKQSGFGREGSKYGIEEYVVTKYWCSDVS

SEQ ID NO: 29481 - protein, 402 aa, Psychrobacter sp. 273-4
MTDNKEQHMATSSSPRFDWEDPFLLRDQLTDEERMVTDSARQFFQKELMPGIIQANRNEHFDRNIMRQMGEMGLLGVTIDGYGCAGMSSVAYGLIAKEVEAVDSGYRSAMSVQSSLVMHPIHAYGTEEQKEKYLPKLATGEYVGCFGLTEPDSGSDPSSMLTRARAVAGGYELTGNKMWITNSPISDVFVVWAKDDAGDIRGFILDKGMKGLSAPKIEGKFSLRASVTGEIVMDKVFVPEANAFPDIRGLKGPFGCLNKARYGIAWGSMGAAEFCWKASRQYTLDRKQFGRPLAATQLVQLKLANMQTEITLGLQAALRVGRLMDEDNAAPEMISLIKRNNCGKALEIARIARDMHGGNGISDEFHIIRHVMNLEAVNTYEGTHDIHALILGRAQTGIQAFY

SEQ ID NO: 29482 - protein, 424 aa, Psychrobacter sp. 273-4
MSQSQVQNKDNIHSLDANWRDDALDLELNYGMQTIAVRAGQHRTDEGEHSEAIFTTSSYVYRSAVDAAGHFDGTKTGNVYSRHTNPSVRTFERRLAALENGERAVATASGMGAILTMCLAYLKAGDHLLAANQLFGSSIGLFNNYMAKFGVEVSYVDCFDNDAWANAVQPNTKVIYCESPSNPLAQICDIGYLSQLCKANDILLVVDNCFATPALQRPLDLGADVVIHSATKYLDGQGRVLGGALVGSDKLMQEAFTVIRSGGISMSPFNAWVFTKGLETLKLRMQAHCSNANQVAEFLVNHPNVSTVHFSGLSDHPSHELTKRQHHMKDGFGAIMGFEVKAKGTHDPKSAAWHVIDSTQMVSITNNLGDAKTTITHPATTTHFRLSAQERAEAGVKDGLIRLSVGLEDVEDIIKDLARGLDSL

SEQ ID NO: 29483 - protein, 400 aa, Psychrobacter sp. 273-4
MNFLRMSELSLTNKVVLIREDLNVPIKEGKVASDARLQASLPTIKMALEKGAAVIVCSHLGRPTEGSSEAIYSLAPVADYLSDKLSAPVTLNNDYLAQGVAIKAGEVVLLENVRFNEGEKKNNAALAQKYADLCDVFVMDAFGTAHRAQASTEGVTQAMHQAGKTACAGPLLAAELDALSLALETPAQPMLAIVGGSKVSTKLEVLHSLAELCSQIIVGGGIANTFLAAQGHSVGASLYEADLVDTAREIMGKTEILLPEYVVVANKNDIDFADFTGSLQKAVATIKSVDNIGDNDMILDIAPDSAIKLAAAITNAKTILWNGPVGVFEVDAFGQGTQIVAEAVKNSQGFSIAGGGDTLAAIDKYQVADGVSYMSTGGGAFLEFVEGKVLPAVAALQINE

SEQ ID NO: 29484 - protein, 493 aa, Psychrobacter sp. 273-4
MQAKELLELERREIKALHYTWIAFFLTFYVWFNMAPLATSMLQTESYLTPDHIKLFLIANVALTIPGRVVVGMALDRFGPRRVFSILMVVMAIPTWFFAFGTSAMQLFVARLFMSIVGAGFVVGIHMTALWFKPKDIGFAEGFYAGWGNFGSAAAAITIPTVALQFFGGDDGWRWAIALSGLIMAAYGVVYWFLITDGPTADTHKKARSAGALEVSTWKDLLLYCLFIVPLYGVLSLLVYRTQGMGFLSATGAWVCYGVIGLMVLYQIYKAISVNVPIIKAGIPEDDKYPFTSVAALNVTYFANFGAELAVVSMLPMFFAATWTLDPTVAGLVASTFAFVNLWARPLGGYISDRVGNRRLVMLVYMFGIGIGFGLMGLLNAEWPLFIAVVFTILCSVFVQGAEGATFGVIPSIKRRLTGQISGLAGAYGNVGAVFYLFVFTLVEPNQFFFIIAIGAFIAWVLCFFWLKEPEDAFGDDYKMSSVDIQIAKEHNG

SEQ ID NO: 29485 - protein, 455 aa, Psychrobacter sp. 273-4
MVFPLSFVDFKSYSLRLGVLALPILITQFCQAALGVVDAIMAGQVSALDLAAVAVGSGIWLPLFLLATGILIATTPLIGEAIGQKQLDKVPHITQQSLWTAAVIGILGFIIVNLAPNVLALMGVPENIQPIATQYLHGVSFGFPAIAVYAVLRSYCEALGRPEPVTVISIIGLLADIPLNYIFIHGLFGMPEMGGAGCGVATAIVLWINVLLLAAYTSFTKRHQFASTRFFYAFASPNRAQIKKLLKLGIPIGVSIFFEASLFSLGALVISPLGELATASHQVALSVTSQLFMIPISVAMALTIMVSNHFGEKNLMALRQVQATGLIWTVLIAMACMIGVWLFRPQLAAAFTDNPVVRAQAMHLLIFALAYQLFDGWQVNVAGILRGMQDTTIPMWVTLFCYWIVALPLGIYLVRFTDIGAQGFWMALITGLFLSSILLTIRLCYQQKRLLAMWS

SEQ ID NO: 29486 - protein, 295 aa, Psychrobacter sp. 273-4
MNKSYIQNSFYEKTARNRIASIVDKNSFVEILKPGSMPTSPNLASLDITGSFDDGVIIGKATIKDNFVYIIAQEGQFMGGAVGEMHGAKIVGMLLKAIEEKPKAIVFFVDSGGVRLHEANAGLIAISEIMRAMLKVRNAGIPIITVIGGTNGAFGGMGISACLSTHIIMTEEGRLALSGPEVIETLKGVEEFDSKDRALVWRVTGGKTRYLLGHVQVLVEDDIDDITQEIIAALQLPVANVDLSYLQQQQDGLQQQYDQWFGKKDSLSIWQSMNINNPDSISMLSAEQVKAIKKG

SEQ ID NO: 29487 - protein, 187 aa, Psychrobacter sp. 273-4
MTQISNQEIEKTLRNSECLISSIEVAAAYERLAAQLNLHYAGLNPIVMVVMNGGLIPAGQLLTHLTFYHRMHYIHASRYRDNEGTNELDWKFKPDVSIAGEYVLLIDDIFDEGITLKSIVEELSKENPLSIESCVLLNKEHDRKVVDFDVDFVGINVADRYVYGCGMDFHGYLRHLPGIYAIKEDKI

SEQ ID NO: 29488 - protein, 379 aa, Psychrobacter sp. 273-4
MKQPMPNTSTLFSSIQLGPYTLKNRIVLPPLTRCRSTQPGNIPNDLMASYYAQRASAGFMVTEGTQIEPRGQGYAWTPGIHSPAQIEGWKKVTQAVHAKGGIIFAQLWHVGRVSHTNLQPNQNQPIAPSAITANNVKVFIETGPGEGALADPSEPRALSTEEVGELVAMYAQAARNALEAGFDGVELHCANGYLVNQFISEHSNTRDDQYGGSLTNRLRFLKEVVAAVSDVVGADRLGVRFAPLFASTNETRVYLGLVEADPHHTYIEAIKVLEQAGIAYLSIAEADWDNAPDLPEPFYQAVRAEFSQRIIYAGKYTVQKSVDILSKGYGDLFAFGRPFIANPDLPERIANNWSLNEVDPATMYGGTAIGYSDYPRYQE

SEQ ID NO: 29489 - protein, 393 aa, Psychrobacter sp. 273-4
MSATYLMPTYLRQPISFTRGSGSWLYTRDETPYLDALTGIAVCGLGHCHPQVTDAIQQQAATLVHTSNLFGIDWQERAGEALCNAAQMDSVFFANSGAEANEAALKLARLYAHQQGFKRPKVIVMEQSFHGRTLLSLSATANPKAREGFYTLDDDFIRVPFGDIAAIEQAAHDYEDICAVFVEPIQGEGGLNTASNGFSYLEQIQAVCNTHNWLFMLDEVQTGNGRTGKYFAYQHSSARPDVLTTAKGLGNGFPVGACMVRGRANGLFGAGSHGSTYGGTPLASRVVHSVYDVLANSDIMKNAVTEGQFIRDGMVDAFGEYGVSSRGAGMMIGIALPEDMDCSNLVDRARDEQKLIINVTGAHVIRLLPPLNMSRDESSQVVERLVNLLKPSF

SEQ ID NO: 29490 - protein, 469 aa, Psychrobacter sp. 273-4
MSNKLLDLIKSSNAKWVDFRFTDTRGKEHHMSFPAHSVDEESMEDGKMFDGSSIAGWKGIEASDMILRPDPETAFIDPFFDAVTVVVTCDIIEPSTLQGYDRDPRSIARRAEEYLKSTGIGDTAFFGPEPEFFVFDEVKWSVGMSGVSHEIVAEEAAWSTNKDYEWGNMGHRPRVKGGYVPVPPVDSSQDMRTVMCDRIEDMIGEGCIEVHHHEVAPCQLEIGVAFNTLVRKADEVQKLKYAVHNVAHQFGKTATFMPKPIVGDNGSGMHVHISISKDGVNTFSGDEYAGLSETALYFVGGIIKHARALNAITNPSTNSYKRLVPHYEAPIKLAYSASNRSASIRIPHVSSPKAVRVEARFPDPAANPYLAFAALLMAGLDGIQNKMHPGEAADKNLYDLPPEEEALIPTVAENLEVALQALKDDHEFLLKGDVFTKEMLEAYIALKQEEVQRVNITVHPVEFDLYYSC

SEQ ID NO: 29491 - protein, 339 aa, Psychrobacter sp. 273-4
MTRTSATPEGLATDQMVDYYAKFARGGFGLIITEGTYSDNTYSQGYFDQPGIINNEQVTAWKKVTEAVHQEGGKVIVQLMHAGALSQGNQFTKETLGPSAVQPKGEQMAFYGGDGAFQVPKEATKDDITEVIKGFVEASKNAKEAGFDGIEIHGANGYILDQFLTDYTNKRTDEYGGSTENRVRLLEKVSRAVREAVGQDYTVGIRISQGKVNDYDHKWANKEKDAEIIFGQLAQAGLDYIHVTDFEAWQPAFGDEGPTFAALAKKYGKLPVIANGSLHDPEKAKEIVEKGGADIITLARGALSNGDWANKVKNGEKPEEFVPEKVLSPDAKIKDFETK

SEQ ID NO: 29492 - protein, 191 aa, Shigella boydii
PLYHIFALTINCLLFIELGGHNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFL

SEQ ID NO: 29493 - protein, 192 aa, Shigella flexneri
LPLYHIFALTINCLLFIELGGQNLLITNPRDIPGLVKELAKYPFTAITGVNTLFNALLNNKEFQQLDFSCLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFL

SEQ ID NO: 29494 - protein, 184 aa, Shigella boydii
FALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDNEVPPGQPGELCVKGPQVMLGYWQRPDATDEIIKNGWLHTGDIAVMDEEGFL

SEQ ID NO: 29495 - protein, 190 aa, Shigella dysenteriae
LYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDGNEVPPGQPGELCVKGPQVMLGYWQRPDATDEIIKNGWLHTGDIAVMDEEGFL

SEQ ID NO: 29496 - protein, 191 aa, Shigella dysenteriae
LPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGF

SEQ ID NO: 29497 - protein, 192 aa, Shigella flexneri
LPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFL

SEQ ID NO: 29498 - protein, 189 aa, Shigella dysenteriae
PLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDGNEVPPGQPGELCVKGPQVMLGYWQRPDATDEIIKNGWLHTGDIAVMDEEG

SEQ ID NO: 29499 - protein, 190 aa, Shigella dysenteriae
PLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDGNEVPPGQPGELCVKGPQVMLGYWQRPDATDEIIKNGWLHTGDIAVMDEEGF

SEQ ID NO: 29500 - protein, 191 aa, Shigella dysenteriae
PLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDGNEVPPGQPGELCVKGPQVMLGYWQRPDATDEIIKNGWLHTGDIAVMDEEGFL

SEQ ID NO: 29501 - protein, 191 aa, Shigella boydii
PLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFL

SEQ ID NO: 29502 - protein, 191 aa, Shigella boydii
PLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTESAPLVSVNPYDIDYHSGSIGLPVPSTEAKLVDDDDNEVPPGQPGELCVKGPQVMLGYWQRPDATDEIIKNGWLHTGDIAVMDEEGFL

SEQ ID NO: 29503 - protein, 196 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 29504 - protein, 205 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSI

SEQ ID NO: 29505 - protein, 188 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGF

SEQ ID NO: 29506 - protein, 207 aa, Shigella boydii
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 29507 - protein, 208 aa, Shigella flexneri
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 29508 - protein, 202 aa, Shigella sonnei
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQ

SEQ ID NO: 29509 - protein, 196 aa, Shigella boydii
LTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 29510 - protein, 207 aa, Shigella sonnei
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 29511 - protein, 206 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSFQG

SEQ ID NO: 29512 - protein, 204 aa, Shigella boydii
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 29513 - protein, 208 aa, Shigella dysenteriae
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSFQGT

SEQ ID NO: 29514 - protein, 196 aa, Escherichia coli
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 29515 - protein, 208 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 29516 - protein, 205 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQ

SEQ ID NO: 29517 - protein, 202 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29518 - protein, 193 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAM

SEQ ID NO: 29519 - protein, 185 aa, Escherichia coli
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFA

SEQ ID NO: 29520 - protein, 203 aa, Escherichia coli
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 29521 - protein, 209 aa, Shigella flexneri
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 29522 - protein, 198 aa, Escherichia coli
RHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29523 - protein, 200 aa, Shigella flexneri
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 29524 - protein, 192 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMI

SEQ ID NO: 29525 - protein, 195 aa, Shigella flexneri
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29526 - protein, 199 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29527 - protein, 196 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 29528 - protein, 193 aa, Shigella flexneri
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29529 - protein, 204 aa, Shigella boydii
RRELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 29530 - protein, 188 aa, Shigella dysenteriae
IGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 29531 - protein, 195 aa, Shigella dysenteriae
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29532 - protein, 194 aa, Shigella dysenteriae
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 29533 - protein, 186 aa, Shigella dysenteriae
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIG

SEQ ID NO: 29534 - protein, 201 aa, Shigella dysenteriae
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29535 - protein, 194 aa, Shigella dysenteriae
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 29536 - protein, 198 aa, Shigella dysenteriae
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVG

SEQ ID NO: 29537 - protein, 198 aa, Shigella dysenteriae
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGF

SEQ ID NO: 29538 - protein, 198 aa, Shigella dysenteriae
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 29539 - protein, 204 aa, Shigella dysenteriae
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSF

SEQ ID NO: 29540 - protein, 193 aa, Shigella dysenteriae
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGF

SEQ ID NO: 29541 - protein, 205 aa, Shigella flexneri
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29542 - protein, 192 aa, Shigella flexneri
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 29543 - protein, 200 aa, Shigella flexneri
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 29544 - protein, 187 aa, Shigella flexneri
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 29545 - protein, 205 aa, Shigella flexneri
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 29546 - protein, 197 aa, Shigella flexneri
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 29547 - protein, 200 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 29548 - protein, 188 aa, Shigella flexneri
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 29549 - protein, 203 aa, Shigella flexneri
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 29550 - protein, 201 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29551 - protein, 198 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 29552 - protein, 201 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 29553 - protein, 201 aa, Shigella boydii
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQLAGWSNWTIGEAPFAGGFAAMIGVAMIVGFS

SEQ ID NO: 29554 - protein, 190 aa, Shigella boydii
GGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29555 - protein, 184 aa, Shigella boydii
IAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMI

SEQ ID NO: 29556 - protein, 204 aa, Shigella boydii
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29557 - protein, 188 aa, Shigella boydii
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGV

SEQ ID NO: 29558 - protein, 198 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAM

SEQ ID NO: 29559 - protein, 193 aa, Shigella boydii
IAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29560 - protein, 202 aa, Shigella sonnei
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSF

SEQ ID NO: 29561 - protein, 203 aa, Shigella sonnei
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29562 - protein, 202 aa, Shigella sonnei
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 29563 - protein, 321 aa, Xylella fastidiosa Ann-1
MHYRRLGSTGLQLSVLSFGTWMTFGNQVARDEARNLVACAWDHGVNFFDGAETYAQGRAEQVLGDVIADLRLPRDGYCVSSKVFFGAVKEPRPTQCGLSRKHVHDACHAALKRLRVDYLDLFFCHRPDADTPIEETVRAMTTLIRQGKVLYWGTSEWSAAQIAEAIAIASREHLERPWVEQPQYNLLHRERVEREYVSLYAQGLGTTIWSPLASGLLTGKHNVGVVLGSRLVQPGYEWLQREVLGEGEARLVQARRFSEVAADLGQLPTQLAIAWCLRNPHVSTVILGASRVAQLKENLQALQVVAALDAAAWRCVEAAME

SEQ ID NO: 29564 - protein, 508 aa, Xylella fastidiosa Ann-1
MVSAWNEEVTESLFMSRKHAFQFLDLPRQMPQRIPVELRTSGDWRELYGKFDKGEAQYQAGRCLDCGNPYCSWKCPVHNAIPQWLQLVQENRIDEAAALCHSTNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIVSGNDPYGRPIAGWEDQVQLPDVAGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 29565 - protein, 368 aa, Xylella fastidiosa Ann-1
MSQREWVASSICKIEADFNRSVDTHLIPLQLPGFPDIDFYLKDESIHPTGSLKHRLARSLFLYALVNGWLSPGRPVIEASSGSTAVSEAYFARLLGLPFIAVIPTSTSPEKVAAIEFHGGRCHAVERACDLHDAAHQLARETGGHFMDQFTYAERATDWRANNNIAESIFKQMADEPHPIPTWIVCSPGTGGTAATLGRYVRYRRHVTRILCADPEISVFFDHYRAACKGSDHRNSVTDTGGSRVEGIGRPRLEPSFIHNCIDAMIKVPDALSLAAMRYISARLGRRVGGSTGTNMVGVLQTAARMRAEGMKGSIVTILCDGGERYAHSYYSPAWYAAHGIDVSDSDAVIAAVVAGDTLPLLPCAALE

SEQ ID NO: 29566 - protein, 314 aa, Xylella fastidiosa Ann-1
MRHAVVSLLVAAMSASLPAMSKQSVSVVNNQEKTVLSTEKEKVSYAIGLDIARSHVFELIAQDIDVAALQRAIENVFKGGPPLISEEVAQTTDTALRAMLAARSGQQEASGTAPPAVSKENIGLMLGSYMVGPSLLAIKDDIDLPVLLQALRTRFAKRTPLMDEQEMTTRMQAFVASKNAVVAGKNRDEGSAFLSKNKNEKGVVTTASGLQYMVLRQGSGSRPTPSNNVRVNYEGKLLSGQVFDSSYQRGQPAEFGLAQVIKGWSEGLSLMSVGSKYRFWIPADLAYGQQGTPGGPIGPDATLTFDVELLSILP

SEQ ID NO: 29567 - protein, 206 aa, Xylella fastidiosa Ann-1
MCNEPATSDVALPDLDWAKGDGLLPVIVQDADTLRVLMLGYMNSQALEVTQRSRLVTFYSRSKQRLWTKGERSGHVLHVVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 29568 - protein, 448 aa, Xylella fastidiosa Ann-1
MREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKQLGIMPDLLCLSKGLTGGVLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 29569 - protein, 349 aa, Xylella fastidiosa Ann-1
MGFAALSATGPLERFAFGRRAPRPDDVVIDILYCGVCHTDLHLARNHSGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDVIIDTVPYDHDVNPYMPTLVLEGVLVLVGYLGPLSMPVNAGGVVRGRRAISGSFIGGAHETQQMLDFCGQHGIVSDVEIIPIQKINEAYERMLKSDVKYRFVIDMTSLTSSGA

SEQ ID NO: 29570 - protein, 271 aa, Xylella fastidiosa Ann-1
MFGELISEAIAMFIIIALGESAAAMYILYDPSPYQNAYWGLCICWGLAVTIAIYVTASVSGTHANPAVTLALALYRGFPWEKVLPYWAAQVIGAFIGAMIVYQLYSPVIDYYNHIHQLTRDAGGAAGVFFTSTGMAITPIHALGDEIILTAFLVFGIFAITERFNEAAPTANSGALVIGLLVATIGACMGYLEGWAINPARDLGPRLFAFLAGWGESAFPGKDHYWWIPIIGPLIGGVMGATAFQCLIYPFLPARVHAKQQAAILLNRQHP

SEQ ID NO: 29571 - protein, 488 aa, Xylella fastidiosa Ann-1
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDATQVGVSYLGLPQDVAAGDVLLLDDGLMQLQVVQVQGARIVTTVLNDGVLSDRKGLNKQGGGLSLGALTDRDRELIRIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 29572 - protein, 319 aa, Xylella fastidiosa Ann-1
MTIYNTILDTIGHTPVVKLNRIAPAHVDLYIKVESFNPSGSVKDRLALAIIIDAEQQGLLKPGDTIVEATSGNTGVALAMIAAARSYTFVATMVETFSIERRKLMRAYGAKVILTPAAERGSGMVRKAKELAEQHGWFLASQFSNPANPAYHRNTTAAEILRDFAGRRLDHFVSGWGTGGTLTGVGEVLKIARPDIKITASEPASAALLQGKEWQPHKIQGWTPDFVPEVLNRSVPHHILSVTDDDAITVARRLAAEEGVFSGISGGASVATALQIAQQAEQGAVILAMLPDTGERYFSTPLFADINEHSDDAWLASLG

SEQ ID NO: 29573 - protein, 314 aa, Xylella fastidiosa Ann-1
MLAQPPVKKGMPRAFLQCAGGAPANVAVAVARLGGAVQFVGMLGSDMFGDFLFDSFAEAGVVTDGIVRTNTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIASTLRFAAAVGALAVTRQGAFTAMPMLSEVLSLIQEQS

SEQ ID NO: 29574 - protein, 469 aa, Xylella fastidiosa Ann-1
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFSNDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLAPEEEKLIPQVCSSLDQALEALDKDRDFLKAGGVMSDDFINGYIALKMQEVTQFRAATHPLEYQMYYAN

SEQ ID NO: 29575 - protein, 348 aa, Xylella fastidiosa Ann-1
MGIRIQELRKQFEDFTALAGIDLDIRQGELLALLGPSGSGKTTLLRIIAGLEHADAGRVLFGDEDATTMSVQARRVGFVFQHYALFKHMSVYENVAFGLRVRRGKARWPESQISARVFELLSLVQLDGLEQRYPMQLSGGQRQRVALARALAIEPRVLLLDEPFGALDAQVRRDLRRWLREIHDRTGLTTVFVTHDQEEALELADRVAILNQGGIEQVASPDEVYNRPSSPFVYSFVGAVNRLPGCVGADGLEVAGIVLSCPPQLSGGGAVDLYVRPEDLVLDAQEGWSAIVLWSQRSGPRMRVRARLEHSAHEVEIELSSATDEYVEGQKLRLIPRHYGVFFSEFGS

SEQ ID NO: 29576 - protein, 276 aa, Xylella fastidiosa Ann-1
MSKTTTHPIAAEHKEANLAIRVRGLINHFGTQTVHDGLDIDVHRGEILGVVGGSGTGKSVLMRTILGLHTPNAGSIEVLGVNPHSQSSEDRRIIARNTGVLFQDGALFSSMTVGENVQVPMKEHHGKFPKRLYYELALLKIKLAGLPANALDKLPSQLSGGMRKRAGLARALALDPPLLFLDEPTAGLDPIGAASFDQLIKTLQKALGLTVFLITHDLDTLYTICNRVAVLAERKVIANAPLAEIETIDHPWIREYFHGPRGRAARTAQHTSTGSS

SEQ ID NO: 29577 - protein, 430 aa, Xylella fastidiosa Ann-1
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 29578 - protein, 371 aa, Xylella fastidiosa Ann-1
MDIGHSGWLGWDTNRIPAVSLYTKVIQSTTAGFASVNGFATNTANTTPLIEPNLPNADLNIGGQPIRSSKFYEWNRYFDEMDYSETLYNDFVAAGWPSSIGFIIDTGRNGWGGSQRPTSAFGNDINSYVNSGRIDRRNHRGNWCNQQDAGIGLPPTVTPGGHVDAFQWIKPPGYSDGSSSLIPNDQGKGFDRYCDPTFTTPDGVLTGALPDAPLSGDWFHAQFVKLINNAYPDISRTPLPGSGSSSSSGSSSSSGSSSSSGSSSSSGSSSSSGSSSGSSSSSGSSSGSSSGSSSGSSSGSSSGSSSSSGSSSGSSSGSSSGSSSGSSSSSGSNSAPVLAQVGFYSAPINTGQPRRVYPGWLTVVVHTKTLF

SEQ ID NO: 29579 - protein, 453 aa, Xylella fastidiosa Ann-1
MAVSFVISRFGSEVRPTLLLALPLVLGHVSTGLIGFVLNVIAGHHSTVTLAASTIGTALLWLPMLVPMGTLISLTVLVSQLHGAERERDIGPLFRQALWLAMLLGLVMFTFLSVVPALLPLFGIVPDIVPGAAKFLHVVRWGSLAFPLYFCMRYFCEGMHCTFPTMLLGFGGLLVLVPLSYALTYGRFGFAEYGVEGLGIATVTVMWLQAVVFALYLWRSRRFAHLQLFAHLELPCWAPIRDLLNIGLPIGISILMEGGLFIVTTLLIGRFGTDEIAAHQIALSVAQLCFMIPMGVAEATTVRIGHAVGRCDLLVMRRVAWAGYAIVIGTQTLSASVLLLGYDVIVAAYTDDLVVASLASKLLLFAAIFQFPDGLQMLSSGVLRGMKDTRVPMLLAMISYWGLGMPLGLGLGFALEWNSRGMWIGLIIGLTAAAVLLGWRFRVVSERMFAGIP

SEQ ID NO: 29580 - protein, 473 aa, Xylella fastidiosa Ann-1
MELASPMNDILPVILSGGSGTRLWPLSREAYPKQFLPLVGHHSMLQATWLRAAPVTTHSPIIVANEEHRFIAAEQLQHLGVYPSAILLEPTGRNTAPAIAVAALEATRTGNDPLLLVLPSDHVIRDETAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 29581 - protein, 192 aa, Lactobacillus gasseri
MWVVVLTFLLVTFFDTAGTLIGLAQQAGFMKNNKMPRVGKALAADSTAMMFGSIFGTSPVGAFVESSAGIAVGGRSGLTAVFVAIFFLISMIFSPLLGVFTTQVTAPALIIVGVLMAQNTAHIHWNKLEIAVPAFLILLGMPLTYSISDGLALGMITYPICMVSAKRGKEVSPMMWVLFVVFIIFLWVLNFK

SEQ ID NO: 29582 - protein, 286 aa, Lactobacillus gasseri
MDKIKMKSISKELISEVIKKRKSATHKGNYGRVLLIGGSKKYGGALIMSAEGALNSGAGLTTVATDSVNISALHTRDPEIMALDWKKRDELKNLIVSSDVVVCGMGLGLDDQARDILALIRDSITLKQTLILDASALDLISQQKDILPVNSKLVIFTPHQMEWQRLSKIKIADQTDQLNQAFLNELVPRKNAILVLKSNHTKVYDQAGNIYQNPFGNPGMAIDGMGDTLAGIIGGFCGQFTPNLATVAGAVGLHSITADEIAVKQYIVRPTQLSALIPAMMRKYEK

SEQ ID NO: 29583 - protein, 454 aa, Lactobacillus gasseri
MPKDFFWGNSVSSMQTEGAWNEDGKGLSVYDVRPATENTTDWHTAIDEYHRYDEDLDLMKEMNMNMYRIQISWSRVCPEGDGKFNLKGIDFYDKLINAMLKRGIEPMICLYHFDMPLHLAKEYNGFMSRHVVDAFVRFGKKMIDHFSDRVKYWIVFNEHNLYFQDEVFNISGYEKGDKTLDDMYTIFHHTMISHIRLANYIHEKYDDVKIGGMLAYQQIYPETSKATDVWAAKQAQEFLNFNIYDADTGRGYSPEVMQYAKDHHINWDITDEDQEEMKKAQADFLAFSYYSSWTLSADKIPEDIAPNRYMNYGGVKNKYLKTNAWGWTIDPLGFRNAITTMYNHYKIPVFPIENGIGLKETWDGEHMIEDDERIAYHEEHIKAMKDAMFLDGAKVLGYLGWGLIDIPSSHADVEKRYGAVYVNRSNHDLKDLKRVPKKSFYWSQKVLKNNGDEI

SEQ ID NO: 29584 - protein, 369 aa, Lactobacillus gasseri
MEKGVMNAVNNVNTEINEALKGRSPYNQAAIDNLMIKLDGTPNKARLGANAILGVSMAVARAAAKSKNEPLYRYLGGCDLELPQTFHNVINGGKHADNGIDIQEFMITPVNKTSFRDGFEKIVNTYHTLKKVIEDAGFETGLGDEGGFASNLKSSEEALRMLQEAIKKAGYEPGKDIAIAFDAAASSFYNKEDGKYHFEGHVWDGEEMLAYYDKLLTEFPEIISAEDPFDENDWDNFEKFTAKFGDKIQVVADDNVCTNPKLVRKAIKDKLCNAVLIKVNQIGTITETLETIRLARKNNMTTMVSHRSGETGDTFIADFTVATNAAELKSGAPARSERVEKYNRLLEIEQEIGVENERLAHFPNDVDMD

SEQ ID NO: 29585 - protein, 222 aa, Lactobacillus gasseri
MVLVRHGESIANRDNVYTGWNDVPLSKKGIEQAKDAGLKVAKIPDFVPTHIHTSVLSRAIMTANIIADVCSFLYLPITKTWRLNERHYGALRGINKDVSKKIFGKEQVLKWRRGFDSVPPLLTQPVQDRRYQKYDMRLMPQGESLHQTQDRLMPYFWDHIAPELMSGHDQLIVAHGSSLRALIKKIEGISNKDIVKVEVPNAEPIVYTFDSDLHIIKKEILH

SEQ ID NO: 29586 - protein, 475 aa, Lactobacillus gasseri
MSTLLKRVKKLPKGFVWGAATAAYQVEGNTNLDGKGKIMWDDYLKNQGNFSPNPACDFYHRYPEDLKIAHNLGLNAIRISIAWTRIFPNGYVTDEPNEAGVKYYHRLFHECLKNNLVPYVTLHHFDSPKTLFDQGDWLNREMIDEFVKYADFCFQEFVEVDNWFTINELISLAMCQYIQGTFPPNKLFDVSDAIQAQHNELVAHAKVVNLFKAKGYKGRIGLIHVIQPVYPATNSEADRHAADLRDAFMNRFLLDGTLLGFYSDRTRHLIKEILVANNAELHILPEDLEILKQASKQNDMLGINYYQNQTVASYDGPSETYHNGNGKKGSSVFAFHGVGKDVRNPAIPTTDWDWNIYPEGLYDVLKRIAHDYPDYPVIYITENGMGAKEAWDSSKEYLDDNYRIDFIDQHLAAILKARNEGVNVQGYFLWSLQDQFSWSNGYNKRYGLIYVDFASQDRHLKRSALWFKALSKTMK

SEQ ID NO: 29587 - protein, 281 aa, Lactobacillus gasseri
MESVIDDDLAIWLAENGYYYVMHRFHPEKRANFIKMMHDKGLFASISVGIKDSEYDFIDYLAKEKIIPEYITIDVAHGHSDYVIKMIKYIKDKLPDTFLTAGNIATPEAVRELENAGADATKVGVGPGRACITKLKTGFGTGGWQLAALRMCSKAARKPLIADGGIRHNGDIAKSVRFGASMVMIGSLFAGHEESPGNLITIDGKRYKQYWGSASEVQKGAYRNVEGKQMLVPYRGSIKDTLREMQEDLQSSISYAGGKDLSAIRVVDYVIVKSSIFDGDK

SEQ ID NO: 29588 - protein, 317 aa, Lactobacillus gasseri
MKTTKLGKTSLDIPALALGVMRMGTRTPEEGAAAINVAYEAGVNFIDSADIYGRGNSEKVFGKALKLSDVKREDLFIQSKTGIVVGPNGSHGSLVYGSRYEFTKEHILNAVDGILKRMDIDYLDCLVLHRPDVLMDLEVIKQAFDVLQATGKVRFFGVSNFNPAQFKMLQNAVSQPLMFDQVQFGLMHTGMIDFGLHTNMTDDASINHDGSLLEFLRMNHITLQAWSPFQYGTFEGTFINNPAFPELNKKLQEIGDKYGVGKNAVAAAWILRWPGQVQVIMGTMTPAHIVDSAKGADIELTNQEWYDLYFAAGHDLP

SEQ ID NO: 29589 - protein, 343 aa, Lactobacillus gasseri
MTEVEFMTKIFAYAIRKDEEPFLNEWKDAHKDVEVEYTDKLLTPETAKLAKGADGVVVYQQLDYTPETLQALADAGVTKMSLRNVGVDNIDMDKAKELGFEITNVPVYSPDAIAEHAAIQAARVLRQDKRMDEKMAKRDLRWAPTIGREVRDQVVGVVGTGHIGQVFMRIMEGFGAKVIAYDIFKNPELEKKGYYVDSLDDLYKQADVISLHVPDVPANVHMINDKSIAEMKDGVVIVNCSRGPLVDTDAVIRGLDSGKIFGFVMDTYEGEVGVFNKDWEGKEFPDARLADLIDRPNVLVTPHTAFYTTHAVRNMVVKAFDNNLKLINGEKPDSPVALDKNKF

SEQ ID NO: 29590 - protein, 322 aa, Lactobacillus gasseri
MASAKAYASLEFWFAMIKVVTIILMIILGFIVIFFGVGNGGKPTGFSNLWSHGGFFTGGVKGFFFSMSIIVGSYEGIELLGISAGEVANPQEAIVKSVKSVLWRILIFYVGAIFVIVTIYPWNELSSIGSPFVTTFAKVGITAAASIINFVVLTAALSGANSGIYSSSRMLFKLAHDGDAPKTFGHISKRIVPNHAILGISGGILIGFVVNMIAATINKSTQDLFVIVFSSSVLPGMIPWFVILLAELKFRHNNQELLVDHPFKLPLYPISNYFAFLMLIVIVVFMLINPETRVSVLVGAAVLIIATIVYLIRHRKDGVDGK

SEQ ID NO: 29591 - protein, 460 aa, Lactobacillus gasseri
MENKKNHPPKLKRSMTAGQMEMISLGGAIGVGLFMGSTSTIKWTGPSVLLAYMFVELILYIVMRALGEMLYVSPGTGSFADYATEYISPLAGYLAEWANVFQYIVVGISEVVAATEYLKFWWPQVNVFWSGIIIIALLLLANLASAKAYGALEFWFAMIKVVTIILMIILGLFVILLGVGNHGKPLGFSNLWSHSGFFTGGVKGFFFSMAIIAGSYEGIELIGISAGEVANPQEAIVKSVKSVLWRILIFYVGAIFVIVTIYPWNQLSNIGSPFVETFTKVGITAAAGIINFVVLTAALSGANSGIYSSSRMLFKLSHEGEAPKIFGKLSKHIVPDRAIIGITVGILVGFVLNLIVSTMNKSMGELFVIVYSSSVLPGMVAWFVILIAELKFRKSNTHLMDKHPFKLPLYPYSNYFAFMMLLIIVIFMFINPETRVSVTVGAGVLVLAAIVYAIKHRKKK

SEQ ID NO: 29592 - protein, 249 aa, Lactobacillus gasseri
MAAIIDFKHVNKYYGKFHALKDINLSIEEGQVVSIIGPSGSGKSTLIRTMNGLERINSGTLMVTGYDLADKHTDLNKIRKNVGMVFQHFNLYDNHTVLENITLAPKIVLHRPEKENHDIAMDLLKKVGLEEKANMYPRQLSGGQKQRVAIARSLAMRPKAILFDEPTSALDPEMIQDVLDVMKYVADQGITMVVVTHEMGFAREVGDRLIFFDQGRILEDAKPEEFFEHPKTERARQFLSKVITEKLGG

SEQ ID NO: 29593 - protein, 225 aa, Lactobacillus gasseri
MVKHRHSLSKNQKWVIASTSSGFALENMDVLFLSFAMSSMIADLHLSGGAAGFISTITNLGMLVGGIAFGILGDKIGRVKTFSHTVIIFAIATALMAFANNIYMIYGLRFLAGIGAGGEYGVGIALIAENFHKEQIGKMTSVAAIGGQIGAILAALIAAWIIPTAGWHMLFLVGIIPVVLTIFIRKHVHESEQFLEAKASEKNSLLSDVAKKCSLRLVLLGKHSA

SEQ ID NO: 29594 - protein, 333 aa, Streptomyces hygroscopicus
MSAALTDGTVQGQQQCDTRLVGLYEADEAGSDLTLALSLAHGRAEAAARGIPLHTHLWQLYGGRTAPGLPRLMVNVFSGGIHRTGPPRGFQQVMVLPATGGLHTDIEVADRVFTAAHRNVERRFGPVPLSASSGLMVPLDSAGQLDLLQAAVAETGHTEVCTLGVDVAAEHLLTEPGRYRFGDRVLTAPDFADHLADLAHRFRMSFLEDPFDAADEAGWARLRGALPATTSVVGDDLFATDATRIEPGRADGILLKLSQAGTVTATLAAAAAARRAGMLLSVSHRSGETEDTAMCDLAVAVGAELIKVGGPRRGDRLAKYNQLLRLDESVAAP

SEQ ID NO: 29595 - protein, 128 aa, Mycoplasma capricolum
MDLVLNHTSDQHEWFKQSRSSKTNPYRDYYIWRDQPNDITSAFGGSAWTYDKTTNQYYFHMFAKEQPDLNWQNPKVREEIAKMVKWWCDFGIMGFRLDVIELLGKRIDQKVLSNGPMLHKYIQDLRKK

SEQ ID NO: 29596 - protein, 167 aa, Lactobacillus fermentum
RALNARVLGYDLKPREEMEGIVEYVSKEELLRQSDVVSLHVDLNPTSEGLLTKAEFDQMKPGASLVNASRGPVVNTADLINALKDGPLAFAALDTVEGEGPIFNADHRQDGLKGEPLVEELHAMDNVILTPHIAFFTNIAVQNMVDISLDDVITILNGQPSEHEVAN

SEQ ID NO: 29597 - protein, 490 aa, Clostridium saccharobutylicum
MGKPTGFLEYDREVGRNREPKERLKDYKEFHQRLPLEKQCIQGARCMDCGVPFCQAGVLFSGMVSGCPLHNLIPEWNDLVYRGKWELAYERLNKTNPFPEFTGRVCPAPCEAGCTAGLNGPAITIKENERSIIDNAFENGFVKANTPLKRTGKKVAVIGSGPSGLAVANTLNKCGHKVTVFERSDRPGGLLMYGIPNMKLDKEVILRRVHLMAEEGIKFVNNANVGDNYDAKEILDEFDAVVLATGASQPRDLQAEGRDNVNGIHFAVDFLKANTKSLLDSDHEDNNYISAKDKNVIIIGGGDTGTDCVATSLRHGCKSVVQFEIMGEPAHERTESNPMPEWPKVLKVDYGQEEFIELYGKDPREYLTTVTAVHSDKDGNLESVDTVKVEWKKGDNGRMFPAHVEGSEKNWPAELILLAMGFTGSEDYLKNAFGIESDERSNVKAGNVDFMTNVPKVFATGDARRGQSLVVTAISEGIAAGIAVDKFLRA

SEQ ID NO: 29598 - protein, 165 aa, Ceratopteris richardii
MVTASVENGVASQNGQTFAQSAKVVFVLGGPGSGKGTQCASIVEQFAFTHLSAGDLLRAEISSGSENGLMIQNMIKEGKIVPSEVTVKLLQNAMERSGNDKFLIDGFPRNEENRAAFELVTGITPEFILFFDCPEEEMERRLLGRNQGRVDDNIETIKKTFQSFH

SEQ ID NO: 29599 - protein, 398 aa, Aspergillus niger
MKSASLLTASVLLGCASAEVHKLKLNKVPLEEQLYTHNIDAHVRALGQKYMGIRPSIHKELVEENPINDMSRHDVLVDNFLNAQYFSEIELGTPPQKFKVVLDTGSSNLWVPSSECSSIACYLHNKYDSSASSTYHKNGSEFAIKYGSGSLSGFVSQDTLKIGDLKVKGQDFAEATNEPGLAFAFGRFDGILGLGYDTISVNKIVPPFYNMLDQGLLDEPVFAFYLGDTNKEGDESVATFGGVDKDHYTGELIKIPLRRKAYWEVELDAIALGDDVAEMENTGVILDTGTSLIALPADLAEMINAQIGAKKGWTGQYTVDCDKRSSLPDVTFTLAGHNFTISSYDYTLEVQGSCVSAFMGMDFPEPVGPLAILGDAFLRKWYSVYDLGNSAVGLAKAK

SEQ ID NO: 29600 - protein, 325 aa, Zinnia elegans
MVKAIRIHEFGGVEVMKWEDVEIGEPKAGEIKVQNKAIGLNYLDVYMRKGIVKEVPPFPFTPGMESAGVVIAVGPEVTTCKVGDVVAYAGYPVSAYAEEQILPADRAVPVPPSVDPVLAAAAIFKGLTAEMLVRRCFKVGPGHTILYHAAAGGVGSLACQWANALGATIIGTVSTKEKAVQAKEDGCHHVIIYKEENFVDRVMEITSGKGVDVVYDSIGKSTFQGSMECLKVRGYLVVFGMPSGAPEPPSFQQLAEKGIYCTMPSVMLYTKERNELVAASEELFSNIEKGVLRVRVNHKYPLSQAAQAHSDIESQKTTGSIVLIP

SEQ ID NO: 29601 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 29602 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 29603 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29604 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFPSKLPWKETLSFRYQAEENSPKHIEEYFHNRMGEDFAEFGTVYQDYCEAMSTLSLGIMELLGMSLGVSREHFREFFNENDSIMRLNYHPPCQKPDLTLGTGPHCDPTSLTILHQDQVGGLQVFVDNEWRSINPNFDAFVVNIGDTFTALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29605 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVSTNWLHQRSLS

SEQ ID NO: 29606 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTPIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29607 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTSSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPENDKMVTPPHELVDTCNPRIYPDFTWPMLLEFTQKHYRADMKTLEVFTNWLHQRSFS

SEQ ID NO: 29608 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKDDKMVTPPHELVDTCNPRIYPDFTWPMLLEFTQKHYRADMKTLEVFTNWLHQRSLS

SEQ ID NO: 29609 - protein, 385 aa, Populus tremula
MAIDCIKSMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKFPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29610 - protein, 385 aa, Populus tremula
MTIDCIKTMPSITAPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29611 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGHASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29612 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29613 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNEDDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29614 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29615 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29616 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 29617 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGEPCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29618 - protein, 385 aa, Populus tremula
MAIDCIKTMPSITTPHHHPKDQDQCKDDGKSFVFDAQVLRHQTNIPQQFIWPDHEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29619 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29620 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLPLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCDPRIYPDFTWPMLLEFTQKHYRADMKTLEVFTNWLHQRSFS

SEQ ID NO: 29621 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29622 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGVYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29623 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFRNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 29624 - protein, 473 aa, Antidaphne viscoidea
PQTETKASVGFKAGVKDYKLTYYTPDYETKDTDILAAFRVTPQPGVPPEEAGAAVRAESSTGTWTTVWTDGLTNLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29625 - protein, 475 aa, Korthalsella lindsayi
MSPQTETKASVGFKAGVKDYKLTYYTPDYETKDTDILAAFRVTPQPGVPPEEAGAAVAAESSTGTWTTVWTDGLTSLDRYKGRCYDIEPVAGEENQFIAYVAYPLDLFEEGSVTNMLTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIHKAQAETGEIKGHYLNATAGTCEEMMKRAVFARELGVPIIMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQVRNEGRDLAREGNEIIREASKWSPELAAACEVWKEIKFEFPAMDTL

SEQ ID NO: 29626 - protein, 475 aa, Notothixos subaureus
MSPQTETKASVGFKAGVKDYKLTYYTPDYETKDTDILAAFRVTPQPGVPPEEAGAAVRAESSTGTWTTVWTDGLTSLDRYKGRCYHIEPVAGEENQYIAYVAYPLDLFEEGSVTNMFTSIVGNVFGFKALRALRLEGLRIPPAYSKTFQGPPHGIQVERDKLNKYGRPLLGCTIKPKLGLSAKNYGRAVYECLRGGLDFTKDDENVNSQPFMRWRDRFVFCAEAIDKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERGITLGFVDLLRDDFIEKDRSRGIYFTQDWVSLPGVLPVASGGIHVWHMPALTEIFGDDSVLQFGGGTLGHPWGNAPGAVANRVALEACVQARNEGGDLAREGNEIIREASKWSPELAAACEVWKEIKFEFQAMDTL

SEQ ID NO: 29627 - protein, 473 aa, Santalum album
PQTETKASVGFKAGVKDYKLTYYTPDYVTKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29628 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 29629 - protein, 298 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGHPL

SEQ ID NO: 29630 - protein, 296 aa, Pennisetum glaucum
IIESVGEGVTDVAPGDHVLPVFTGECKECPHCKSAESNMCDLLRINTVRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 29631 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 29632 - protein, 296 aa, Pennisetum glaucum
IIESVGEGVTDVAPGNHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDVWLGCRCAGGCATQGCRVQDSPNELPEREDPEGNLLWQLQATHWPAQCGGAVYEEVEKFITHSVPFSEINKAFDLMAKGGGH

SEQ ID NO: 29633 - protein, 296 aa, Pennisetum glaucum
IIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLEAAEGARIAGASRIIGVDLNPSRFEEAKKFGCTEFVNPKDHNKPVQEVLADMTNGGVDRSVECTGNINAMIQAFECVHDVGLGCRCAGGCATQGCRVQDSPNELPEREDPEGNLLWQLQATHWPAQCGGAVYEEVEKFITHSVPFSEINKAFDLMAKGGGH

SEQ ID NO: 29634 - protein, 318 aa, Pelargonium x hortorum
MESFPVINMEKLNGEERAATMEKIKDACENWGFFELLNHGIPYELLDTVEKMTKEHYRKCMEQRFKEMVASKGLEGVEVEVEDLDWESTFFLKHLPESNISQVPDLQDEYRKVMKEFAAKLEKLAEELLDLLSENLGLEKGYLKKAFYGSKGPTFGTKVSNYPPCPKPDLIKGLRAHTDAGGLILLFQDDKVSGLQLLKDGKWVDVPPMHHSIVINLGDQLEVITNGKYKSIEHRVIAQSDGTRMSIASFYNPGSDAVIYPAPALLEKETEEKQVYPKFVFEDYMKLYSGLKFQAKEPRFEAMKAVEANVTLDPIRTA

SEQ ID NO: 29635 - protein, 318 aa, Arachis hypogaea
VMHRDLKPESFLFANKKENSPLKAIDFGLSVFFKPGEKFSEIVGSPYYMAPEVLKRNYGPEIDIWSAGVILYILLCGVPPFWAESEQGGAQAILRGLIDFKREPWPSISESAKSLVKQMLEPDPKLRLTAKQVLEHPWIQMLRRAPNIPLGDAVKSRLKQFSMMNRFQKKALRVIADFLSNEEVEDIKDIFQKMDTDNDGIVSIEELKAEFQNFGSQLAESEIQMLLEAVNTNGKGTLDYGEFVAVSLHLKRMANDEHLRKAFSYFDKDGNGYIEPDELRNALMEDGTDDCADVANDIFQEVDTDKDGRISYEEFVAM

SEQ ID NO: 29636 - protein, 168 aa, Nicotiana tabacum
MLVYQDLLSGDELPSDSFSYTELGNGVLWEVQGKWVVQGAVDVNIGANPSAEGADEDEGVDDQAIKVVDIVDTFRLQEQPSFDKKQFVAYMKKYIKNLTPKLGAEQEEVFKNNIQGATKYLLSKLSDLQFFVGESMADDTGMVFAYYKDGATDPTFLYLAHGLKEVKC

SEQ ID NO: 29637 - protein, 1562 aa, Mycosphaerella graminicola
MWGYSVDERKLQREDTNGPPTNQWHNAQRTGGTHPTEEVEGEGEGTWGENDVGGFTTRQAMEDYEALRKDLTQLSKTRSRDTQHSLKRTTTGQTAKSGRKSLTSRQATHTSEAAEQDVEAGPQEEVEESKKDDDDEDDFELDRFMREGHFEKRSDGTSDKRVGVVYKDLTVKGIGSTTSFVRTLPDAIIGTFGPDLFKIICRFVPALAKRTGETRTLLNGFTGCVRDGEMMLVLGRPGSGCSTFLKAISNNRETYAEVTGDVSYGGIPADKQKKMYRGEVVYNQEDDVHFATLNVWQTFIFALMNKTKKKETGNIPVIAEALMKMFGIPHTKYTLVGDDFVRGVSGGERKRVSIAETLASKSTVVCWDNSTRGLDASTALDYARSLRVMTDVSNRTTLVTLYQAGEGIYEVMDKVLVIDEGREIYSGPAKEARQYFIDLGYEAPERQTTADFLTAVTDPVERKFRKGYEHKAPKGPEALEKAFRESPNYQKVLEDITDYENYLKETDYNDAREFEDAVQDGKSKRVSNKSSYTVSFQRQVLACVKREAWLLWGDKTTLWTKLFIIISNGLIVGSLFYGESFDTSGAFTRGGALFFSILFLGWLQLTELMKAVSGRAVVKRHEDYAFYRPSAVTIARVVMDLPVILVQVLIFGIIMFFMTNMTISASQFFIYMLFVYITTILLTALYRMFASLSPEIDTAVRFSGIALNLLVIYTGYVIPRPQLLTKYIWFGWIYWINPLSYSFEAVITNEFAGRTMACAPSQLVPQGPGIDPAYQGCALAGADVNAQSVDGSAYLATQFNYSRSNLWRNFGVVIAFIVLYILVTVIATETVSFAGGGGGALIFKKSKKAKKQVKHAKHADEEKGGIAEDSSSSSKKNASLGDAPNEDKEDEALDKLTKSESIFTWKDVEYTVPYMGGERKLLNKVNGYAKPGVMVALMGASGAGKTTLLNTLAQRQSMGVVSGEMFVDGRPLGREFQRNTGFCLQGDLHDGTATIREALEFSAILRQDASVSREEKIAYVDTVIDLLELNDMQDAIISSLGVEQRKRLTIGVELAAKPSLLLFLDEPTSGLDSQSAYSIVRFLKKLASAGQAIVCTIHQPSSVLIQQFDMILALNPGGNTFYFGPVGENGKDVTKYFSDRGVDCPPHKNVAEFILETAAKPHKRKDGKKIDWNQEWVESQQAKDVLEEIDGLKQTRSHVSTSQKNKDDEKEFAASTMLQCTELLRRTFRQYWRDPSYLYGKFFVSVIVGIFNGFTFWQLGNTQQDMQNRMFTAFLIITIPPTIVNAVVPKFYTNMALWQAREYPSRIYGYFAFVTAQVVAEIPPAIIGAVLYWVLWYWPTGLPTDSSTSGYVFFMTLLFFLFQASWGQWITAFSPSFTVISNVLPFFFVMFSLFNGVVRPYASLPVFWRYWMYYVNPSTWWIGGVLAATLDGIPVQCAETETAHFDAPPGQTCASYAGAFAQSAGGYLLNPQDNTNCMYCPLSTGNQYLAQLNINASDKWRDLGIFVVFVFSNWFLVYFFIYTVRVKGWTFGFGPLFGALGKGVELIKKPFKKGEKKEQSEE

SEQ ID NO: 29638 - protein, 1499 aa, Mycosphaerella graminicola
MTARMASESKIDDFGDEKSNRHSPSNDTLMKEKNESPGDVSSPSSTSINERNKEVNCLARRFSEISGWNEIPSNPLEAAKGTELDPLSPNFKARTWVKSMLKFSKQDGRTPMRTGGVAFRNLSAHGFGLATDYQKDVGNIWLDSISIVKKLFGMEKSRRIDILQDFEGLLESGEMLVVLGPPGSGCSTFLKTLTGETHGFQVDKNSYMNFQGIPAGEMHSVFRSEAIYTAEVDIHFPQLTVGETLTFAARARTPRFIPGDVERNVYAEHMRDVVMAMYGISHTINTRVGNDYLRGVSGGERKRVTIAEASLSGAALQAWDNSTRGLDSANAVEFCKSVRLGCELGGSAAMVAIYQAPRAAYEQFDKVIVLYEGRQIYFGNIHAGKTYFEDLGFQCPDRQTTPDFLTSMTSAVERVVKPGWEDKVPRSPDEFAAAWKASPTRQKLIQDIEDYERRFPFKGEAYQQFVDSRKAQKAKSHRFKSPYTISYLQQCQVCLWRGYRRLCADPELLYTSLFMNSILALIVGTLFYNLKLTTASFYQRGAVIFFGTMMNAFGSSLEILTLYHQRPIVEKHERYALYHPSAEAVASMIMDLPYKISNCIIFNTVLYFMVNLRREPGAFFFFIFLAFITTLTMSMMFRTIASCSRTLSQAMTPSALILLWLLIFTGFAIPVDYMLGWCRWLNYIDPVAYAFESLMINEFSGRNYACKSDDLVPSYGTLAAQSQVCNAVGAVAGRDYVEGEAYINSAYSYYRSHKWRNIGIIFAFMVGFLTVYLVASENIRAKKSKGEVLLFQKGRIPAALKEKSQDEEMSEVNRVSSVMCRQMSNVEATDVILRQTAVFSWRNVCYDIKIKGEERRILDNVDGWVKPGTLTALMGVSGAGKTTLLDVLATRVTMGVISGEMLVDGRERDNSFQRKTGYVQQQDLHLATSTVREALNFSALLRQPASVSRQEKLDYVDEVIKLLDMQEYADAVVGVPGEGLNVEQRKRLTVGVELAAKPQLLLFLDEPTSGLDSQTSWAICDLMEKLKNSGQAILCTIHQPSAMLFQRFNRLLFLAKGGKTVYFGEVGPGAKILSTYFERNGGHPCPPDANPAEWMLEVIGAAPGSRTDIDWHQVWRASPEYAATQRELDHLKDNGALVRQPSMVESDNESFNAFAAGFWSQLREVLVRVALQYWRTPSYIYAKLSLCTLAGLFIGFIFYKAPLTHQGLTNQMLSIFMIFTLFSNVSQQIMPHFVLQRSLYEARERPSKTYSWQVFLISNILIELPWNAFAGLLFFLCYYYPIGLYANASPTDSVAERGGYFFLMILAFFLFTSTFTNLMIAGMDSAETSGNIATLLFSLCLIFNGILASPKTMPKFWLFLYRVSPFTYITGGLMSAGLMDQTTHCAANEFVTFQPDGGEGGGTTCGTYMDPYISGANGTVGKGGYILNPSADADCKYCSFNTTNHFLKLVSIDPADRWRDLGITWVYILVNVAGAVALYWLFRVPKGSKKKAEKKEKTG

SEQ ID NO: 29639 - protein, 281 aa, Shigella flexneri
  misc_feature (215)..(215): Xaa can be any naturally occurring amino acid
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSVESVDLAGTFSTYPNPHINFVQAFAVEMVITAILMGLILALTDDGNGVPRGPLAPLLIGLLIAVIGASMGPLTGFAMNPARDFGPKVFAXLAGWGNVAFTGGRDIPYFLVPLFSPIVGAIVGAFAYRKLIGRHLPCDICVVEEKETTTPSEQKASL

SEQ ID NO: 29640 - protein, 238 aa, Streptomyces reticuli
MPDSVSSLTFPPAFLWGAATSAYQIEGAVREDGRTPSIWDTFSHTPGKTAGGETGDIAVDHYHRYRDDVALMAELGLTAYRFSVSWSRVQPTGRGPVVQRGLDFYRRLVDELLARGIKPALTLYHWDLPQELEDAGGWPVRDTAFRFAEYAQLVGEALGDRVEHWITLNEPWCSAFLGYGSGVHAPGRTDPAASVRAAHHLNLGHGLAVSALRAALPARNQIAISLNSSVVRPLSQDP

SEQ ID NO: 29641 - protein, 286 aa, Solanum tuberosum
MTKEVEAVHEQAAEYSRKDYTDPPPAPLIDFEELTKWSLYRAVIADFIATLLFLYITVLIVIGYNIKPMLKPASVCGGVGLLGIAWAFGGMIFVLVYCTAGISGGHINPAVTFGLFLARKVSLIRAVLYMVAQCLGAICGVGFVKAFQSAYYNRYGGGVNVMAPGHTKGVGLAAEIIGTFVLVYVVFSATDPKRSARDSHVPVLAPLPIGFAVFMVHLATIPITGTGINPARSFGAAVIFNGDKAWDEHWIFWVGPFIGAFIAAVYHQYILRAGAIKALGSFRSNA

SEQ ID NO: 29642 - protein, 465 aa, Agrimonia parviflora
VGFKAGVKDYKLTYYTPEYQTKDTDILAAFRVTPQPGVPAEEAGAAVAAESSTGTWTTVWTDGLTSLDRYKGRCYNIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTVEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 29643 - protein, 465 aa, Alchemilla mollis
VGFKAGVKDYKLTYYTPDYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDYIEKDRSRGIYFAQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTI

SEQ ID NO: 29644 - protein, 465 aa, Amelanchier alnifolia
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29645 - protein, 465 aa, Aruncus dioicus
VGFKAGVKDYKLNYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 29646 - protein, 465 aa, Cercocarpus ledifolius
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLHLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29647 - protein, 465 aa, Chamaebatiaria millefolium
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29648 - protein, 465 aa, Connarus conchocarpus
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSIPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29649 - protein, 465 aa, Crataegus columbiana
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEDMMKRAIFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29650 - protein, 465 aa, Eriobotrya japonica
  misc_feature (377)..(377): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHXPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29651 - protein, 465 aa, Exochorda giraldii
VGFKAGVKEYKLTYYTPEYETKDTDILAAFRVTPQPGVPPEEAGAAVAAESSTGTWTTVWTDGLTSLDRYKGRCYHIEPVPGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29652 - protein, 465 aa, Fallugia paradoxa
VGFKAGVKEYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 29653 - protein, 465 aa, Filipendula purpurea
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVSYVKTFQGPPHGIQVERDKLNKYGRPLLGCTIKPKLGLSAKNYGRAVYECLRGGLDFTKDDENVNSQPFMRWRDRFLFCAEAIYKAQGETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELSAACEVWKEIKFEFEAMDTL

SEQ ID NO: 29654 - protein, 465 aa, Filipendula vulgaris
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPVSYVKTFQGPPHGIQVERDKLNKYGRPLLGCTIKPKLGLSAKNYGRAVYECLRGGLDFTKDDENVNSQPFMRWRDRFLFCAEAIYKAQGETGEIKGHYLNATAGTCEDMMKRAVFARELGVPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIRQACKWSPELSAACEVWKEIKFEFEAMDTL

SEQ ID NO: 29655 - protein, 465 aa, Fragaria x ananassa
VGFKAGVKDYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNDIIREACKWSPELAAACEVWKEIKFEFEAMDTL

SEQ ID NO: 29656 - protein, 465 aa, Holodiscus discolor
  misc_feature (76)..(76): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYXIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 29657 - protein, 465 aa, Kageneckia angustifolia
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29658 - protein, 465 aa, Prunus laurocerasus
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNLFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFVFCAEALFKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29659 - protein, 465 aa, Lindleya mespiloides
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSMPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29660 - protein, 465 aa, Lyonothamnus floribundus
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29661 - protein, 465 aa, Neillia sinensis
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29662 - protein, 465 aa, Neurada procumbens
VGFKAGVKDYRLTYYTPEYQTKDTDILAAFRVTPQPGVPPEEAGAAVAAESSTGTWTTVWTDGLTSLDRYKGRCYHIEPVAGEENQFICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRATFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29663 - protein, 465 aa, Osmaronia cerasiformis
  misc_feature (368)..(368): Xaa can be any naturally occurring amino acid
VGFKAGVKEYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNLFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIEKDRSRGIYFTQDWVSLPGVLPVXSGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29664 - protein, 465 aa, Physocarpus malvaceus
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29665 - protein, 465 aa, Potentilla fruticosa
VGFKAGVKDYKLTYYTPEYETKDTDILAAFRVTPQPGVPPEEAGAAVAAESSTGTWTTVWTDGLTSLDRYKGRCYHIEPVPGEETQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 29666 - protein, 465 aa, Purshia tridentata
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29667 - protein, 465 aa, Quillaja saponaria
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRNLATEGNEIIREASKWSPELAAACEVWKEIKFEFEAMDTL

SEQ ID NO: 29668 - protein, 465 aa, Rosa woodsii
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29669 - protein, 465 aa, Sorbaria arborea
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29670 - protein, 465 aa, Sorbus scopulina
VGFKAGVKEYKLTYYTPDYETKDTDILAAFRVTAQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29671 - protein, 465 aa, Stylobasium spathulatum
  misc_feature (316)..(316): Xaa can be any naturally occurring amino acid
VGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHXHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29672 - protein, 465 aa, Vauquelinia corymbosa
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVCARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 29673 - protein, 465 aa, Waldsteinia fragarioides
  misc_feature (205)..(205): Xaa can be any naturally occurring amino acid
VGFKAGVKEYKLTYYTPDYETKDTDILAAFRVTPQPGVPPEEAGAAVAAESSTGTWTTVWTDGLTSLDRYKGRCYHIEPVPGEESQFIAYVAYPLDLFEEGSVTNLFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWXDRFLFCAEAIFKSQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEVIREACKWSPELAAACEVWKEIKFEFEAVDTI

SEQ ID NO: 29674 - protein, 132 aa, Saccharomyces cerevisiae
MSGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKTAKASQEL

SEQ ID NO: 29675 - protein, 263 aa, Torenia fournieri
FFELLNHGISPEFMDTVERLTKDHYKKCMELRFKEMVASKGLEAVQSQADDIDWESTFYVKHLPESNISEIPDLDDDYRKVMKEFAAQIEKLAEELLDLLCENLGLEKGYLKKVFYGSKGPPFGTKVSNYPPCPKPDFIKGLRAHTDAGGIILLFQDDKVSGLQLLKDGEWVDVPPMKHSIVINLGDQLEVITNGKYKSVMHRVIAQTDGNRMSIASFYNPGTDAVIYSAPALVEKEEEKKDLYPKFVFDDYMKLYAGLKFQA

SEQ ID NO: 29676 - protein, 403 aa, Rhodopseudomonas palustris
MDLLESRIVIVGAGQAGARAAEALRAAGHRGAVTLIGDEPHPPYERPQLSKKMLLDQQADATFIRTTQEWSDLGVTLRTGTRAVTIDLNQRKLALSGGDDIGFDRLLIATGTRPRRLAALEGTKVAVHYLRGIDDALTLRPQLIEGHRVALVGGGVIGLEVAAAALSRGCEVTIIERADDLLPQIGSPSLIRFAHDMFVKRGAAILCKAELSGQQTHSLTLADGRVVDADVIVVGIGSEPAGELALQIGLAGVQVFVFDARGATECDHVVAAGDVAEQWSAIPRFAWLRLENWANAQNQAIATARAMAGLDSRYEAPSWFWSDQFDANIQVVGHPACANEIIRGDAGSARFSAISVRDGEVVGAVSVNNAKDMAMVRRLVASRKKVDPAALANPAFDLKRALV

SEQ ID NO: 29677 - protein, 440 aa, Aspergillus aculeatus
MRALFLLALGSIPALVSGQLSGSVGPLTSASTKGATKTCNILSYGAVADNSTDVGPAITSAWAACKSGGLVYIPSGNYALNTWVTLTGGSATAIQLDGIIYRTGTASGNMIAVTDTTDFELFSSTSKGAVQGFGYVYHAEGTYGARILRLTDVTHFSVHDVILVDAPAFHFTMDTCSDGEVYNMAIRGGNEGGLDGIDVWGSNIWVHDVEVTNKDECVTVKSPANNILVESIYCNWSGGCAMGSLGADTDVTDIVYRNVYTWSSNQMYMIKSNGGSGTVSNVLLENFIGHGNAYSLDIDGYWSSMTAVAGDGVQLNNITVKNWKGTEANGATRPPIRVVCSDTAPCTDLTLEDIAIWTESGSSELYLCRSAYGSGYCLKDSSSHTSYTTTSTVTAAPSGYSATTMAADLATAFGLTASIPIPTIPTSFYPGLTPYSALAG

SEQ ID NO: 29678 - protein, 214 aa, Azotobacter vinelandii
MSYYQQAFDVTSLPSWRALQEHRLAMQNFHMREAFLSDPGRFDEFSTSSCGLFLDYSKNLITPETRDLLVNLAREAGVEQAARAMFDGEPVNASERRPALHTALRRPVGDSLLIDGHNIMRDVHAALAQMTDIVGRIHNKLWRGYSDRAITDVVNIGIGGSYLGPELVSEALLPYTQHGVRCHYLANIDGSEFHELTARLNAETTCSSSPARPS

SEQ ID NO: 29679 - protein, 264 aa, Azotobacter vinelandii
MNAMQRRTKIVATLGPATETPEAIEGLVKAGVDVVRLNFSHGKAEEHQARATLVREMAAKHGRFVAILADLQGPKIRISRFADGKVLLEKGQTFVLDAALDKNAGDATRVGIDYEALITDSRPGDILLLDDGRVVLETREVKASELVCAVRVGGPLSNNKGINRQGGGLSASALTDKDCADIKTAAAMQVDYLAVSFPRDAADMQHARRLMQEAGGQRRAGGEDRARRGGGRRPGARRHHPRLRGGDGGARRPGRGDGTELDST

SEQ ID NO: 29680 - protein, 480 aa, Azotobacter vinelandii
MLSKERYKAAYVYWLCCIATLGGVMFGFSTGVISGSVELIQQYFHLSPAETGWIVSSIFVGCVLGALAAGKLADRIGRKSTLLLSTLAFAISAYGTTFADSFAIFSSARIVAGIGIGLASTVVPLYMGEIAPRDIRGKASGIWDLSLLGSQTLVFLVNFLIGKGMTEAWLVEVGWRWMMGAQFVPVALMLVCTLILPESPTWCIDTRRVERAIKVLSKIYPDLNHEEARQFFSARETAGGSLGLGVILRTPVLRYGLIVGCAIGVLQQFTGAAIVMYYAPVILQTGDMSKDALLFQTIFIGLFTGIASFVGMTLFDRFGRRPVMKFGTIGSIVGLLLISYSMYTHHSGYLSIFAALFFMAMFGISWSAGCWVLLSEIFPPRIRSHATGLAVTLMWAFNFLVTQFFPMINEIPVLQESFNGAFTMWIFVAFNLFCLFFLIRYLPETRGVALDDMEALIESHRRKLSRKTGETRTSIAVSDI

SEQ ID NO: 29681 - protein, 506 aa, Azotobacter vinelandii
MRYAHPGSEGAIVSYKVRYGNYIGGQFVPPVKGQYFTNSSPVTGEEFAEFPRSTAEDIEKALDAAHAAAGAWGRTSVQERAAVLLKIADRIEQNLEVLAVTETWDNGKPVRETLNADVPLSADHFRYYAGCIRAQEGSAGEINENTVAYHFHEPLGVVGQIIPWNFPLLMAAWKLAPALAAGNCIVLKPAEQTPLSITVLVELIGDLLPPGVLNIVQGFGREAGEALATSKRIAKIAFTGSTPVGAHILKCAAENIIPSTVELGGKSPNIFFEDIMQAEPAFIEKAAEGLVLAFFNQGEVCTCPSRALIQESIYDDFMKVVMKKVGQIKRGHPLDTDTMVGAQASSQQFEKILSYLEIARSEGAEVLTGGAAERLEGSLASGYYIQPTLLKGHNKMRVFQEEIFGPVVGVTTFKDEAEALAIANDTEFGLGAGLWTRDINRAYRMGRGIQAGRVWTNCYHLYPAHAAFGGYKKSGVGRETHKMMLDHYQQTKNLLVSYDINPLGFF

SEQ ID NO: 29682 - protein, 253 aa, Azotobacter vinelandii
MNGQCPTCAQDLQGCAFFFDVDGTLAEIQPRPELVFIPAAILAALGRLQTVGVPVAVISGRRLADLDQLFEPLRLPAAGVHGAERRGADGRLRQLNLDREALRRVGDELFQACARYPGLHLENKGLAFALHFRLAPELEAVARGLAEDFIRRYPALLTLQPGKCVFELKPRGASKGEVIREFMREPPFGGRVPVFIGDDLTDEAGFQAVNALGGHSFKVGPGETAARQRLDSVSAVEKWLDALVRPLKPEVYP

SEQ ID NO: 29683 - protein, 477 aa, Azotobacter vinelandii
MSSSVPVHRNYIDGAFVESAAHLEVFNPANGALLSRVPAASAEEVERALAAARAAQKDWARKPAIERAGHLRRIAAKIRADAGRIARTITLEQGKIASLAEVEVNFTADYLDYMAEWARRLEGEIIASDRPGENIFLFRKPLGVVAGILPWNFPFFLIARKMAPALLTGNTIVVKPSEETPNNCFEFARLVAETDLPRGVFNVVCGAGQVGGALSSHPGVDLISFTGSVETGARIMAAAAPNLTKLNLELGGKAPAIVLADADLELAVKAIRDSRIINSGQVCNCAERVYVQRQVAEPFIERIAAAMAATRYGDPLAEPEVEMGPLINRLGLEKIDAKVRTALAQGATLVTGGAIAERPGHHYQPTVLTGCRADTRIMREEIFGPVLPIQIVDDLDEAIALANDCEYGLTSSVFTRDLNKAMHALRELDFGETYINREHFEAMQGFHAGVRKSGIGGADGKHGLYEYTHTHVVYLQS

SEQ ID NO: 29684 - protein, 511 aa, Azotobacter vinelandii
MTALPKPLVLIILDGFGHSDSPAHNAIHAARTPVYDRLLATCPHGLISGSGMDVGLPDGQMGNSEVGHMNLGAGRVLYQDFTRVTKAIQDGEFFDNPAICAAVDRAVAAGKAVHILGLLSEGGVHSHQDHIAAMAELAVRRGAEKIYLHAFLDGRDTPPKSALSPLLTLDACFARLGKGRIATLIGRYFALDRDNRWDRIEQAYRLIVDGKAEYAAETAAAGLQAAYARDESDEFVKATAIGAPVRVEDGDAVVFMNFRADRARELSRTFVEADFKEFERPHVPRLAGFVTLTQYSASIPAPCAFPPTELTNVLGEYLANNGKTQLRIAETEKYAHVTFFFSGGREEPFAGEERILIPSPQVATYDLKPEMSAPEVTERMVEAIENRRYDVIIANYANGDMVGHTGVFEAAVKAVECLDASLGRIVAALEKVGGEALITADHGNVEQMRDESTGQAHTAHTCEPVPFIYVGKRALRIRAGGVLADVAPTMLKLLDLPQPREMTGRPLVEPA

SEQ ID NO: 29685 - protein, 286 aa, Azotobacter vinelandii
MSDYQETLYEGYGQRFRMDRLLHEVRTGHQHLVIFENARMGRVMALDGVIQTTEADEFIYHEMLTHVPILAHGAARRVLIVGGGDGGILREVCRHRSVERITMVEIDATVVEMCKEFLPEHSRGAFEDPRLNLVIDDGMRFVATTEDRFDVIISDSTDPIGPGEVLFSENFYQACRRCLNDGGILVTQNGTPFMQLGEVQTTAQRMNGLFADWHFYQAAVPTYIGGAMTFAWGACDAASRRLPPDILRQRFVGSGIVARYYNPEIHQGAFALPQYVLQAIGKPGNN

SEQ ID NO: 29686 - protein, 241 aa, Azotobacter vinelandii
MALVGLVLSGCDSQTNAELKTPAQKASYGIGLNMGKSLAQEGMDDLDSKAVAQGIEDAIGKKEQRLSDEELIEAFAALQKRAEERMAALGEENAKAGKKFLEENAKRTGVVTTASGLQYEVLKKADGAQPKPSDVVTVHYEGRLTDGSVFDSSIERGSPIDLPVSGVIPGWVEGLQLMHVGEKFKLYIPSDLAYGEQSPSPSIPANSVLVFELELLGIKDQPAEQPGGSAPDVEQGEAQGQ

SEQ ID NO: 29687 - protein, 291 aa, Azotobacter vinelandii
MAAAGLNRADLLQRAGLYPPPPGASDVLGLECAGVISEVGAGSHWQVGDRVCALLAGGGMAEEVVVDGRHALPAPEGLSLVEAAVLPEVYATAWLNLFKLGALKSGEKALIHAGASGVGSAGIQLCKAFGNPCWVSVGSAERLAYCESLGAQGGVLRTQDLEGLRDFAPFDVILDPIGARYAALDLDLLARDGRWVIIGLMGGREAQLDLAKLLGKRVQLIGSTLRNRDDAFKGELIDELRRHVWPLFAEGRLEPRLEHSFAAKDVDTAFETLASNNVSGKVALVIDDNLV

SEQ ID NO: 29688 - protein, 427 aa, Azotobacter vinelandii
MPFTANRDFQRDPRLVVAARGNYLTDAEGRQVYDSLSGLWCCGAGHGRREIAEAVTRQLGTLDYSPGFQFGHPLSFRLAEKIASLTPAGLDHVFFTNSGSECADTALKIARAYWRLKGKAGKTRLIGRARGYHGVNLGGTAVGGIGGNRKAFGPLSDVDHLPHTLLAENAFSRGLPAHGGAALADALLGLIELHDASNIAALIVEPMSGSAGVLVPPEGYLARLREICDRHEILLIFDEVITGFGRTGALFGAERFGVTPDILNLAKQLTNGAAPMGAVLVKGEIYDTFMRQELPEHAVEFAHGYTYSAHPVACAAALATLELLERDNLLQRAAELAPHFENALHGLRGARHLLDIRNCGLAGALQLAPRDGDALVRPFEAAMRLWRRGFYVRCGGDTLQFGPPFSSSAAELDRLFDAVGEVLGGLD

SEQ ID NO: 29689 - protein, 363 aa, Azotobacter vinelandii
MGPYTLKNRIVLPPLTRSRSSQPGNIPNDLMATYYRQRTGAGFMVTEGTQIEPRGQGYAWTPGIHSAEQVEGWRKVTDAVHAERGVIFAQLWHVGRVSHTSLQPGGEAPVAPSAIRADSVKVFIETGPGTGALAEPSTPRALTTAEVKELIQLYAQAARNALEAGFDGVELHCANGYLVNQFISAHTNRRDDEYGGSLHNRLRFLREITQAVADVVGKERMGVRFAPLFATTDEDRVYLGLVEEDPHQTYIEAVKILEDEGIAYLSLAEADWENAPELPEAFREDVRKTFSGKILYAGKYTAERGNRVIQAGWGDLIAFGRPFIANPDLPDRIANNWPLNPVDLTSMYGGTDKGYTDYPTYRP

SEQ ID NO: 29690 - protein, 486 aa, Azotobacter vinelandii
MRKIENFIAGEYVAAASGRRFDKRSPLDNRVIASIAEAGRAEVDAAVGAARGALAGDWGRLSTEQRVELLYGVANEITRRFDDFVEAEMADTGQPAHVMKQVFIPRGAANFKVFADVVKNVASESFQTATPDGRGALNYALRVPKGVIGVICPWNAPFMLMTWKVGPALACGNAVVVKPSEESPQTAALLGEVMNAVGIPKGVYNVVQGFGPDSAGEFVTQHPGVDAITFTGETRTGAAIMKAASEGMRDVSFELGGKNAGIVFADCDFEAAVEGIFRSAFLNSGQVCLGTERVYVERPIFERFVQALKVKAESVRFGRPDDHDANYGPLISQEHRQKVLSYYRKALEEGATLVTGGGVPEMPGELAEGAWVQPTIWTGLPESAAVVREEIFGPCCHIRPFDAEDEVVQLANATDYGLSTTLWTNDLARAHRLAARVEVGITWINSWFLRDLRTAFGGAKQSGIGREGGVHSLEFYTETRNVCVKL

SEQ ID NO: 29691 - protein, 481 aa, Azotobacter vinelandii
MIPVILSGGSGSRLWPLSRKQYPKQFLALTSERTLFQQTLQRLNFEGMQSPIVVCNQEHRFIVKEQLEAIGLNIQGLLLEPFGRNTAPAIALTAMKLLAEGRDELLLILPADHVIADQQAFQQALKVAAQAAEMGELVLFGIPAHSPETGYGYIKCDLAVQGTLPEGSNRVLQFVEKPDLARAREFVESGNYFWNSGVFLFRASRFLEELKEHDPDIYDNCLLTLERSEPHDDEVKIDPATFACCPDNSIDYAVMEKTRHACAVPLCAGWSDVGCWASIWEVHDKDENGNVVKGDVILHDTRDSLVHSNGKLVTVIGLDNVVVVETKDATMVVHKDRVQDVKKLVKILDDQGRKESLNHCQVYRPWGAYDSVDMGSRFQVKRITVKPGASLSLQKHHHRAEHWIVVSGTAQVTCDEKTFVLTENQSTYIPVAAVHRLANPGKIPLEIIEVQSGSYLGEDDIERLEDIYGRTEGVQSRSVAG

SEQ ID NO: 29692 - protein, 388 aa, Azotobacter vinelandii
MNDDARTRLVHAARPPKGPGGRPVNPPLTRLSTVLFDSVGEMREVRRRRDGERLLSYGARGNPTAFALEDLVSELEGGYRTKLFPTGLAAAAQTLLSYLRPGDQVLITESVYAPVRRVASELLEPFGIEVGYFAPDGRDLEAHLQANTRMVYTEVPGSLLYELCDLPAIAALCRPRGILLAVDNTWGSGYLYRPLALGADISVMALTKYLGGHGDVVMGSACTREEVWQPLSRMSDALGITVSPDDAWLVLRGARTLAARLEVHERQALEIARWLQRRPEVGRVHHPALPEHPGHALWRRDFAGSNGLLSFEFAEDDPALAARFVDALRLFGIGASWGGYESLAILAELSGRGALPTTASCIVRLHIGLDDSASLIADLEQALKAAVG

SEQ ID NO: 29693 - protein, 352 aa, Azotobacter vinelandii
MAVPRLELRHLVKTLGASRIVDGLDLAIAPGEVVVLLGPSGCGKTTTLRMVAGFLQPDEGEVHLAGRLAASARFALPPEKRHLGMMFQNYAVWPHKTVFQNVAYGLQVAGIARDEIRRRVERMLAIVDLDGHAGRKPADLSGGQQQRVALARALVTEPSLLLLDEPLSNLDAALRQSMRVELKALQRRVGVSMLYVTHDQDEALVLADRIVVMRGGRIEQIGTPEDIYRRPRTRFVAEFIGRANLLPGTLEALDGQGRARVRLDAGPVFRALGGPGLAAGQRCQVVVRPEQILFAPGGAEARLCQTLFLGSHYELTLELGESRLQAEARHLPAMQDGRLSVAIEDDSAWVLP

SEQ ID NO: 29694 - protein, 299 aa, Azotobacter vinelandii
MTVHFPTIAECIGNTPLVRLQRLPGETSNTLLVKLEGNNPAGSVKDRPALSMITRAELRGDIRPGDTLIEATSGNTGIALAMAAAIKGYRMILIMPDNMSAERKAAMTAYGAELLLVSKAEGMEGARDLALKMQGEGRGKVLDQFGNQDNPQAHYEGTGPEIWRQTQGRITHFISSMGTTGTIMGTSRYLKEQNPAIRIVGLQPQEGSAIPGIRRWPQEYLPKIFDASRVDQVIDMAQSEAEDTMRRLAREEGIFCGVSSGGAVAAMLRLSCEVENAVLVAIICDRGDRYLSTGVYDQP

SEQ ID NO: 29695 - protein, 386 aa, Azotobacter vinelandii
MTVLKMTDLDLKGKRVLIREDLNVPVKDGVVKSDARILASLPTIKLALEKGAAVMVCSHLGRPTEGEYSEENSLKPVADYLSGALGREVPLLGEYLDGVKVEPGQVVLFENVRFNKGEKKNADELAQRYAALCDVFVMDAFGTAHRAEGSTHGVARFAKVACAGPLLAAELEALGKALDNPQRPMAAIVAGSKVSTKLDVLNSLSQVCDQLIVGGGIANTFLAAAGYKVGKSLYEADLVDTAKAIAAKVSVPLPVDVVVAKAFAESAEATVKAIDEVADDDMILDIGPQTAAQFAELLKSSRTILWNGPVGVFEFDQFGNGTKVLAEAIAASPAFSIAGGGDTLAAIDKYGVGEKISYISTGGGAFLEFVEGKVLPAVAVLEERAR

SEQ ID NO: 29696 - protein, 501 aa, Azotobacter vinelandii
MTHSIPSIKLLIDGQFVESTTSQWREVVDPATQQVLARVPFASEAELNAAVASAAAAFKTWRKTSIGTRARLFLKYQQLIRENLKELAAILSAEQGKTLADAEGDVFRGLEVVEHAAGIGNLQLGELANNVAGGVDTYTLLQPLGVCAGITPFNFPAMIPLWMFPMAIATGNTFVLKPSEQDPMVTMRLVELALEAGVPPGVLNVVHGGAEVVDRLCDHPDIKALSFVGSSRVGAHVYQRASQAGKRVQCMMGAKNHAVVLPDAHKEQTLNSLAGAAFGAAGQRCMAISVAVLVGAARDWLPELVAKAATLKVGAGSKPGTDLGPLISRAALDRVGSLIEQGVREGARLELDGRNPVVAGYEQGNFVGPTLFSGVTPGMSLYREEIFGPVLCVMQAETLDEAIAIVNANPHGNGTALFTRSGAAARHFQEEIEVGQVGINVPIPVPVPIFSFTGSRASKLGDLGPYGKQVVQFYTQTKTVTQRWFDENEVGGPVNTTITLK

SEQ ID NO: 29697 - protein, 297 aa, Azotobacter vinelandii
MHIGFIGLGNMGAPMARNLLAAGHRLSVHDLSAPAVAGLAQAGATVADSPAALAREVELIITMLPASAHVKGVYLGEDGLLAQVRPGVMLIDSSTIDPLSAREVAAAAREHGNPMLDAPVSGGTAGAAAGTLTFMVGGETADFERARPVLAAMGKNIVHCGPAGNGQVAKVANNMLLGISMIGVAEAMSLGVALGMEPKVLAGVINSSSGRCWSSDSYNPFPGVMDNVPAAHGYSGGFGTDLMLKDLGLASEAARQARQPVILGALAQQLYQAFSAQGNGALDFSAIVNLYRKDANA

SEQ ID NO: 29698 - protein, 443 aa, Azotobacter vinelandii
MNAVKAGRKVAVVDDRPQVGGNCTHLGTIPSKALRHSVRQIMQYNNNPLFRQIGEPRWFSFADVLKSAEQVIAKQVSSRTGYYARNRIDTFFGTASFCDEHTIEVVHLNGMVETLVAKQFVIATGSRPYRPADVDFTHPRIYDSDTILSLGHTPRRLIIYGAGVIGCEYASIFSGLGVLVDLIDNRDQLLSFLDDEISDSLSYHLRNNNVLIRHNEEYERVEGLDNGVILHLKSGKKIKADAFLWSNGRTGNTDKLGLENIGLKANGRGQIQVDEHYRTEVSNIYAAGDVIGWPSLASAAYDQGRSAAGSITENDSWRFVDDVPTGIYTIPEISSVGKTERELTQAKVPYEVGKAFFKGMARAQIAVEKAGMLKILFHRETLEILGVHCFGYQASEIVHIGQAIMNQKGEANTLKYFINTTFNYPTMAEAYRVAAYDGLNRLF

SEQ ID NO: 29699 - protein, 162 aa, Azotobacter vinelandii
MQYVTPDLCDAYPELVQVVEPMFSNFGGRDSFGGEIVTIKCFEDNSLVKDQVDTDGKGKVLVVDGGGSLRRALLGDMLAEKAARNGWEGLVVYGCIRDVDVIAQTDLGVQALATHPMKTDKRGIGDLNVPVTFGGVTFRPGEYLYADNNGIIVSPQPLKMPE

SEQ ID NO: 29700 - protein, 413 aa, Azotobacter vinelandii
MAELGKRRFARIDRLPPYVFNITAELKMAARRRGEDIIDFSMGNPDGAPPAHIVEKLVQVARREDTHGYSTSRGIPRLRRAISHWYRDRYAVEIDPDSEAIVTIGSKEGLAHLMLATLDHGDSVLVPNPSYPIHIYGAVIAGAQVRSVPLVPGMDFFAELERAIRETIPKPKMMILGFPSNPTAQCVELDFFERVVALARQYDILVVHDLAYADIVYDGWKAPSIMQVPGAKEVAVEFFTLSKSYNMAGWRIGFMVGNQELVGALARIKSYHDYGTFTPLQVAAIAALEGDQQCVRDIAEQYRERRNLLVKGLHEIGWMVEKPKASMYIWAKIPEPYAHLGSLEFAKKLLAEAKVCVSPGLGFGDYGDDHVRFALIENLDRTRQAIRGIKAMFRADGLLEVTSEKARKSDASH

SEQ ID NO: 29701 - protein, 1054 aa, Azotobacter vinelandii
MFKASRVLQGNVLDTSAGEFFPFISANYCVDEAAWLNELLPLADPGEAGIAAIRERAGALIEAVRRRGNVEVTLDALLREYSLDTQEGLMLMCLAEALLRVPDPATAEALIRDKLSAAQWAQHLGHSDNLLVNFAAWGLLMTGRLVSPESSDGRPKKVIGRLLQRSGEPVIRAALNQAMKLMGNQFVLGRNIAEALRNARRARERGYGHSFDMLGEAALTEAAAERFLTDYRLAIEALGREPQVGGGPRPSISIKLSALHPRYEAAQRRRVLAELFASVRELAELARSLNVGITIDAEEADRLELSLELFEKLLCDPAIRGWGEFGLVVQAYSKRALPVLVWLTLLGRELDTRIPVRLVKGAYWDSEIKQCQVQGLEGYPVFTRKEGTDTSYLACARYLLGEHCRGVLYPQFATHNAHTVSCILAMAETHPPHDFEFQRLYGMGDALYDCLLERQQVQVRIYAPVGEHRELLPYLVRRLLENGANSSFVHRLVDPRIPVEALIGHPVEQLRRCSGLANPRIPLPVDIHGAGRKNSRGINLNVRSQWEPFERALRVQLEHRWQAAPLVDGQVLAGEVHEVRSPQDLDRVVGTVWFAGAELVDRAMARLAAAWPRWNATPMERRAAIFGRLADLLEEHRTELVALCILEAGKTIQDSLDEVREAVDFCRYYAQQARLTLKRTELRGPTGERNELFYEGRGLFVCISPWNFPLAIYLGQIVAALVAGNCVLAKPAEQTSLIAARALELLFAAGLPKEAIAFLPGDGPALGAACCADPHLAGVCFTGSTETARLINRRLAWRDGPLVTLIAETGGQNVMIVDSTALPEQVVKDALHSAFTSAGQRCSALRVLYLQNEIAGPVIELLRGAMAELRVGLPQRRDTDVGPLIDTQARQALLEHVDLLKGEERLLAEAGLAPALNGHFLAPLAFEIGGIGELRKEHFGPILHVVRYAAEDLEQVVAAINASGYGLTLGVHSRNEATARRIEALTRVGNLYVNRNQIGAVVGVQPFGGCGLSGTGPKAGGPNYLLRFVHERSTAINTAAVGGNASLLSLTERE

SEQ ID NO: 29702 - protein, 1003 aa, Azotobacter vinelandii
MAGATAATLGFAPGVANATQPRQYKLLRAKETRNNCTYCSVGCGVLMYSLGDGAKNAKPRIFHIEGDPDHPVSRGSLCPKGAGLVDFIHSEQRLQYPEYRAPGSDKWQRISWEEAIERIARLMKDDRDANFVEKNAAGVTVNRWLTTGMLCSSAASNETGALDWRFTRALGILGMDCQARLCHGPTVSALAPSFGRGAMTNNWVDIKNANVVLVMGGNPAEAHPVGFKWAIEAKIRNGAKLIVVDPRFNRSAAVADLYTPIRAGSDVTFLMGVVNYLIANDRIQHEYVRAYTNASLLVRDDFGFDEGLFSGYDEVKKQYDRSSWAYQLDENGHARRDPTLSHPRCVWNLLKQHVSRYTPEMVTRLCGTPKEDFLEICRLLGDTSAPDKTATFLYALGWTHHTSGVQIIRGAAMIQLLLGNIGMPGGGINALRGHSNIQGYTDLGLLSVRMPGYLNLPSERQPDLATYLAQSTPKALLPGQVNYWQNTEKFFVSLMKSVWGDKATRDNDWGFDWLPKWDVEYDVLRYMELMYEGKVNGYLAQGFNPIAAFPDKNKAVAALSRLKYLVVIDPLVTESSNFWQNHGEANDVNPAEIQTEVFRLPSSCFAEENGSIANSGRWLQWHWAGAAPPAEAWHDGKILGHLFLRLRELYEREGGANPAPLLNMAWNYSDPEDPAPEEVAREANGYALADLYDPQGNLLAKKGELLRDFSLLRADGSTASFCWVFAGSWTEAGNQMARRDNASDGQGLGSTPGWAWSWPQNRRILYNRASVDPQGKPWDPKRKLIEWNGQRWSGIDVADFAATVAPGSEANPFIMLPEGLGRLFAVGALGDGPFPEHYEPIESPLAENPLHPKVTFNPTTRLFDNDRQRMGTAADFPYVATTYSITEMFRHWTKASRLNAIVQPEQFVEIGEQLAAQKGIRAGDTVKVSSMRGFIKAKAVVTKRIATLEIDGQPVDTVGIPCHWGFTGTTRKGFLANTLTPAVGDANAQTPEYKAFLVNIEKV

SEQ ID NO: 29703 - protein, 468 aa, Azotobacter vinelandii
MSLNADWMQRDLAVLWHPCTQMKDHERLPLIPIRRGEGVWLEDFDGKRYLDAVGSWWVNVFGHANPRINARIREQLESLEHVMLAGFSHQPAIELSERLVAITPAGLSRVFYADNGSSGIEVALKMSFHYWRNCGRTGKKRFVTLTNSYHGETVAAMSVGDVALFTDTYKALLLDTIKVPSPDCYLRPEGMSWEAHSRAMFAHMERTLAEHRDEIAAVIVEPLIQGAGGMRMYHPVYLELLREACDRYEVHLIHDEIAVGFGRTGTLFACEQAGIVPDFLVLSKALTGGYLPMAAVLTTDTVYRAFYDDYASLRAFLHSHTYTGNPLACAAALATLDIFEQDNVIERNKALAARMARATEHLKDHPHVAEVRQTGMALAIEMVAEKAGKVAYPWQERRGLKVYEHALSRGALLRPLGSVVYFLPPYVITPEQIDFLAEVASEGIDLATRDAVGVALPTGGPQTFHDPG

SEQ ID NO: 29704 - protein, 390 aa, Azotobacter vinelandii
MVPNYAPAAFIPVRGQGSRVWDQNGRELIDFTGGIAVNSLGHCHPRLVAALTEQAGKLWHVSNIFTNEPTLRLAKKLEEATFADRAFFCNSGAEANEAAFKLARRVAHDRFGPQKCEIISALDSFHGRTFFTVSVTGQPKYSDGFGPKPEGITHVPYNDLAALEAAISERTCAVVLEPIQGESGILPAQQAYLEGARRLCDQYDALLILDEVQTGVGRTGELFAYMHYGVVPDILSTAKGLGGGFPIGAMLTRSDLAKHFSAGVHGTTFGGNPLACAVAEAVIDVVNTPEVLQGIKAKHQRFKTRLEAIGRQYGIFSQVRGMGMLIGSVLSEPWKGKARDVLVAAEQEALMVLQAGADVVRFAPSLVIEDADIDEGLERFERAIVRLVRG

SEQ ID NO: 29705 - protein, 504 aa, Azotobacter vinelandii
MTVNIADWLDAAARRWPARPALYEGERAVADYRAFAAAAAARASGLRDEHGIAPGDRVALFMHNACEYLELLYAIWWAGAVAVPINHKLHGDEAAWIAGDAQARLIFTDHGELFANGGLPAHCRELAGLGSERPERIDPALASPVRRGTDDLAWLFYTSGTTGRAKGVMLSHGNLLAMSLCYPVDVDPVEADDAYVYAAPMSHGAGLYNFIHVRCGARHVVPASRGFDAAELFGLAGTLGRLSLFAAPTMLKRMVGEARRRGYAGDGIKSIVCGGAPLYLADLREALATFGPRLIQIYGQGESPMTISALCRELIADRARADWPRLAASVGYPQSCVEVGVLDAAGDPLPPGRPGEVVVRGPCVMHGYWRDAAASAATLVDGWLRTGDIGYLDRDGLLTLTDRSKDVIISGGSNIYPREVEEVLALHPAIAEVSVVGEPDPEWGESVAAFVVLRPGERADAQALNAWFVARLASFKKPRRYLFVRELPKNGYGKILKTELRRCL

SEQ ID NO: 29706 - protein, 437 aa, Azotobacter vinelandii
MSNPSTSIQHVAAREILDSRGNPTVEAVVTLAGGATGVASVPSGASTGSREALELRDGALRYQGKGVMKAVDNVNGAIRERVVGLDALDQRAVDQAMLERDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKAFDSRGFADYLAGLCERYPIVSIEDGLDESDWAGWAYLTEKLGDKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCSR

SEQ ID NO: 29707 - protein, 113 aa, Azotobacter vinelandii
MSSELQIEDIQPGDGKAVVKGALITTQYNGYLEDGTKFDSSYDRGKPFQCVIGTGRVIKGWDQGLMGMRVGGKRRLFVPARLAYGERQVGAQIKPNSNLIFEIELLEVLTRDD

SEQ ID NO: 29708 - protein, 500 aa, Azotobacter vinelandii
MPDIQENLPLPLYSAAQVRELDARLIAAGTPGFELMRRAAHAAWRALRRRWPRAGAATVFAGRGNNAGDGYLVATLAQRAGWRVRVLAVGDPQQLQGDAALARDEARQAGVAIEPWSECAALDGVLVDALLGTGLGGAVREPYAQAIRQINASGLPVLAVDIPSGLSADTGCALGVAVRAGLTVTFIGLKLGLFTGEAPDHVGTLVFDDLAADPHIVAAQPVSARRLAVGGVACLAPRPRTAHKGHFGHVLVVGGDLGLGGAALLSAESALRAGAGLVSLATRDVHVPAALARRPELMSRGVESANQALALMTRADVLVVGPGLGQEAWGRSLLSAAAGLDRPQVWDADALNLLAAGAVGAPARGVLTPHPGEAARLLGSDIGTVQADRPAAAVALARRHGTVVVLKGAGSLVADPQGRLALCDHGHPAMAGAGLGDVLAGLVGALLAQGLEPFEAASLAVWLHARAGERLGAQGRGLVASDLFPAIRQLLEEHSPCLPD

SEQ ID NO: 29709 - protein, 431 aa, Azotobacter vinelandii
MLKKLFRLEAHGTTVRTELLAGLTTFLTMAYILFVNPGILGETGMDKGAVFVATALAAAIGSALMGLIANYPIALAPGMGLNAFFTYGVVLQMGHSWQVGLGAVFLSACLFFLISVLRIRQWIVDSIPLPLRLAIGAGIGLFLALIALQNAGIVEGHPVTLLTLGDLTQAPPILAALGFLLIVALEARRVPGAVLLGILAVTLAAVGLDVIPFAGVLAPPPSLAPTLLQLDIAGALEIGLVSVVFAFLFVDVFDNSGTLIAVARRAGLMTADGRLPKMGRALIADSAAAMGGALLGTSTTTSYIESAAGVSAGGRTGLTACTVALLFLLSLFFAPLAASIPPFATAPALLFVAVLMVSALGELDWSDLTSAAPALVTALAMPLTYSIANGIAFGFIAWSAIKLCTGRRHELNPALLILAALFVVKLGWFGA

SEQ ID NO: 29710 - protein, 395 aa, Azotobacter vinelandii
MSDAKVRFDCFDPLMLDQQLTETERMVRDAARAYCQEKLAPRIQEAFRQERTDREIFAEMGELGLLGATIPEAYGGAGMNHVCYGLIAREVERVDSGYRSMMSVQSSLVMLPINEFATQAQKEKYLPRLASGEWVGCFGLTEPNFGSDPGGMATRARKADGGYRLSGSKTWITNSPIADVFVVWAKTDDGRIRGFILEKGWQGLSAPAIHGKVGLRASITGEIVMDEVFVPEENMFPEVSGLKGPFTCLNSARYGIAWGALGAAEFCYETARQYTLDRAQFGRPLAANQLIQKKLADMLTEIALGLQACLRVGRLKDEGNAPVEATSIIKRNSCGKSLDIARMARDMLGGNGISDEFGVARHLVNLEVVNTYEGTHDIHALILGRAITDIAAFAN

SEQ ID NO: 29711 - protein, 452 aa, Azotobacter vinelandii
MAYDFDLFVIGAGSGGVRAARFAAGFGARVAVAESRYLGGTCVNVGCVPKKLLVYGAHYAEDFEQARGYGWSLGEARFDWAGLVANKDREIQRLNGIYRKLLTDSGVTLLEGHARLTDAHGVEVNGQRYSAEHILVATGGWPVVPDIPGREHAITSNEAFHLPACPERVLVVGGGYIAVEFASIFHGLGAKTSLLYRGELFLRGFDAAVREHLRDEMLKRGLDLQFNADIARIDRQADGSLRATLRDGRSLESDCVFYATGRRPMLDDLGLEEIGVELDERGYIRVDELYRSSQPSILAIGDVTGNVQLTPVALAEGMAVARRLFRPEQYRPVDYRLIPTAVFSLPNIGTVGLTEEQARKAGYRVKIFESRFRPMKLTMTDSQERSLMKLVVDAASERVLGCHMVGPEAGEILQGLAVALKAGATKQVFDETLGIHPTAAEEFVTMRIPVDR

SEQ ID NO: 29712 - protein, 232 aa, Azotobacter vinelandii
MAGLDKRVNTYEEALAGLTDGMTVLAGGFGLCGIPENLIAEIRRRRVKGLTVVSNNCGIDGFGLGVLLEERQIRKMIASYVGENALFERQLLDGELEVELTPQGTLAEKLRAGGAGIPAFYTATGYGTPVAEGKEVREFRGRRYILEEAISGDFAIVKGWKADHFGNVVYRHTAQNFNPVVATAGRITVVEVEEIVEPGELEPSQIHTPGIYVDRVILGHFEKRIEQRTVRA

SEQ ID NO: 29713 - protein, 481 aa, Azotobacter vinelandii
MQRRTKIVATLGPATETPEAIEGLVKAGVDVVRLNFSHGKAEEHQARATLVREMAAKHGRFVAILADLQGPKIRISRFADGKVLLEKGQTFVLDAALDKNAGDATRVGIDYEALITDSRPGDILLLDDGRVVLETREVKASELVCAVRVGGPLSNNKGINRQGGGLSASALTDKDCADIQTAAAMQVDYLAVSFPRDAADMQHARRLMQEAGGNAGLVAKIERAEAVADDQVLDGIILASEAVMVARGDLGVEIGDAELVGVQKRIIERARVLNRAVITATQMMETMITQSLPTRAEVFDVANAVLDGTDAVMLSAETAAGAYPVETVEAMGRIILGAEQHPLAHRSKHRMDQVFHRIDETIALSAMYAANHLEGVKAIVCLTESGDTPRLMSRIRSHLPIYAFSRHPRTQSRVALFRGVHPIPFEADRIAEAELNARAVKELLQRRLVAEGDRVLITKGAGHAQGGTDTLRIVRVGDVIQ

SEQ ID NO: 29714 - protein, 375 aa, Azotobacter vinelandii
MAKRDYYEVLGVERGAGEAELKKAYRRLAMKYHPDRNPDDKSAEEKFKEVNEAYEVLSDAGKRMAYDQYGHAGVDQSMGGGAGFGAGGANFSDIFGDVFSDFFGAGRAGARGGPQRGSDLRYTLELNLEEAVRGTTVTIRVPTLVHCKTCDGSGAKKGTTPVTCTTCGGIGQVRMQQGFFSVQQTCPRCHGSGKMIADPCPDCHGQGRVEEHKTLSVKVPAGVDSGDRIRLAGEGEAGTLGGPPGDLYVVVSVREHPIFQRDGKHLYCEVPISFADAALGGELEVPTLDGRVKLKIPEGTQTGKLFRLRGKGVAPVRGGAAGDLMCRVVVETPVNLSKRQRELLEEFRGSLQGNSSHSPKASGWFEGMKRFFDDL

SEQ ID NO: 29715 - protein, 438 aa, Azotobacter vinelandii
MSNPSTSIQHVAAREILDSRGNPTVEAVVTLAGGATGVASVPSGASTGSREALELRDGALRYQGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALQGKAPYDASALLKRRCCRGR

SEQ ID NO: 29716 - protein, 133 aa, Azotobacter vinelandii
MKDWLDEIHWNADGLVPAIAQDHRTGRILMMAWMNRESLALTVRENRAIYWSRSRGKLWRKGEESGHVQKVHELRLDCDADVIILQVEQLGGIACHTGRESCFYRVFEDGAWKVVDPILKDPDAIYRAGHPHE

SEQ ID NO: 29717 - protein, 473 aa, Azotobacter vinelandii
MTERLNNDFQFIEVGRKDPKKKLLRQRKKEFVEIYDLFKPQQAQEQAHRCLGCGNPYCEWKCPVHNFVPNWLKLVSEGNILAAAELSHQTNTLPEVCGRVCPQDRLCEGACTLNDGFGAVTIGSVEKYITDTAFAMGWRPDMSKVTPTGKRVAVVGAGPAGLGCADILARNGVTPVVFDRNPEIGGLLTFGIPEFKLEKSVMSRRREVFAGMGVEFRLNTEVGKDVTMQQLLDEFDAVFLGMGTYTYMKGGFPGEDLPGVYDALDFLIANVNRNLGFEKSPEDFIDMKGKKVVVLGGGDTAMDCNRTSIRQGAKSVTCAYRRDEENMPGSRREVKNAKDEGVKFLYNRQPIAIVGEDRVEGVKVVETRLGEPDARGRRSPEPIPGSEEILPADAVVIAFGFRPSPAPWFEALQIKTDSQGRVIAPLHDNPFKHQTSNPKVFAGGDMVRGSDLVVTAIYEGRQAAEGILDYLGL

SEQ ID NO: 29718 - protein, 327 aa, Azotobacter vinelandii
MRKLGSSGLEVSALGLGCMGLSHGYGPATDTGQAVSLIRAAVERGVTFFDTAEVYGPYLNEEVVGEALAPVRERVVIATKFGFTFGDDNKQQILDSRPEHIRWAVEGSLKRLRTDHIDLLYQHRVDPEVPIEDVAGMVKELIAEGKVKHFGLSEAGAQTIRRAHAVQPVTALQSEYSLWWREPEQEILPTLEELGIGFVPFSPLGKGFLTGAIGASTTFGSDDFRSTVPRFSPQALQANQALVESLGRIASDKGVTPAQVALAWLLAQKPWIVPTPGTTKLHRLEENLGAASIELTEADLGKIATALKQVKIQGDRYPAALQARVGR

SEQ ID NO: 29719 - protein, 361 aa, Azotobacter vinelandii
MGFAQQTTAGTGGRAKADIHSARRRPGALEVSALGLGCMSMNGGQYNPPGDKREMIRVIHAAIDRGVDFFDTAEVYGPFINEELLGEALAPYRDKAVIATKFGFGIDPASALRIGGLDSRPEHIRAVAETSLRRLRTDRIDLFYQHRVDPAVPIEDVAGTVKDLIAEGKVKHFGLSEPGLQTVRRAHAVQPVAAIQNEYSLLWRGPELGLLESCEELGIGLVPWSPLGAGLLTGTLDADTRFDAPGYTDYRRTNPRFAPEALTGNMALVELAREWAQRKEATPSQIALAWLLAQRPWIVPIPGTTNIQHLDENLGAINLQFSAAEMQAFNTALAQIVVHGERGTPRLLEMVGRDTPLPKGR

SEQ ID NO: 29720 - protein, 215 aa, Azotobacter vinelandii
MRVILLGAPGAGKGTQARFITERFGIPQISTGDMLRAAVKAGSPLGLKVKGVMDSGGLVSDDIIIDLIRERIAQPDCARGFLFDGFPRTIPQAEALRDAGVSIDHVLEIAVDDEEIVSRMAGRRVHAASGRVYHDLHNPPKVAGKDDETGEDLIQREDDKEETVRHRLALYHSQTKPLVDFYQRLAATTGTPRYTRVEGIGSVSEITARVQAALA

SEQ ID NO: 29721 - protein, 365 aa, Azotobacter vinelandii
MSDQDQLKALRVRIDSLDEKILELISERARCAEEVARVKMASLKPGESPVFYRPEREAWVLRHIMEINKGPLGNEEVARLFREIMSSCLALEHPLKVAYLGPEGTFTQAAALKHFGHAVISLPMAAIDEVFREVAAGAVNFGVVPVENSTEGAVNHTLDSFLEHDLVICGEVELRIHHHLLVGENTRTDKISRIYSHAQSLAQCRKWLDAHYPSVERVALSSNADAARRVKSEWNSAAIAGDMAAQLYGLTKLAEKIEDRPDNSTRFLIIGNQEVPPIGDDKTSIIVSMNNKPGALHALLMPFHENGIDLTRIETRPSRSGKWTYVFFIDFVGHRHDPLVKSVLERLSQEVVALKVLGSYPKAVL

SEQ ID NO: 29722 - protein, 232 aa, Azotobacter vinelandii
MNKLYPSAQTALDGLVEDGMTLAVGGFGLCGIPEALIAALRDSAKGGLTVISNNAGVDDFGLGLLLATRQIRKMISSYVGENKEFERQYLAGELELEFTPQGTLAEKLRAGGAGIPAFYTRTGYGTLVAEGKETRQFDGEWYVLEKSLTADIALVKAWKADKAGNLLFRKTARNFNPLAAMAGRVCVAEVEEVVETGELDPDRIHLPGIYVQRIVLNPNPEKRIEQRTLRSA

SEQ ID NO: 29723 - protein, 205 aa, Azotobacter vinelandii
MSELNLSTDEARVSYGIGRQLGDQIRDNPPPGVELEAILAGLADAFGGQASRVEPAALSASFKVIRERMQAETQAKAEAAAASGVSFLAENARREGVTVLASGLQYEVLKAGEGRKPGREDRVRTHYHGTLIDGSVFDSSYQRGQPAEFPVNGVIAGWTEALQLMNSGSKWRLYVPSELAYGDQAIGSIPPHSVLVFDVELLDVL

SEQ ID NO: 29724 - protein, 483 aa, Azotobacter vinelandii
MQLNDARLFRQQAYIEGRWVDADGGQTLAVNNPASNEILGGVPKMGAAETRRAIEAAERALLAWRALTAKERAGKLRCWFELLLEHQDDLARLMTLEQGKPLAEARGEIAYAASFLEWFAEEAKRIYGDTIPGHQADKRILVIKQPVGVCAAITPWNFPAAMITRKAGPSLAAGCTLVLKPASQTPFSALALAELAERAGIPAGVFNVVTGSAAEIGGELTANPIVRKLSFTGSTEIGRQLMAQCARDIKKVSLELGGNAPFIVFDDADLDAAVEGALASKYRNAGQTCVCANRLYVQDGVYDAFAEKLRAAVARLKVGNGLEEGVSIGPLIDDKAVGKVEEHIADAVSRGARVIAGGRPHALGGTFFEPTILAEVPADARVAREETFGPLAPLFRFGDDDEAIALANATEFGLAAYFYARDLSRVFRVAESLEYGIVGVNTGLISTEVAPFGGVKASGLGREGSKYGIEDYLEIKYLCLGGI

SEQ ID NO: 29725 - protein, 457 aa, Azotobacter vinelandii
MKDATGNPQTRHWQALGHAHHLPPFSDYRQLKEHGPRIITRASGVYLWDSEGNCILDGMAGLWCVNVGYGREELVEAASRQMRELPYYNLFFQTAHPPAVELARAIAELAPPGMHHVFFTGSGSEANDTVLRLVRHYWAIKGQPRKNVVIGRWNGYHGSTVAGASLGGMKAMHGQGDLPIPGIEHIDQPYWFGEGGGLDPEAFGIRVADQLERKILEIGEERVAAFIAEPIQGAGGVIIPPDSYWPRIREILRKYDILFAADEVVCGFGRTGEWFGSQYYGLEPDLMAIAKGLTSGYLPMGGVVVRDRIVEVLEEGGEFYHGFTYSGHPVAAALALENIRLLREEGIVERVRTRTGPYLQRRWRELAEHPLVGEVRGLGMLAALELVKDKKTRERFPADLAAGMRCREHCFANGLVMRAVGDTMIVAPPLVISEAEIDELIAKARHCLDLTASEMPG

SEQ ID NO: 29726 - protein, 159 aa, Azotobacter vinelandii
MIDPDGFRPNVGIILTNDIGQVLWARRINQDAWQFPQGGIDARESPEEALFRELNEEVGLEPQDVRILACTRGWLRYRLPQRLVRSHSQPLCIGQKQKWFLLRLLSDEQRVRMDLTGKPEFDGWRWVSYWYPLGQVVAFKREVYRRALKELAPRLLARD

SEQ ID NO: 29727 - protein, 337 aa, Azotobacter vinelandii
MAPYTFERRELRPDDVALEILYCGVCHSDLHTARNDWGMSYYPIVPGHEIVGRVIETGTQVTGFKAGDYVAVGCMVDSCRECDQCRKGDEQLCRQGPIYTYSGHDRISGEPTQGGYAKHLVVSEAFCLHMPEGLDLAKAAPLLCAGITTYSPLRTWNVGSGSRVGVIGLGGLGHMAVKLAVGLGAEVTVLSRSADKRADALALGAARLLVSADEGAMAEAAGSFDLIIDTVPAKHDLDPYLPLLDVDGTLVIVGQLGPMSDFSTVPLLSGRRRVAGSPIGGIRETQELLDFCAKKNILPDCEMIRMDQINEAFERMEKADVRYRFVIDMASLSAAAA

SEQ ID NO: 29728 - protein, 325 aa, Azotobacter vinelandii
MSRIYADNAQSIGNTPLVKINRLAPQGVTILAKIEGRNPSYSVKCRIGANLVWDAEASGRLKPGMTLVEPTSGNTGIGLAFVAAARGYRLILTMPASMSLERRKVLKALGAELVLTEAAKGMKGAIEKATEIAAADSGLYFMPQQFDNPANPAIHEKTTGPEIWNDTDGAVDVLVAGVGTGGTITGVSRYIKQTCGKPLLSVAVEPAGSPVISQTLAGEEVKPAPHKIQGIGAGFVPKNLDLTLVDRVERITDDEAKDMALRLMREEGILCGISSGAAMAAAVRLAEHEPALQGKTLVVILPDSGERYLSSMLFEGLFSEQELTQ

SEQ ID NO: 29729 - protein, 439 aa, Azotobacter vinelandii
MGGLLFGYDTGIIGVALLGLSQDFVLNDTLKQFVTGAIIFGALFGCLLTGPISDRIGRRRTIIGVGLVFALGSLLSALSPSVGFLVVSRFLLGLSAGSSTQIIPVYIAEVAPPQHRGKLVVLFQLMVMTGITVAYFTGFALGEHWRWMFGLGVVPALILLAGMAILPESPRWLLVRGREAAALSVLTHVRGDAHWAARELEEIKTVSREPQGTWRDLRLPWIRPAVIVGGAIAMFSQITGVNAMIYYAPTILTQAGFSTDTAVLATGSSTILVVLMTWFGSVLVDRIGRRRYLLWLIPGSIAALIGMGLLFQSGGPTTTLEQWLVVLCLAGYLMLNCGGFGVCIWLINSEVYPLFIRGKGASVGAFSHWFFDLLVTLTTLSLVTALGAANTFWMYAAISTGALLFIWRYVPETRGKSLEQIEHELREHRFYPFQQKTEH

SEQ ID NO: 29730 - protein, 439 aa, Azotobacter vinelandii
MSNPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGQYRLAGEGKTFDSRGFADYLAGLCERYPIVSIEDGLDESDWAGWAYLTEKLGQKVQLVGDDLFVTNPKILREGIEQGIGNSILIKFNQIGSLSETLEAIRLAQQAGYTAVISHRSGETEDTTIADLAVATRAGQIKTGSLCRSDRVGKYNQLLRIEEALKGKAPYDASALLKRRCCGGKA

SEQ ID NO: 29731 - protein, 481 aa, Azotobacter vinelandii
MLRRTKIVATLGPATETPEAIEGLVKAGVDVVRLNFSHGKAEEHQARATLVREMAAKHGRFVAILADLQGPKIRISRFADGKVLLEKGQTFVLDAALDKNAGDATRVGIDYEALITDSRPGDILLLDDGRVVLETREVKASELVCAVLVGGPLSNNKGINRQGGGLSASALTDKDCADIQTAAAMQVDYLAVSFPRDAADMQHARRLMQEAGGNAGLVAKIERAEAVADDQVLDGIILASEAVMVARGDLGVEIGDAELVGVQKRIIERARVLNRAVITATQMMETMITQSLPTRAEVFDVANAVLDGTDAVMLSAETAAGAYPVETVEAMGRIILGAEQHPLAHRSKHRMDQVFHRIDETIALSAMYAANHLEGVKAIVCLTESGDTPRLMSRIRSHLPIYAFSRHPRTQSRVALFRGVHPIPFEADRIAEAELNARAVKELLQRRLVAEGDLVLITKGAGHAQGGTDTLRIVRVGDVIH

SEQ ID NO: 29732 - protein, 356 aa, Azotobacter vinelandii
MSIFQSGQIGNLALANRIVMAPLGRARSDVQSRVPLPRVATYYSQRAGAGLIVSEATHVSPNSVSRPGGSAIHTAEQVEGWKAVTAAVHAAGGRIFQQLFHLGRKAHQGRLPGNALPVAPSAIAAQGEVETPQGPQPFPVPRALERAEIPALVEEFRQAARNSLLAGFDGVEIHAANGYLIDQFLRDGSNRRQDDYGGSVANRARLLLEIVDAVIGVFGPGRVGVRISPHFEVDGIGDSDPAALYTHVAEQLQARGIAYLHLIEPDSVEPARRLAPRLRQLFRGAFILAGEFDRARAIRALAEGRADFVAFGRLFIANPDLVERLRREAPLNPPDEATFYSGEEHGYIDYPFLAVG

SEQ ID NO: 29733 - protein, 437 aa, Azotobacter vinelandii
MSKPSTSIQHVAAREILDSRGNPTVEAVVTLAGGATGVASVPSGASTGSREALELRDGALRYKGKGVMKAVDNVNGAIRERVVGLDALDQRAVDQAMLELDGTDNKAILGANAILAVSLATARAAAAARGLPLYAHLAELYGSPGEYSLPVPMMNILNGGEHADNNVDLQEFMIQPVGAASFKEALRIGAEVFHTLKQVLAERGLSTAVGDEGGFAPSLSSNEEALVVIQAAVERAGYVLGQDITLALDCAASEFYHDGEYRLAGEGKTFDSRGFADYLAGLCERYPIVSIEDGLDESDWVGWAYLTEKLGQKVQLVGDDLFVTNPKILREGIERGIGNSILIKFNQIGSLSETLEAIRLAQQAGYTAVISHRSGETEDTTIADLAVATRAGQIKTGSLCRSDRVGKYNQLLRIEEALQGKAPYDATALLKRRCCSR

SEQ ID NO: 29734 - protein, 507 aa, Azotobacter vinelandii
MLEESIRPACTAGTGAQTLAQRERIGLQRRTKIVATLGPATETPEAIEGLVKAGVDVVRLNFSHGKAEEHQARATLVREMAAKHGRFVAILADLQGPKIRISRFADGKVLLEKGQTFVLDAALDKNAGDATRVGIDYEALITDSRPGDILLLDDGRVVLETREVKASELVCAVLVGGPLSNNKGINRQGGGLSASALTDKDCADIQTAAAMQVDYLAVSFPRDAADMQHARRLMQEAGGNAGLVAKIERAEAVADDQVLDGIILASEAVMVARGDLGVEIGDAELVGVQKRIIERARVLNRAVITATQMMETMITQSLPTRAEVFDVANAVLDGTDAVMLSAETAAGAYPVETVEAMGRIILGAEQHPLAHRSKHRLDQVFHCIDETIALSAMYAANHLEGVKAIVCLTESGDTPRLMSRIRSHLPIYAFSRHPRTQSRVALFRGVHPIPFEADRIAEAELNARAVKELLQRRLVAEGDRVLITKGAGHAQGGTDTLRIVRVGDVIH

SEQ ID NO: 29735 - protein, 485 aa, Azotobacter vinelandii
MNDKTVAPQQHDISYVLRICAVAALGGLLFGYDTAVISGAVEALQQYFSLSPAETGWAVSNVVVGCIVGALGAGWVAGRLGRKKALVLSAILFTVSAIGAAVVDSFVWFVIYRIVGGLAVGIASTVSPMYMSEVSPKDIRGRALGMQSFAIVGGQVVVFYVNYLIAKGAADTWLVEYGWRWMLGSEVVPCILFCLFVFSIPESPRWQAMVGQDERALRTLRRISNDAHAHHLLNEIKHSLHQDSQGRTQKPNLREAGLALILFVGCMLAMLQQVTGVNVMMYYAPMVLKGVTGSTESALFQTIWIGVMQLVGTIIGTWLIDRVGRLPLMRVGTVGIVASLLLTSYALYAQESGYLALIGMLLFMVLFAISWGVGTWVLISEIFPNHMRSMGMSMAVCSMWIANFLVTQSFPMLNEHPVLIERFHGAFPMWVFAGCCVFCYWFVARFVPETRGVSLERMEEVMLAKLKRQPLADEEESAALRSSRA

SEQ ID NO: 29736 - protein, 334 aa, Saccharomyces cerevisiae [sequence omitted]

SEQ ID NO: 29737 - protein, 351 aa, Saccharomyces cerevisiae
MPSQVIPEKQKAIVFYETDGKLEYKDVTVPEPKPNEILVHVKYSGVCHSDLHAWHGDWPFQLKFPLIGGHEGAGVVVKLGSNVKGWKVGDFAGIKWLNGTCMSCEYCEVGNESQCPYLDGTGFTHDGTFQEYATADAVQAAHIPPNVNLAEVAPILCAGITVYKALKRANVIPGQWVTISGACGGLGSLAIQYALAMGYRVIGIDGGNAKRKLFEQLGGEIFIDFTEEKDIVGAIIKATNGGSHGVINVSVSEAAIEASTRYCRPNGTVVLVGMPAHAYCNSDVFNQVVKSISIVGSCVGNRADTREALDFFARGLIKSPIHLAGLSDVPEIFAKMEKGEIVGRYVVETSK

SEQ ID NO: 29738 - protein, 1094 aa, Saccharomyces cerevisiae
MNMDSGITSSHGSMDKTQKQSSEWAANQKHNQRVENTRVLMGPAVPAMPPVPSNFPPVPTGTIMSPQLSPFPDHRLRHHPLAHMMPADKNFLAYNMESFKSRVTKACDYCRKRKIRCTEIEPISGKCRNCIKYNKDCTFHFHEELKRRREEALNNKGNGKSVKKPRLDKENKFKDENFDIAVRSRNTSSTDSSPKLHTNLSQEYIGVSAGKSASDKEDTWPDFVPIDRTVLEKIELNHTKVAGKVFVLEEICKNMKGTIEKLAEKSKIDVIDKEYMKRPKRKQYSKALLTKQKMFHFRQNVLSHLTDEEFLSPINEMFTTTFKYSILQTKLVLDFSFRSASSPSSDNILYPLPRLAIAKRLLKNIKCPSLASLLHIVDVDQCLQFADVHFDPAKGRLTSSQAFLLNICLCLGATVTNFEEKQELVDEDNHETYYFEKFELWRLRSFTFLNSVYYYHKLSVARADMTALKALLLLAKFAQQKISASSAVKVLSVAIKVALDLRLNLHSTYEDLELDEIIKRRRLWCYCFSTDKFFSVVLSRPPFLKEENTDVLTDESYVELFRDKILPNLSIKYDDSKLEGVKDIVSVVNLLANHLEYVPYIQSYFLSRLSLIESQIYYSCFSIRTTLDDTLDEIIENVLENQKALDRMRDDLPTILSLENYKENMRILSLDSSKLDFEVSCCTTILLHLRWYHQKITLSLFVISIIGDNLDQRESSRHDIAEIIRRSRLDFKRNCIEVLNILKDFEYYPTVQNEFLYFSLTTVFSMFLYLSEIMVNDEHAMETGYIIGLLRDTHTRMLGSEERCLSVHNLKWQTSLFFYTFFLRSTMEKFNLTSKYAKFYAFDSNYYEGVLNRLVKHTRESKDDMVELLKTSFINKEKMAAFGSFVTEDQEKMEVSFNIFNEITIQDLNFLQFSSIPKLWENKTLEPGEEYHHSNGTNTDNNETTGADDTDDNNNNNNNNNKNGNNSSSTINNNNNNYSNSNNNDNDNNINDDDDDDDDDDDDDDDDDDDDDNDDDYSNNGADDDEEDDDYDRSLFPTGLASLLDASYPERTANDYRDENEQSNKLFEKIEGHLEHGVFFYDRDFFFKNVCVKM

SEQ ID NO: 29739 - protein, 156 aa, Haemophilus influenzae
NRTNTPVLVDGKDVMPEVNAVLAKMKDFCQRIISGEWKGYTGKAISDVVNIGIGGSDLGPYMVTEALRPYKNHLNMHFVSNVDGTHIAETLKKVNPQTTLFLVASKTFTTQETMTNAQSARDWLLKAAKNESAVAKHFAALSTNAKDVEKFGIDTN

SEQ ID NO: 29740 - protein, 156 aa, Haemophilus influenzae
NRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKNESAVAKHFAALSTNAKDVEKFGIDTN

SEQ ID NO: 29741 - protein, 488 aa, Saccharomyces cerevisiae
MAETERLMPNGGSRETKPLITGHLILGTIVACLGSIQYGYHIAELNAPQEFLSCSRFEAPDENISYDDTWVGQHGLKQCIALTDSQYGAITSIFSIGGLFGSYYAGNWANRYGRKYVSMGASAMCMVSSLLLFFSNSYLQLLFGRFLVGMSCGTAIVITPLFINEIAPVEWRGAMGSMNQVSINLGILLTQTLALKYADSYNWRWLLFSGSVIAVANILAWLKVDESPRWLVSHGFVSEAETALFKLRPGTYQQAKQEIQDWQRSHGHNRDPESSEETHSGPTLWQYVTDPSYKKPRTVILAILSCQQFCGINSIIFYGVKVIGKILPDYSIQVNFAISILNVVVTLAASAIIDHVGRRPLLLASTTVMTAMSLLISVGLTLSVSFLLVTATFVYIAAFAIGLGPIPFLIIGELSYPQDAATAQSFGTVCNWLATFIVGYLFPIGHGLMGGYVFAIFAAIAAMFATYVYKRVPETKGKTTYSEVWAGY

SEQ ID NO: 29742 - protein, 162 aa, Saccharomyces cerevisiae
MTTSFYDLECKDKKGESFKFDQLKGKVVLIVNVASKCGFTPQYKELEELYKKYQDKGFVILGFPCNQFGKQEPGSDEQITEFCQLNYGVTFPIMKKIDVNGSNADSVYNYLKSQKAGLLGFKGIKWNFEKFLVDSNGKVVQRFSSLTKPSSLDQEIQSLLSK

SEQ ID NO: 29743 - protein, 175 aa, Saccharomyces cerevisiae
MPQYFAIIGKKDNPVYEIEFTNAENPQGFPQDLKELNPFILHASLDIVEDLQWQINPTSQLNGNGGNGSNGGGGFLRSRAVNNTDNCYLGKVDHFYGLAITAYISYSGMKFVMIHGNSANSSVVIDDNNMRSFYQEVHELYVKTLMNPFYKITDPIRSPAFDSRVRTLARKHLSK

SEQ ID NO: 29744 - protein, 110 aa, Desulfitobacterium hafniense DCB-2
MFATGSGLQYMILRQGSGERPKPTDKVSVNYKGTLLSGKTFDSSYDRGQPAEFPVNGVIQGWQEGLAMMPVGSKFKFWIPSELAYGPNGAPPSIGPNAVLTFEVELLDIL

SEQ ID NO: 29745 - protein, 141 aa, Desulfitobacterium hafniense DCB-2
AVVGKHDFIMGKVFPFVRTAGPTLSAFNAWVMLKGMETLAIRMERHSQSALAIAEFLESHPAVNRVFHPALKSHPQYEIAQRQQSGGGAIVSFELKGDSPEAMRAAAWRVIDSTKLCSITGNLGDTRTTITIRTPHPVAWA

SEQ ID NO: 29746 - protein, 252 aa, Desulfitobacterium hafniense DCB-2
LRLGVQSGSVVEIGRDIGFDALIADYDAVFLGLGTYRYTDGGLPGQDLRNVLPALPFLVQNGRIVHGEGADASSAPIAGWEDHIELPDLRGKRVIVLGGGDTGMDCVRSAVRLGAAQVSCVYRRDEANMPGSAREVANAREEGVQFLFNRQPLELTGDGETVRGVRVAQTRLGAPDARGRQRAEIVEGSEELLDADVVVIAYGFQPDPPVWLAQEGIELADNGRIHVLASTESCATRRKAWGRAGGPDTRPK

SEQ ID NO: 29747 - protein, 211 aa, Desulfitobacterium hafniense DCB-2
FYVGTLFVIMSIYPWNQVGTNGSPFVLTFQHLGITFAASILNFVVLTASLSAINSDVFGVGRMLHGMAEQGSAPKMFAKTSRRGVPWVTVTVMTIALLFAVYLNYIMPENVFLVIASLATFATVWVWIMILLSQIAFRRRLPPEEAKALKFRVPGGVATTVIGLLFLVFIIGLIGYHPDTRISLYVGFAWILLLLIGWQFKTRRERKLAKA

SEQ ID NO: 29748 - protein, 195 aa, Desulfitobacterium hafniense DCB-2
MSIEQLAETAQAMVAAGKGIIAIDESTTTIAKRFAGVGIENTEENRRAYRELLLATPKLNEYISGAILFDETLRQSTKAGVPFAKHMADHGIIPGIKVDKGPQPLAGFPGEVVTEGLDGLRARLEEYYKLGARFAKWRAVINISDDIPSGTCIEANSHALARYAALCQEQGLVPMVEPEVIMDGSHDIDTCFKSR

SEQ ID NO: 29749 - protein, 249 aa, Desulfitobacterium hafniense DCB-2
MGEQGFANRRSIRVRLRALALAALTCALSPAHAAIDAQQLGARYDATQANLAFRVYSSRATRIEVFLYKNPTGSQEVARLALSKDPATQIWSLSLPVSTIKTTYGITGVVYYGYRAWGPNWTYDPAWSKGSASGFVSDVDNAGNRFNPNKLLIDPYAREISQDPNTAACPDGTIYASGAAHRNKDSGLCANKSIALAADATSVGSKPTRALKDEVIYEVHVRGLTRNDDSVPAAERGTYKGAARKAAAL

SEQ ID NO: 29750 - protein, 227 aa, Desulfitobacterium hafniense DCB-2
MTETFSIERRKLMRAYGAKVILSPAAERGSGMVRRAAELAEKHGWFLARQFENPANPAFHRNTTAAEILQDFAGRRLDHFVTGWGTGGTLTGVAQMLRLARPEVRVTASEPAGAALLSGKDWAPHKIQGWTPDFIPAVLDREAADQIVPVDDVLARDTARRLAAEEGLFVGISAGATMAAALQVAQSADPGSVVLAMLPDTGERYLSTFLFEGVNEGSDEEWLASLE

SEQ ID NO: 29751 - protein, 149 aa, Desulfitobacterium hafniense DCB-2
MMTSTSNPLFQPYSLGPLSLPNRIVMPPMTRSRASQPGDVPNALMAEYYAQRASAGLIVSEGTWISPLGRGYAWTPGIHTPEQVAGWRKVTTAVHQAGGRIFAQLWHVGRLSHISLLDGHAPVSSSAIQAQGVNVFVAQSDGKPASVPL

SEQ ID NO: 29752 - protein, 230 aa, Desulfitobacterium hafniense DCB-2
  misc_feature (156)..(156): Xaa can be any naturally occurring amino acid
MIHKGGDACPGVRPSGHRVRADTATTAAPLECGHIFTDASSMCGIVGAIADRDVVPVLIDGLKRLEYRGYDSAGIAVFDGAQLRRVRRTGRVAEMEAAAQSESFSAQIGIGHTRWATHGGVTEANAHPHISFGELAVVHNGIIENHDEQRERLRAXGYAFESQTDTEVIGQLIHSYLKQAHELFAAGHGGVRNWSGLPNAGGASEPGGVAAHGCPVGAAEGRNFSTGCSI

SEQ ID NO: 29753 - protein, 215 aa, Desulfitobacterium hafniense DCB-2
MILTPPAERGTGMVRKAAELAEKHGWFLARQFENPANTAYHRNTTGPEILRDFAGKRLDYFVSGWGTGGTLSGAGQVLKLARPDLKIVTSEPAGASLLGGKDWAPHKIQGWTPDFVPAVLDRSIADEIRPIDDVTARDTARRLAAEEGLFVGISAGATIAAALEVAQAAPEGSVLLAMLPDTGERYLSTFLFEGVNEGSDDEWLKSLEQEEPVAA

SEQ ID NO: 29754 - protein, 167 aa, Desulfitobacterium hafniense DCB-2
  misc_feature (34)..(34): Xaa can be any naturally occurring amino acid
MSPLPALLPEFLILFGPTVNSFRRYQPWIFSPVXATWGWENRTCALRLIGGSPHSQRVECRVPGADANPYLALACVLGAGLWGIEQAIEPGEESTWNVYENLDKVAPHYRFPRSFAAAIERFDASRAARELFGDRFVDAYVEMKRAQDEEFAALVTDVELRRFFEFA

SEQ ID NO: 29755 - protein, 296 aa, Desulfitobacterium hafniense DCB-2
MMIDQVLSHTSNEHEWFKRSRESRDNEFADWYVWADARADGTAPNNWMSLFGGVAWRWEPRRQQYYLHNFLSAQPDLNFHHPAVRAAVLDNVRFWLERGVDGLRLDAINFCFHDAQLRDNPPKPPAQRVGRGFSPDNPYAFQYHHYNNTQPENLAFLGELRALLDRYPGAVALGEISSEDSLATMDEYTRNGRLHMGYSFELLTEDYNVEHIRGTVQRVEASMREGWPCWAISNHDVQRVVTRWGRGEAPKHFATLVSALACSLRGSVCVYQDEELGLPEAEVPFEALQDPYGKNF

SEQ ID NO: 29756 - protein, 274 aa, Desulfitobacterium hafniense DCB-2
MERAAAKRTPLGVKATPLTEIQIREEERVSSGSQELNRVLGGGIVPGSFVLLGGEPGIGKSTLLLQTAGLLAKGMDVLYISGEESEKQIKLRAERLGIKESRLHILTETRLEVVRDVALAMGPGLLIVDSIQTMVLEELQAAAGSVSQVREGAAFLMRLAKEEEIPIFLVGHVTKEGAIAGPRVLEHIVDTVLYFEGDRHHVYRLLRAVKNRFGSTNEIGVTEMHEDGLMEVHNPSKVSLGENTATDPGSSVAVIVEGSRTLLVEIQALVKPTT

SEQ ID NO: 29757 - protein, 413 aa, Desulfitobacterium hafniense DCB-2
MAANAEFNWADPLLLDQQLTADERMVRDAAAAYCQDKLMPRVLQSFRNEKTDVEIFREMGELGLLGPTIPEQYGGPGLNYVSYGLIAREVERVDSGYRSMMSVQSSLVMVPIYEFGTEAQKQKYLPKLATGEWIGCFGLTEPNHGSDPGSMVTRAKKVAGGYELTGAKMWITNSPIADVFVVWAKLMGDDGKEAIRGFILEKGWKGLSAPAIHGKVGLRTSITGEIVLDQVFVPEENIMPGVSGLKGPFTCLNSARYGIAWGALGAAEFCWHTARQYTLDRKQFGRPLAATQLVQKKLADMQTEITLGLQGCLRLGRMKDEGTAAVEITSIMKRNSCGKSLDIARVARDMLGGNGISDEFGVIRHVVNLEVVNTYEGTHDIHALILGRAQTGLQAFSEAGSMKKPGLSIKPGG

SEQ ID NO: 29758 - protein, 258 aa, Desulfitobacterium hafniense DCB-2
MVEGTAGNTGIGLAHICAARGYRCVIVIPETQSKEKMDLLRVLGAEVRTVPAVPYADPNNYQKVAGRLAQELDNAIWANQFDNTVNRQAHYETTGPEIWRDTDGKIDAFVCATGTGGTLAGVARFLKAQNPAVRTVLADPHGSGLYSFVKTGQIRAEGNSITEGIGSSRITANLADTPIDDAVRIDDQRCVTMVYRLLREEGLYVGGSTGINVAAAVQIAQDLGPGHTIVTLLCDRGSLYSARLFNAEWLAQKGLVAG

SEQ ID NO: 29759 - protein, 274 aa, Desulfitobacterium hafniense DCB-2
MHAAGGRIFLQLWHVGRMSHASFHDGEPPVAPSALSPDAQVWIVRDGVGAMVDCPLPRALRRDEIAGVVEQFRRGAANAIAAGFDGVEIHGANGYLIDQFLRTTSNVREDEYGGSIANRVRFLDEVTRAVAAEVGAQRTGIRLAPYITARNMNCPQIIPAILEAARRLQAIGVAYLHLSEADWDDAPHVPDSFRHELRSIYSGALIVAGRYDRERGERILSQGLADLVAFGRPFIANPDLPQRYAHDWPLAAFDPATLFGGDERGYTTYPAYAV

SEQ ID NO: 29760 - protein, 364 aa, Desulfitobacterium hafniense DCB-2
MDGRDVLPQSAKGFMTQLNSKCRELGLGQVATVSGRYYMMDRDKRWERVEKGYRALVNGEGLKAPNSLAAIEQSYDVRVTDEFVAPTVIVDSAGEAVGPLRDGDSFIFFNFRSDRAREISYALLDEEFTGFDRGRPLQLHYVCMTEYDDKLKGAAVAFPAQNLDNTLGEVLAKHQKKQLRIAETEKYAHVTFFFNGGVEEPCPGETRCLIPSPQVPTYNLLPEMSAYGITEELLKRLEREEDEVIILNFANADMVGHTGEFEATVKAIAAVDQCIGQIVPQVLERQGTVIITADHGNAEAKVDLQTGQPLTAHTTNPVPLILVNDQLKGKTLREGGALRDVAPTMLRLLEIPQPQEMTGKSLIC

SEQ ID NO: 29761 - protein, 269 aa, Desulfitobacterium hafniense DCB-2
MASQRNGMPANDSPPPSPRVKAVVFDRYGAAEVLRAIDLPMPQAGPGEIRVRVRAAGVRPSDIALRSGLSAGAHGGARARFPHRLGNEFAGVVDQIGAGVADFAVGDEVMGWAAAMSYAEALTVPATQAVHKPHTMTWAVAGALPSTGQTAHAALRQLGVGAGQTVLIHGAAGALGCVAVQLAVAWGARVIGTAAAADHDYLRSLGAQPVSDDHAGVEQVRALAPHGVDALFDACGQDDFAPWLALAAPQRALSLSRRYGLAELRSARS

SEQ ID NO: 29762 - protein, 203 aa, Desulfitobacterium hafniense DCB-2
MHGYPVGIVANNGILFAESALKGAHFIELCNQRGIPLVFLQNITGFMVGKKYENAGIAKDGAKMVTAVACSHVPKFTVVIGGSFGAGNYAMCGRAYGARFLWMWPNARISVMGGEQAASVLATVRRDGIEAQGKQWSAEEEDSFKSPIRDQYESQGNPYYATARLWDDGIIDPADTRRVLGLGLSASLNAPIEERTRFGVFRM

SEQ ID NO: 29763 - protein, 399 aa, Desulfitobacterium hafniense DCB-2
MDLHLKAIAKRYANVAALDAVDLDVASGELVALLGPSGSGKTTLLRVIAGLLQPDSGQLLFGHNDATALSLRERNVGFVFQHYALFKHMTVAENIAFGLRSRPRARRPDKATIAKRVQELLGLIQLPELGARYPEQLSGGQKQRVALARALAIDPTVLLLDEPFGALDAKVRVELRRWLRRLHDQTGQTTLFVTHDQEEALELADRVVVLKDGRIEQIGTPDEIYSAPASAYVFDFIGRANVIDGQTEGGELSIDGHGLRLPVDVHSRSRARLYVRPHDMALVGAGEGLAARVISSHRLAERITLELNVEGQTRPLELDLVATPDAGTRRRAADHVRRWLSSYRLKPSAVTGVRGAESNLPTSEARNRISELPSNPRGRGWPRTRAHKFKGPTNGRSTR

SEQ ID NO: 29764 - protein, 168 aa, Desulfitobacterium hafniense DCB-2
MMKAAVVRAFGAPLTIDEVPVPQPGPGQIQVKIEASGVCHTDLHAAQGDWPVKPSLPFIPGHEGVGFVSAVGANVKRVKEGDRVGVPWLYSACGYCEHCLQGWETLCEKQQNTGYSVNGGYGEFVDGDPNYVGLLPKNVDFIEIAPDLCAGVNGYKVSRSRHRPRSRW

SEQ ID NO: 29765 - protein, 224 aa, Desulfitobacterium hafniense DCB-2
MDTVLNFEGDGHHVYRLLRPVKNRFGSTNEIGVFEMHEDGLVEVPNPSKVFLGENSATAPGSSVAVIVEGSRPLLVEIQALVTPTTYGPPRRTATGIDYNRILMLLAVLDKKVGLHLGAQDVFINIAGGIRIDEPGVDLACIAAIASSLGERPLKRYALVGEVGLTGEVRGISQIEKRVKEAVKLGFEGCIIPRINVSAVKVPGNFTVIAVKTVEEAVQVMFEQ

SEQ ID NO: 29766 - protein, 391 aa, Desulfitobacterium hafniense DCB-2
MGLDEGEGTCDFHGCLNDDSEVEWSKPVIDPQTDIAVLQYTGGTTGTSKGAMLSHGNLYANAYQIWEWIKGSPGQEKSLCVIPLFHIYALSVCMNTSILGGSAVIPVPKFDADLILKLINDEKPTLYPGTPTMYVALINHPKLKEHDVSSIRACVSGSAPLPVEVALRFGELTGGKLVEGYGLSEASPVTHINPFPSARVGSIGTPVSNTQAKIVDIELGDKELPVGEVGELAVKGPQVMLGYWQRENETRAVLRDGWLYTGDLARMDEDGYFYVVDRKKDMIITGGYNVYPREIEEALYAHPAVREAICAGVPDSYWGEKVKAYVVLREEQQVTEEELLSFLKKELASYKVPKQIEIRDNLPKTAVGKVLRRFLVEEEKQKLEDMHRSLK

SEQ ID NO: 29767 - protein, 363 aa, Desulfitobacterium hafniense DCB-2
ADEQEIKKAYRKLARQYHPDVNPGDKDAEEKFKEATEAYDVLSDTEKRARYDQMGHSAFDPNQQGFGGFGGDFGGFGDIFDMFFGGGGGGGQRRQGPTRGNDLRYDLTITFEEAAFGTEKEIQVPRQETCTECHGSGSAPGTHPTTCSQCHGTGQVKATQRTPFGAIQTARTCPACNGSGQFISSPCKECSGKGTTRKVKTIKVTVPPGSEDGLNLRFSGNGEAGLRGGPSGDLYVVLNVKAHKFFEREGNDVYCEIPITFVQAALGSELDVPTLDGKVKMKIPEGTQTATVFRLRGHGIPYRRGNGRGDQHVRVVVATPTKLTDRQKELLREFGEVTSDQQQMGKKSFFEKVKENIRDAIDL

SEQ ID NO: 29768 - protein, 387 aa, Desulfitobacterium hafniense DCB-2
MGEWKKSGCILCAQNCGLELEIENNRIVKVRGDKDNPRSLGYCCQKGLKIAHYAHNGDRLYYPLKKAGDRHVRISWEQAIGEISEKLLSIKEDHGPKSFAYVGGGNVGGQMEVGIGLRLLGLLGSRYYYSSLAQEFSNVFWVDGRVAGKQGLTSVADAHGADTLVAWGWNGWMSHQEPRTRLLIKEFAENPRKKLLVIDPRLSETAKFADLHLALRPGSDTLLLKAIIRIILEQEWEDKKYLEDHVSGWEEVAQLFSGFEAKRAVEEVCGLNYEDVVETARLIAQTKSCIHQDLGIYMNRNSTLNNYLLHILRAVTGRLAVEGGQIFPGFLYPMGVTAMSAIRNWRTGNLRCSRVGDNGGNCRETSRHPEEQANSRRYPRLANPDIT

SEQ ID NO: 29769 - protein, 247 aa, Desulfitobacterium hafniense DCB-2
MAKVIEVQHLSKSFGPNEVLKDIDFSVRKGEVVCIIGSSGSGKSTLLRCINLLEKPSGGQIIYKGENILDDQHDVYQYRQKLGMVFQQFNLFNNHNVLNNCMVGQIKLLKRSKAEAEEVAMKYLKVVGMEQYINAKPKQLSGGQKQRVAIARALSMEPDVMLFDEPTSALDPEMVGEVLKVMKELAESGLTMLVVTHEMGFAKEVSDRVVFMDKGVIAEEGPPEEIFNNPTQERTREFLKRTLTPQV

SEQ ID NO: 29770 - protein, 244 aa, Desulfitobacterium hafniense DCB-2
MKLKISNLEKAFAGKTVLKDINIDLEYFRSLAIIGPSGGGKSTLLRMIAGLQRPDRGEIHINGERIHYSETLLHEYRKTIGVVFQSYNLFPHLTALDNITLPLTVVHKFSKEKAEIIALDLLDRFQLKVHMDKKPHQLSGGQQQRIAVARALSIESRFLLFDEPTSALDPELTSEVLDMIKELQEQDKDLILVTHEMGFARQSCDYVLFIADGQIIEHGSSARIFKEPQSLELKNFLNKILEWR

SEQ ID NO: 29771 - protein, 265 aa, Desulfitobacterium hafniense DCB-2
MELKNRIVLPAMHLNYCPDGEVTERLIEFYRVRARGGVGLVIVGGCGIDRVGNTLGMIQLDEDRYIPGLQKLVEAVHQEGAKVMTQLYQAGNYASSLLTGNQPVAPSPLPSKLTKEIPHELTVEEIKELVQTFAQAAVRTQKAGFDGVEILAGTGYLISEFLSPATNKRTDEYGGDLPNRMRFALEIMAAIRQGVGPDFPVVVRIAGHDFIPGGHTNKEARTFAKALAAAGVDAINVTGGWHETLVPQITHECSPVRLPLFSPGN

SEQ ID NO: 29772 - protein, 384 aa, Desulfitobacterium hafniense DCB-2
MARDILTSGDADLVGFARPILADPNLPLKAQGLDPSPLRPCVACNQGCLDHVFRGIPVACLVNAEAGREAELKVRGVSSSSRKVLVVGAGPAGLEFARAASSQGHNITVWEKSGLLGGQLNLAAAPPDRQDFHRFTEYLARACKAQGVRIYTNQEADVENILAGIAEEGFTDIILATGALPMAPPFPVEEGVEIAQAWDVLAGKETGEHVVIVGGGSVGVETALYLAGQGTLDAEILRFLIVNQAESTETLARLLFQGRKRVTLVEMTKGVGRDLGSSTRWAMLADLQRHQVKVLTNTMVKAVRADGVWVEGPEGESLIPGDTVVAAVGSVANQELLKALQDKLPAHVTLQQIGDATKPAKVLDAVHAGYKAALSLGQTGYAQE

SEQ ID NO: 29773 - protein, 204 aa, Desulfitobacterium hafniense DCB-2
MVQDVDTREVLMLAYMNEEALRRTLQEGRAWYYSRSRQSLWLKGETSGHTQEVVDLRFDCDRDTILLTVRQKGVACHEEFYSCFHYGVQGEGYVTLGAPEEVPAIPLGRTMELLAEVIHSRNMERPEGAYTTYLFDKGLDKILKKVGEECAETIIAAKNSSAEEIRYEVSDLIYHVLVLLEERGGKPGGYFPGAAVTKKIVRHT

SEQ ID NO: 29774 - protein, 184 aa, Desulfitobacterium hafniense DCB-2
MFRAAIKAGTALGMKAKEYMDAGSLVPDEVTIGIVAERLAEPDCSKGFLLDGFPRTVAQADALDKILTQLKMNLDGVINIEVPEAKLLERLTGRRICRQCGGTYHMVFNPPAAEAVCDKCGGELYQRSDDTLETAKNRLQVYNDQTQPLIDYYREKGLLKEINGDQDIAQVLQDIVDAMEHGHD

SEQ ID NO: 29775 - protein, 414 aa, Desulfitobacterium hafniense DCB-2
MDLGMLTFVLGSIKTDLGLTTVQAGLLSSFSFLGMFFGAASAGMAADKFGRKIVFQTSMILWGAASIACAFTQNVEQLALARFFLGLGMGMEFPIGQSLISEFIPAKNRGRYIALLEGFWPIGFIAAGILSYFLLPIGGWRLVFLCEGIPAIFVLIIRRMVPESPRWLADTNQDEKADVVMTAFEKNVEKAYGKELPPPIKDDNLVIGKHEKKFSFLQLWAPGYKKRTIMVWLLWFFALLGYYGLTTWLSAFLQEAGYSVTKSVYYTIMISLAGIPGFFSAAYFIEKNGRKPTLIVVLIGCAVFAYLYGTASSLQTLIGFGLGMQFFLFAMWSSLYAYTPELYPTRARATGTGFASSVGRFGSLLGPYIVAVVLPTLGNSGVFALGAACFIAAALSVAILGEETKGRVLEEISA

SEQ ID NO: 29776 - protein, 217 aa, Desulfitobacterium hafniense DCB-2
MTNSWTDMQNTKCFLIAGSNCAENHPIAMRWINKAKENGAKVIVVDPRFTRTASQADIFAQVRPGADIAYLNAIINYILENKLYDQDYVLNHTNGLYKISKDFKFADGLFSGFDPETKKYNFDSWAYQLDAENKPVKAESLDDPDCVFGKLKEHFSRYTLEVGADISGIPAEKIKEIADTFCNTRPGSILYALGMTQHTTGVQESAVTRSSSCFWAT

SEQ ID NO: 29777 - protein, 133 aa, Desulfitobacterium hafniense DCB-2
MLLHIKDEKLVYLDGDPDNPVNSGALCPKGASLGHVANAKDRVTKPRYRAPGSSDWQDISWDEAINKIASKIKEVRDTTWMATEEIGGTAYNVNRADGIAVLGSAEVDNEESYLIKKLSELIGTPYNEHQARI

SEQ ID NO: 29778 - protein, 357 aa, Desulfitobacterium hafniense DCB-2
MSIEVSQVSKTFDTFTALHELNLKIHTGELVALLGPSGSGKTTLLRIIAGLEPPDTGSIIFDGEDNTEKSTQDRKVGFVFQHYALFKNMTVFENIAFGLKVRPAKLRPSKEVIRQKVQELLALVKMEELANRYPAQLSGGQRQRIALARALAVEPKVLLLDEPFGALDAKVRKDLRRWLRKLHNEYPITSVFVTHDQEEALDVADRIVILNEGKIEQIGTPEEVYDNPANPFVYNFLGNVNLFHGRMHDGKVELGSLQLEAPEHAGIGNADIVSYIRPHDIEICLEDEGKGFIAAEIFFIRAVGPIVNLELKRLDNDEYIEVEISKEVYRSLKLKAKQKVYLRPRDFKVYVPEDYVI

SEQ ID NO: 29779 - protein, 379 aa, Desulfitobacterium hafniense DCB-2
MIIGGLTAGIISDRIGRKKTLSIFVAMYSLLTLPIYFVHSFEVFAMLRILSGIGLGACIPIAVTMMTESAPTHKRGFFTSSIMAFYISGWVVAGIVAITIVPVFGWRVCYLLGGIPALYSLVLWFKMKESPYWLLSKGREKEAIDVVKTIEIAARGKAGEWPLGRLITPPAPPKVGVSMIFSKNYRKATLANWTIYFMGSVLIYGISGWLPTLLVESGFGVVKGYSFAVLQNIFAIIGAMSIGFFADIIGRRLNVSLSWFFTAVFAILLGFATTQWQVILFIIIVGFLMNGALSSTQPLLTESYPTEFRSTGVAWAQAFGRLGGFSGPIAAGFIQQMGAGFTGLFIFFAIPSFIAAAVAFFFVVETKDKAIEKIVSANV

SEQ ID NO: 29780 - protein, 430 aa, Desulfitobacterium hafniense DCB-2
MGFQDQRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTARLAEGLQSIAQELGFPIWVNSVGAMFSAFFTDQPVIDFKSACSSDVERFGSFFRGMLERGIYLAPSQYEAVFLSAAHTDADIDYTLEQARDVLKSLG

SEQ ID NO: 29781 - protein, 330 aa, Desulfitobacterium hafniense DCB-2
MKDGSKPKVLIARQVPQEVEEWIGRHCEYSKWEGSGDIPRSELLKQLGDVDGLLINREKIDGELLDAAPKLKIVANISVGYNNFDIGEMQARKVLGTHTPNVLDDTVADLVFGLMLSTARRLCELDRYVKAGRWNETVTPDLFGMDVHHQTLGIIGMGRIGRALAQRGKWGFDMNILYHNRSRHPEAEQRFDARYCTLEELLQRSDFVVLLAPLSPQTVNLMSGREFGLMKRSAVFISASRGETVDEEALVEALREGRILGAGLDVYRKEPIPPDHPLLRFKNVVTLPHLGSATTRTRLAMARMAAENLLIGLKREIPPQCVPELKHLVL

SEQ ID NO: 29782 - protein, 503 aa, Desulfitobacterium hafniense DCB-2
MELARGLVELGFDLISTGGTFKTLTEAGLPVRYVTEVTGFPEILDGRVKTLHPRIHGGILARATAEHLQQLEDNGIGLIDLVVVNLYPFKETIARPGVSFQEAIENIDIGGPSMVRAAAKNQERVSIVVNPERYPEVLQALREQGEISYDMRKRLAAEAFAHTAEYDQCIAGYLTAALAEESVSSSSSPFPATITLGGQKAQDLRYGENPAQKAAFYRGADAAGTLAYGEQIQGKELSYNNWMDMDAAWGIVQDFSEPACAIIKHTNPCGTALGKTALEAYEKALAADPVSAFGGIIAFNRTVDAECAASLKAHFYEVIVAHEFSSDARAILQEKKNLRLVKVAQDGKPAHTPWKVRSIQGGFLIQEEDEGTTPISAWEVVSKRQPEPEELRELDFAWRVVKHVKSNAIVLAKAGQTLGVGAGQMNRVGSVKIALEQAGDKAQGAYLASDAFFPFPDSLEEAAKAGVRAVVQPGGSVRDAEVIEAADRLNLIMVFTNRRHFKH

SEQ ID NO: 29783 - protein, 317 aa, Desulfitobacterium hafniense DCB-2
MAPALAAGCTVVARGSEVAPLSLIELFKCLQDAGIPKGVANSIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIREAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 29784 - protein, 257 aa, Desulfitobacterium hafniense DCB-2
MLPESLLVSAVKRLQIYPEAERKSLAVGCQGVFREDVVVGGNFGAFSTNRPAAAAKSLNCSWTMIGHSEERNDKMGIIAAYDPGSLHSNMGRQAVNTTVDTILNQELKCALNRGLNVLFCIGETAEDRGDGDFNQQKPPIKAALKAQLLNGLKGFDKNQLKGRLVIGYEPVWAIGPGKTPPGSDYIAFVSTYIKETVLREFNFVPSVVYGGGLKEENAGIIAKIDTIDGGLVALTRFTGEIGFYPEDLRKIISKYLE

SEQ ID NO: 29785 - protein, 253 aa, Desulfitobacterium hafniense DCB-2
MGREVVRTILDQEDMQLVGASDARQQGRDIGELLAMAPLGIEITGPLEVAHLKETRADIMVDFTNPQSVLKNAKCALAAGVVPVLGTTGLDEADISEIRDLVDQTKVGAFIAPNFAIGAILMMRFAQEAAKYFPHVEIIELHHDQKLDAPSGTALKTVEWISEVRKPLVQGHPNEYEKIKGSRGGDVDGIHIHSVRLPGFIAHQEVIFGGLGQALTIRHDALSRETYMPGIMLAVRKASQLSNLVIGLENFLE

SEQ ID NO: 29786 - protein, 476 aa, Desulfitobacterium hafniense DCB-2
MELGVTKGDKVAYLLPNGLRIVELYYAVQKIGAVSVAINYRLASPEIGCLLEQADCQVFVYHELFDDKVRQVKENVKTISLMIRVGEQPIQGEYAFEALTDHDHEEEPDILIGEEDLCRIQFTGGTTGRSKGVMRTQRQEIFQVIGITTALELGGPDRVMLTQSPLCHQAGLSWLNVAIGAGNTLIVCDRFEPEKILRQIQEESVTNVMLLPPSSYHRIFALPSLAEYDLSSVKSVHSSAGGTSPEIVRKLYKVFPNCVVRCGYGLTETGGVGTTFVLTREVLENNPELTKSVGKEMSFLELRLVDESGREVPVGETGECIARGPSVMTGYYNQPELTEEVIKEGWVYTGDLLRKDEKGYYYFMDRKKDMIKSGGENVFAQEVEGVIRTHSAVDDCAVIGVPDPRFGEAVMAVIKTKPGQAVTGEGIQEHCKKYLAGYKKPRLVEFVDEFPVDQAGKIQKYKLRATFARKDFPETM

SEQ ID NO: 29787 - protein, 390 aa, Desulfitobacterium hafniense DCB-2
MISEENNRPYSRCLTSYYIGEEIDQDRIYIRDANFYAATGIDFIPQKVEQVNDTEKSITLQSGEIVGYDKLLIATGASPYSLPVEGLDLEGVCELRTLEDARRIMDFAPHVKEAVVMGAGLVGLKGAHALHELGIKVSIIVNSRIMSRSVDPHTGQIITELLEQDGYEVIYNTKLSKILGQDKVEGVCLSSGKEIPCQLVLMAAGVSPNVDLVKNTGIEVNKGIIVDKHMQTTVSHIYAAGDVAEAYHAVWDEKRVISIWPVATAQGTVAGSNMAGVERIYEGSVGSNSAVFCGVGVVSAGIPYLPTGEGQELSTYDKATKRYRKFIVKDDILVGMIMVGDIDGAGILTAMIKQKTKVSLDTLNYWLNHPVRFQGYCTAEAKGGIVCGIC

SEQ ID NO: 29788 - protein, 435 aa, Desulfitobacterium hafniense DCB-2
MRKINVNKVIDEAKFNRYFLIIFVLLLLALIFDGYDMGIYGVTLPSVMKELNLNATQTGLLASAGMFGMMFGALLFGMLSDVIGRKKTIIIGIFVYSVFNGIVAFIHSASIFAVVRFIAGMGMGALTPVVISLLSEYTPRSRRTLLLTMVMVGIPLGQLVASLAGVAFLESIGWRVLYLATLIALIMIAFVVWNVPESMKFYVPRGETKTIKKVLAKANPDFEQTEEDVYELSIVNQQKASLGSLFKSGYAKNTIYIWIAFFCNLYLFFGISTWLPKLMTMLGYPLKSSVMFLAIFLLGGVLTTPFVGMLGDKYGYKKVMPVLYAMSAVLVSLLSFQMSTFIFYTLLFLAGCAVTLVQSMTLAAAPDFYPIAFRGTAMGWGSAVSRLGSAVAPTVVGVLLTANLPVRGVFLTFIIPAVIACIAILLTKKDPDLVG

SEQ ID NO: 29789 - protein, 214 aa, Desulfitobacterium hafniense DCB-2
MLLSAKNIGKTYGEEVILQGISLELDGGQSLAVTGPSGSGKSTLLSLLGLMLSPTVGEIWYKNEDIGKLAEDRKDRLRNQEFGFIFQSANLIGSLTVLDNVLVPAYLAKNRQMKEKAVNLLQEFELGHRLDYYPSELSVGQKRRVAIARALLLDPAVVFADEPTNDLDPQLCSWVGDYLLGLPAQGCALVVVTHDLGLAARADKVVAIADGHLQ

SEQ ID NO: 29790 - protein, 416 aa, Desulfitobacterium hafniense DCB-2
MFDQMDVGTFAYAAPVLVKTWGLTMEQIAQVNSYGFVGMFLGAIFGGWIADKIGRKKTIILCVAIFSLGSLGNALAFNFHTLAITRFFTGLGVIGMLVVAMVYIAEMMPSEHRGRYQALTMACGTIAIPVGAAFARWVVPLSTESWRYIFVLGGTSILLLPFCFIVFKESPRWLVSKGRITEAEKVIREITGREVDLSSEVPEKIKKSSSLSTLKLILSKEYLKRTIILVIITDGVVLGAQMLGGFYPAILQEYAGFQLTLVLSIMALSWWGIPFGDLSASLVSDKGGRKGPLALFSIINGMTFVVCGFFPTPAVIIAAVFLSRVFGGGSVSILYTYLAESYPTHIRSTAVGLIMGQVRILSAVIVLIVPPILATYGWLGVHLVNAGIIIVTAIVALIFGQKTSKRTLEEINKAPG

SEQ ID NO: 29791 - protein, 341 aa, Desulfitobacterium hafniense DCB-2
MLPLFEPIRIKDLEIKNRIVMPPMALDIATEQGAITHKLIEHYRMRTRGVGMIIVEHAYVNPEGKAHPRQLGIHRDDLIPALEHLAAEIHKQGAVVGIQISHGGARSMGNICGPSSIQSQYLTRFGEADRKNCRVLPRKLDQEGIKGIIADFARAARRAQKAGFDFVEIHGAHGYLVNQFYSPLTNIRHDEYGGSLERRLTFPLEVVKSVRRVVGKSMPIFYRLGADDRLPGGNTVQDSALAAQALEAAGVDCLDLSGGISGYLRHGEEGFFAYMGQAIKPQVTIPVMVTGGIKTGNKANEMIAGGIADFVGVGRTLLKENEWAYKEWVRMGSGTCPYQAI

SEQ ID NO: 29792 - protein, 305 aa, Nostoc punctiforme PCC 73102
MRNEWSSIISTVYPIVPGHEIVGRVTEVGSAVTKYKPGDLAAVGCLVDSDGTCLNCKAGLENFCPNQILTFNSPDKHLGGVTYGGYSDSIVVDERFVLRVPSNLDLAGAAPLLCAGITTYSPMRHWGVTEGKKVGLVGLGGLGHMGVKFAHAFGAHVVVFTTSPDKKEDALRLGADEVVVSRNADEMQKHAGSFDFILDTVSAKHDINAYLNLLRLDGNITLVGAPEKPLDVAAFSLIMARRSLSGSNIGGIPETQEMLDFCGKHNITADVEVIPIQKVNEAYDRLLKSDVKYRFVIDMASLKSE

SEQ ID NO: 29793 - protein, 324 aa, Nostoc punctiforme PCC 73102
MSVIFFPPPIQQINSEIIRSAGVDLYVLRLDLMHPWVNGNKWFKLKYNLLEAKEKNFTTLLTFGGAYSNHIYATAAAGNLFGFRTIGVIRGEERLPLNPTLNFAVQQGMQLVYTNREMYRQRNTPVVEEYLQQRFGEVFIIPEGGSNLNGVRGCMEIIGDAMSTAVTERSRSAGYAYAFDRICVACGTATTLTGIALSLHQGQRAIAFPVLKNGSFLAQEIESLLTNYLASDLPTPSNSPAFWELVCDYHFGGYAKVNKELLLFSQQFREEHGIPLDYVYTAKMFYGVMDLLKQGFFSKGDSLLLVHTGGLQGNVGMEERFQRM

SEQ ID NO: 29794 - protein, 156 aa, Nostoc punctiforme PCC 73102
MADIILKILPTNKKAKEAFVYYRDGMSAQAEGEYAEALEYYEEALTLEEDTNDRGYILYNMGLIYASNGDHNKALELYHQAIELNPRLPQALNNIAVIYHYQGEKEKEAGDNEAGEALFDQAADYWIRAIRMAPNNYIEAQNWLKTTGRSQIDVFF

SEQ ID NO: 29795 - protein, 204 aa, Nostoc punctiforme PCC 73102
MILGGSGSGKSTQAQRLGRYFDIPLISTGEILREAISGDQPLPEFRWSEADPRTSLSVYASLSELGYHARPYIQKGELVPDEMIIDLIRIRLRQPDINCDWVLEGYPRTAFQAEELDFLLDDLGQKLDWAIYLQVPEAVMVSRSLGRSLPDDQPEIVQRRVELFYDRTIPILEYYDRRRCLLTINGDQSPDMVQQNILTLLSLP

SEQ ID NO: 29796 - protein, 335 aa, Nostoc punctiforme PCC 73102
MQKRTLGNSNLEVSAIGLGCMGMSFSYGPPKDTEEMTALLRAAIDRGITFFDTAEVYGPFLNEELVGEALAPFRDQVVIATKFGFDISPNSDPRGMKGSPGLNSRPEHIKEAVEGSLKRLKVEAIDLLYQHRVDPNVPIEDVAGAVKELIQSGKVKHFGLSEAGVQTIRRAHAVQPIAALQSEYSLWWRKPEAEVIPTLEELGIGFVPYSPLGKGFLTGKMDESTTFDSSDFRSTLPRFTKEALKANQALIDLLGSIAEQKQATPAQIAIAWLLAQKSWIVPIPGTTKLHRLDENIGAVSVELTPDDLRNIDDAASKIAVQGARYPEKLEQMTGR

SEQ ID NO: 29797 - protein, 139 aa, Nostoc punctiforme PCC 73102
MARYQETTQTDTLHLPSTITSRGVAATELRPWGAFTVLEEGRGYKIKRIEVKPGHRLSLQMHHHRSEHWIVVSGTARVTCGEKEVLLSNNESTYVPQCTSHRLENPGVIPLVLIEVQNGEYLGEDDIIRYQDDYARTKD

SEQ ID NO: 29798 - protein, 471 aa, Nostoc punctiforme PCC 73102
MSSKIKFGTDGWRGIIADDFTFPNVRKVTRAIATYLETAYTKNRPVLIAYDTRFLADQFAKTAAQVLADLGWTVKITVRDCPTPVIAYNARHLNSAGALMFTASHNPAPYCGIKYIPDYAGPATPEITDTIVANIESASDELPGSNPSGSISIFDPKPDYLQFIYTLLDIEKIKRANLKVKYDALYSTSRGYLDEVLQHSGVQLESFHDWRDVLFGGGMPEPKGEQLVELVEAVVRDQADLGLATDGDSDRFGIVDEQGTVLTPNTVLLVLARHLIKNKGKTGAIVRTVATTHLLDNFAAKNGLQIYETAVGFKYIGEKMRETAVLIGGEESGGLSIIGHIPEKDGVLADMLVAEAIAYEGKPLSQMVKEAIAEADGPLYNNRLDLHLTEAHKTAVIDSFTKNPPTEVVGIKVKEVGRKDGIKLYLEEGSWVLLRPSGTEPLVRVYLETNTPEKLTQIAQELESVIAKLEG

SEQ ID NO: 29799 - protein, 400 aa, Nostoc punctiforme PCC 73102
MQFAKRLQPLQSNVFADMDRAKAIALAAGQEVIDLSLGSSDLPVEAHVIEAIAQSLHDRSTHGYLLFNGTLGFREAAANWYEQKFGIKVDPQTEVLPLIGSQEGTAHLPLALLNPGDFALLLDPGYPSHAGGVHLASGQIYPMPLRAENAFLPVFADIPAPVLAQSRMMVLSYPHNPTSAIAPLSFFQEAVAFCQQHNLILVHDFPYVDLVFQETGEWADSSPNPKSLVPSILQADPEKSVSIEFFTLSKSYNMGGFRIGYAIGNAELINALRQVKAAVDFNQYRGILNGAIAALTGPQAGVKSAVAIFQQRRDAFITALHSIGWNVPTPKATMYIWAKLPSAWSQNSIEFCTQLVKQTGVAASPGAGFGKSGEGYVRFALVHEPPLLETAVERIAQFLY

SEQ ID NO: 29800 - protein, 369 aa, Nostoc punctiforme PCC 73102
MQVKAAVAYSAGKPLTIETVQLSGPQAGEVLVEVKASGICHTDAFTLSGDDPEGLFPAILGHEGAGVVVEVGAGVTSLKPGDRVIPLYTPECRQCEYCLSFKTNLCQAIRLTQGRGVMPDGTSRFSIDGQMIHHYMGTSTFANYTVLPEIAVAKIREDAPFEKVCYIGCGVTTGIGAVINTAKVEPGANVVVFGLGGIGLNVIQAARMVGANMIVGVDINPSKRALAEKFGMTHFVNPQEVEGDLVPYLVDLTKGGADYSFECIGNVKIMRQALECCHKGWGVSVIIGVAGAGQEISTRPFQLVTGRVWKGSAFGGARGRTDVPKIVDWYMQGKINIDDLITHVMPIEQINDAFELMHKGESIRSVVTF

SEQ ID NO: 29801 - protein, 460 aa, Nostoc punctiforme PCC 73102
MITTELSKIGDIIQNQREFFETGKTKDVTFRIEQLKNLKQAIIEHEQAIVEALKADLHKPELEIYITEIGVIKEIDYAIKHINAWTKPKKAAVSFDFFSYSAKIYPEPLGVVLIIGPWNYPFQLIISPLVGAIAAGNCAIIKPSEIASHTSGVIAKIIAKHFDPAYIAVLEGDVEASQKLLVEKFDHIFFTGGTAIGKIIMAAAAKYLTPVTLELGGKSPCIVDTDINLEHTVRRITWGKFINAGQTCIAPDYLLVNKKIKKDLIDGLKKCLKEFYGDNPISSPDYARIISQKHFDRLVNFLKDGEVIIGGENQSSERYIAPTVIDNVSSEDSVMQEEIFGPILPIIEYTDVAEAIALINSRPKPLALYLFSQNKNLQKRVLQETSSGGVCINDTVIQVGVSSLPFGGVGDSGIGNYHGKASFDTFSHNKSVLQNSFWLDLKWRYAPYEGKLPLIKKLLG

SEQ ID NO: 29802 - protein, 327 aa, Nostoc punctiforme PCC 73102
MTSQVNQRDLEIDSSPLLAVLQELHSQYKLLQEGAVAKYIPELAKVNPDLFSICIVTVDGQIYKVGNYDQLFTIQSISKVFAYGLALEDHGLDYVLTRVGVEPTGDAFNAIVLDEQSKRPYNPMVNAGAIATTSLIKGSGPTERLNRMLDMYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAKSGVCGGIIAVVPNKMGIGVFSPLLDVRGNSVRGVKVCEELSQRLGLHLFDCSGQEAKFD

SEQ ID NO: 29803 - protein, 1635 aa, Nostoc punctiforme PCC 73102
MQTSDNQDPIDGVAIIGMVGRFPGAGNVDEFWRNLCEGLESTTFFQDEELDPSIDPNLCKDPSYVKARGIIPGGETFDAAFFGINPMEAVVMDPQARVFLELVYEALENAGYESESFDGLIGLYAGCGQNTYFANHISGRMEIVDRIGEFQTMLANEKDFLTTRAAYKLNLKGPAVSVNTACSTSLVAIIQACQALSSYQCDMALAGGVSMTTPQNSGYIAQEGSMLSGDGHCRPFDASAQGTMFNNGAGIVVLKRLEDALNEGDRIYAVIRGSGINNDGADKVSFTAPSVDGQAEAIAMAQAYANFHPETISYIEAHGTATPLGDPIEIEALTQAFRVHTDAKQFCAIGSLKSNVGHLVAAAGVAGLIKTVLALHYKKIPPSLNFEAPNPKIDFANSPFYVNTKLAEWSQGETPRRAGVSSFGVGGTNAHIVLEEAPQIQNSGSSRPQQLLLLSAKTSTALEAATANLQQYLQYNAEINLADVAYTLQRGRKALNYRRSVVCHDITDAIAALQSLDPNQINTRHTVIRNLAVAFMFPGQGSQYVDMGLNLYNREPVFQEVVDECAEILKPLLGGDLRRIIYPAPSDRETAAIALKQTCFTQPALFVIEYALAQLWQSWGVKPQAMIGHSIGEFVAACIAGVFTLEDALMLVANRGRFMWELPQGAMLSVRLPAQEVEPRLIPELAIAAINAPSLCVVSGPTEAIAALQKQLESEEVVCRPLHTSHAFHSPMMDDIIAPFAEVVRKVKLSPPQIPFVSTVTGDWITAQQATDPMYWATHLRQTVRFAEGIQTLWQQPERVLLEVGPRITTTTLARQQAKDIKQQIAIASLSDNAENEAEWTALLKAVGQLWLAGVSIDWSNFYQRETRQRISLPTYPFERQRFWIDPLPHPNRAATPKPLNPQLEKTQDMTKSPQQKLIPLLKEIIEETSGLEIASVDDSTTFLEMGLDSLSLTQVGLALKKKFQVKVTLRQLLEIYPNLGTLADFINPALSPETLSALGLTETVAEPIPEVPLPAPATTSPTLVVHEVHTNGSAPQISPQPAASSFFENVINQQLQIMSQQLSLLGNNSQAVTIPVVPAATPQNNGVKPQNAVSIPATQTSKESPASVDTESNGAKKAFGAAARIEKTQTKTLTTQQRTHLDKIIQRYTQRTKKSKEYTQSHRPYLADPRTVSGFNPTMKEMVYPIVASRSSGSKLWDLDGNEYVDLSNGFGLNLFGWSPPFITEAIEAQLKLGMEIGPQTPLVGEVAKLMCELTNFDRAAFCNTGSEAVLGAMRMARTITGRNLIAIFSGAYHGILDEVIVRGTKKLRSIPAAPGIPPEMVENILVVDYDSPESLEILRSRADELAAVMVESVQSRRPEYQPKEFLQQLRDFTEEAGIALIFDEIVTGFRIHPGGAQAHFGIKADIATYGKIVGGGLPIGVIAGKSQYMDALDGGFWQFGDDSVPEVGVTYFAGTFVRHPLALAAAKAVLQHLKQSGPSLQQNLNARTDKFVAELMGYFQKVQAPFTAYNFGSLFIVKSAPEFPYGDLLFYLLRDKGVHTWDHRPCFLTTAHSEADLAFVMAAFKESIAEMQSAGFLSAPPIEVTNSEVTNNSLRNRPPQPNAKLGRDPQGNPAWYIPDTERPGKYLQVASVS

SEQ ID NO: 29804 - protein, 340 aa, Nostoc punctiforme PCC 73102
MELAMIGLGRMGANMAQRLMRAGHHVVGYVRRTEKLSAMVNEGVIAAGASSIADLVSKLSKPRTVWLMVPAASVDETIETLIPLLEPDDIIIDGGNSYYHDDIRRAATLKDRGIHYVDCGTSGGVWGLERGYCLMIGGEQVAIKRLDPIFATLAPGVGEIDRTPGREKAGGTAEQGYLHCGPIGAGHFVKMVHNGIEYGVMAAYAEGLNILHHANIGNNQREIDAETTPLRNPEHYQYDFNLGDIAEVWRRGSVIASWLLDLTAIALLESPNLERFGGRVSDSGEGRWSAIAAIDESVPTPVLSAALFARFSSRGEADFADKLLSAMRYQFGGHYEKANS

SEQ ID NO: 29805 - protein, 437 aa, Nostoc punctiforme PCC 73102
MYNQGAVEGAANIELGSRIFVYEVVGLRQGEETDQTNYPIRKSGSVFIRVPYNRMNQEMRRITRLGGTIVSIQPITALEPVNGKASFGNATSVVSELAKSGETANSEGNGKATPVNAHSAEEQNKDKKGNTMTQAKAKKDHGDVPVNTYRPNAPFIGKVISNEPLVKEGGIGIVQHLKFDLSGGDLKYIEGQSIGIIPPGLDKNGKPEKLRLYSIASTRHGDDVDDKTVSLCVRQLEYKHPETGETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPENFRLTAAISREQKNPQGGRMYIQDRVAEHADELWQLIKNEKTHTYICGLRGMEEGIDAALTAAAAKEGVTWSDYQKQLKKAGRWHVETY

SEQ ID NO: 29806 - protein, 477 aa, Nostoc punctiforme PCC 73102
MKSRNNKIQKPSNLQTPMTATYNLPDGPQMPRWLRTIKFISQPVKYVDDFAKTYGDTFTIRSSRSDNHIVYFSQPQALEEIFTADSRHFEVGRGNTGLRFLLGDRSFMLVDGDRHQRQRQLLAPPFHGERMRAYGEDIRKITQQVSHEWKIGKPFNIRESMQEITLRVILRVVFGLNEGELFEELRRSLSDLLDFISSPIMSSAFFFRFIQKDFGAWSPWGRILLQRQKVDLLIYTLLRERRAQTDQNRQDILSLMMAARYDDGQGMSDEELHDELMTLLVAGHETTASALTWAFYWIDHLPEVREKLLQELNTIGVNPDLSSVAKLPYLTAVCQETLRIYPIAMTAFVRIVKTPITIMGYELREGTAIVPSIYLAHHREEVYPQSKQFKPERFLERQYSPYEYLPFGGGNRRCIGMAFAQYEMKIVLATVLSEFQVSLVNKRPVHPVRRGLTVATPAGMRMVATPQVKRANTPALV

SEQ ID NO: 29807 - protein, 330 aa, Nostoc punctiforme PCC 73102
MTAAGSPEVLQVQEVPNPAVPVGNTELLVRLVAAGINPIDTKLRSRGTFYPDRTPTILGCDGAGVVEAAGAGVQRFRPGDEVYFCYGGLGAHQGNYAEYSVVDERFVARKPASISFTEAAAAPLVLITAWEALYERGRLLPGERVFIHAGAGGVGHVAIQLAKLKGATVATTVSSEEKANFVKELGADHVIFYKQTDFVQAVLDWTGGEGVDLAFDTVGGETFHKTFPAVRVYGDIVTILEPDANTVWKTARLRNLRIGLELMLTPALLGLEDILQHHAEILEQCATWIDEGKLKIHVSHEFPLKEAAKAHQLIESGSVTGKIVLLISDK

SEQ ID NO: 29808 - protein, 458 aa, Nostoc punctiforme PCC 73102
METADVIVIGSGQGGIPLAADFASSGRNVVLFERDALGGSCINYGCTPSKAFLASAHAAGRARQATKLGIHAQVEVDFSAVMERVRSIRSQFNQGVKRRLDSAGVRVVCAEAAFTGERTVSGGGVTVQAPLIVINTGTSSTIPDFSGLVGTPYLTNRNFFDLQQIPPRLLVVGGGYIALELGQGMARLGSQTELIVRGERLLAQEESDVSAVLADAFEQDGIGLHFNVTVQQVAYTNRVFTLTLNNGEVLDGEALLIATGRKPNTQALNSAVTGVELDAQGFIKIDEQFQTTCAGIYAIGDAAKQPAFTHVSWEDYRRLKAILCGEHRTRNDRVLGYAVYTEPQVGRVGMTLEQAHKQGITASEVTLPMAHIARSIEWGHDLGFYRMVIDTQTNLILGATLVGYETAELVHVFLSLMEAKATWQVLEQSVHIHPTYGEALPSLARLLVGDDMPTCPNM

SEQ ID NO: 29809 - protein, 337 aa, Nostoc punctiforme PCC 73102
MELGMIGLGRMGANMAHRLTQAGHTVIGYTRQPQKAEVLVQEGAIARGVTSFVELIEALTPPRAVWLMLPAATVDATLHTLMPFLDADDIIIDGGNSHYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQIDAETAPLRNPEFYQYDFNLADIAEVWQRGSVISSWLLDLIAIALLKDPDLANFEGRVSDSGEGRWTLMAAIEEGVPVPVLSTALYTRFSSRGQSDFANKLISALRYEFGGHLEK

SEQ ID NO: 29810 - protein, 485 aa, Nostoc punctiforme PCC 73102
MNKAGNHLQQRYLEAFTTRYNERTKKSKQLAQTYRPIITSNMGPVGFSLSCKEMCYPITAKRSLGSRIWDVDGNEYIDFMMGLGVNLFGHNPPFIQAALKEQLEKGIQIGPQSELTGEVGELICELTGMERVAFSNTGTEAVMAAIRLARTATGRNKIVLFSGSYHGHFDGTLVEVETIDGIPHTVPITSGIPQNIVEDYLVLDYGNPQSLDAIRANKHELAAVLVEPVQSRRPDLQPKDFLLQLRQLTKELGIALIFDEVITGFRVHPGGAQAWFGVEADIATYGKIVGGGMPIGIIAGKATYMDRIDGGMWNYGDASQPQVETTYFAGTFRRHPLAMAAALAVLKHLKMQGSQLQQQLNQRMSQLVETLNAYFEEEEVPLRLRNFSSWFSPAFLENFSLLEYATPSELRELLYYHLLDKGVMLGGPGGYLSTAHTDEDINYIIQAFKDSVRELRKGGFLPPIAPQNLVKEFSLETREQIADVR

SEQ ID NO: 29811 - protein, 394 aa, Nostoc punctiforme PCC 73102
MKLELTPQQKNAQAEFREFVDAEVVSQANQYDQQEYTPSDLVQKFAQKRYLGAVLPKEFGGEAMDMITYGLLNEEIGRGCSSLRSLLTVHCMVSHALCKWGNKSQKNDWLPKLASGEIIAAFALSEPNVGSDAKSVETTATLSGDAYILNGHKKWITYGQIADVFLVFAQCEGKPSAFLVEKNSPGLSIKPIFGMLGVRASMLAELHLNDCRIPQENLVGRLGFGFSYVASSALDYGRYSVAWGSVGIAQACLSACIRYTSDRKQFGVYLKEHQLIRQMITNMIANIKAARLLCYQAGYLKEIGDPSSIIETSIAKYFTSTIASQVASDAVQIHGGNGCSSEYPVERYLRDAKIMEIIEGSTQIQQVTIAEYGYQEYLSPRTGAVMLQNLAARM

SEQ ID NO: 29812 - protein, 1420 aa, Nostoc punctiforme PCC 73102
MGAIRLARATTGRSKIALFTGSYHGIYDGILVRGVTTSEGTRRSIPRAIGIPSYIADDVIVLDYGQPESLEILKTHAHELAAVLVEPIQSSRPDLQPKEFLLQLRQLTQATGTVLIFDEVITGFRMHPGGIQGLWDIQADLTTYGKTVAAGMPIGVIAGKAALMDTLDGGMWNYGDESYPQAETTMFAGTFFKHPLVMAAAWAALNHIKNSGPKLQQELSQKTAKLAQTINSYFEKRQVPIQVVHFGSLFRFIGSSPLKFNQLFFYHLLEKGVYVWEGRTFYLSTAHTDADIEHIIRAVKESVVEMQQGELLPSAPILTTLKIPLTAAQKELWFLAQMGDEVSRAYNESRTIHLRGTCNLLAVRKAVQEIINRHEALRTTFSPEGDEQLIHSTLTIDIPVSDFSTLDKSQREAQLSELLAREAQQIFHLEKGPLLGCHIVKLEENYHLVVLTNHHIVADGWSIGILLQELAAIYSAQCQGIASQLLQPMKWSEYALWQVERQQSPEMAKAEAYWLGQFSSSVPVLELPTDRPRPPIFSYTGARENLILDPTLYNALKNLSGQRGYTLFTILLTAFITLLQRLTNQQDIVVGIASAGQSAIAGESLVGHCVNLLPIRSQVIGNPGFTEYLSAIQQVLLDAYEYQIYPFIKLIENLKLPRDPSRTPLFTTGFNLDKAQFESKSLKQEFEVAKNSTSATKFDLNLNIFQTDNELLIELEYNTDLFDCQTIQRWSKHYVTLLEGIVANPEQPLAQLPVLTKTEQQQLLVEWNNTQTDYSGEYCIHELFEVQVERSPDAIAVIFEDQQLTYRELNQRANQLAHYLRSAKLSRSNSLGVGPEVLVGIFMDRSIDMVVSILGILKAGGAYVPLDPTYPKERLAFMLSDAQVSVLLTEDKFLEGLPEHQAQVVCLNQNSEAWCQERVDNPVREVTTNNLAYVIYTSGSTGKPKGVLVNHQNVIRLFTATQSWFNFSDRDVWTNFHSYGFDFSVWEIWGSLLYGGRLVVVPYWISRSPEAFYNLLCTQQVTVLNQTPSAFRQLMNAEEEAAGKTGTLALRLVIFGGETLELDSLQPWFERHGDGSQLVNMYGITETTVHVTYRPINIADLNQRNGSLIGHRIPDLQIYLLDSQRQPVPIGVAGELYIGGAGVTRGYLNRPELTAERFIVNPFSEVTDAYLYKSGDLARYLPNGELEYLGRIDHQVKIRGFRIELGEIETALRKHQAVREVIVQAVEESHGEKRLVGYVVLDDKQAVTIGDLQRFLKEKLPEYMVPSAFIFLPALPLTPNGKLDRRSLPAPETIRPNLSDAYVMPQTEMEQTIATIWQKALNIEKIGIHDNFFELGGHSLLMVKVHSKLREIFQTDLSMIDMFRYPTISSLAECFTTIKNHTLSLQKTDVKIEKIKDGKAQQQKRLQKLKSITKSLGVKE

SEQ ID NO: 29813 - protein, 335 aa, Nostoc punctiforme PCC 73102
MVAATDFKDYYEILGVSKNATPEDIKKAYRKLARKYHPDLNPNDKQAEARFKEINEANEVLSDPAKRQKYDQYGQYWQQAAAGAPPPRGAGTQGYDFSQYSNFNDFIDELLGGLGRSGGRTRQRGANYRTTRRPEGFRDYVDFGYGEDPSSRFTDIPAQDTEAAIALTFSEAFHGTQKRLQIDGETITVRIPPGVKPGSRIRVKGKGQMSPFNQQRGDLYLSIELLPHPFFKFEGDNLACEVPVSPEEAVLGAQIDVPTPDGKVTMKIPAGVDSGQALRLRGKGWRDPKGNRTALIVRLKIVTPKDLSPQERECYEKLRQVSSFNPRQGLEEVRL

SEQ ID NO: 29814 - protein, 160 aa, Nostoc punctiforme PCC 73102
  misc_feature (118)..(118): Xaa can be any naturally occurring amino acid
MYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAXAEFVVGYRRCTHRWFWGFFALLMSVYTVRAEGLKTFHGWFLF

SEQ ID NO: 29815 - protein, 505 aa, Nostoc punctiforme PCC 73102
MARLALLSVSNKTGIIDLARSLVEEFDFDLISSGGTAQALKDAGLPVTKVADYTGSPEILGGRVKTLHPRIHGGILARRDVPQDITDLENNQIRPIDLVVVNLYPFEETIAKPGVTLLEAVEQIDIGGPAMLRASSKNFAHLAVLCDPAQYDEYLEELRQNNGVASLEFRQKAALKGFSHTASYDQAIAQALTCQFASYLADTQQYTLSGTQLQSLRYGENPHQPATWYQTGTTPTGWAAATKLQGKELSYNNLVDLEAARRIIAEFTDTPAATIIKHTNPCGTALGSSISEAYKKAFNADSTSAFGGIVALNRPIDAATASELTKTFLECVVAPSCEAEAQEILAKKSNVRVLTLADLSSGPKDTVKAIAGGFLVQTADDIVADTSQWQVVTERQPTDSELAELLFAWKVCKHVKSNAIVVTSDRTTLGVGAGQMNRVGSVKIALEQAGEKAKGAILASDGFFPFDDSVRTAAAAGITAIVQPGGSLRDKDSIKAANDLGLVMF

SEQ ID NO: 29816 - protein, 354 aa, Nostoc punctiforme PCC 73102
MNTLLFPVILAGGKGERFWPLSRKDRPKQFLSLDGSSRSLLQATADRLIKLGDGWDSLWVITSSQIAEGVRQQLPDLPVENLLIESEGRDTAAAVAWTSLEIKQRYGEDAVIGFFPADHWIADEEAFAHTLSAATQLAASTAAIVTLGIKPTFPSTGYGYIEQGEKIGSFNELPAYHVNRFTEKPNRETAETFLSTGRFSWNSGMFVFRAGVVLEELHTHAPEIIEPLEQQGLDIYPQLPKKSIDYALMEKTTLAYVLPVDFGWDDLGDWNAIERLLKTEENPNVELATHVGLDTQGAIIYASNPEDVVVTIGLEDVVIVRDRNVTLVVKKERTQEIKQILKILQSDSRFTDLL

SEQ ID NO: 29817 - protein, 399 aa, Nostoc punctiforme PCC 73102
  misc_feature (103)..(103): Xaa can be any naturally occurring amino acid
MSQLEQALPDTFVTKSLETPPNIFDQVEALAKDFATRAGAHDKEGSFPFENFTALHEAKLLSLTIPRELGGEGLGLSTICRVIEGIARGDASKALSLTMHYLXHANAARSRRWHPEVYKRLCRESIEGIALINAARVEPELGTPARGGLPATIAEHTTEGWRLTGHKQYTTGSPILSYFVVWARTTEDEPQVGNFLVPRDLPGLQIVETWDHLGMRATGSHDLILENVLIPLEYALNLSPISAAPSLDPLISTWGSLTVSALYLGVATSARDWLVKYLWERSPSNLKEPLATLPRFQTAVGEIEVLLFANNRLIYSLAEDIDRGEYDPNVGLQAQAVKYLTTTNSIRAVEIALELTGNPGMLKRNPLERHYRDVLCSRIHTPQNDVICQSLGKSALKVK

SEQ ID NO: 29818 - protein, 248 aa, Nostoc punctiforme PCC 73102
MTKLPVRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFHLV

SEQ ID NO: 29819 - protein, 394 aa, Leuconostoc mesenteroides subsp. mesenteroides ATCC 8293
MKNLIDKVTFRHGATIDTRTAQSPMLTNSGLNEKVTQDTINYYNARSQSAGMVIVEYTSVSPNGGPSRSWAPDREQLAIYDDSFVPGFKKITEKLKKDGNKAILQLVHSGREAQYRYALGGQVEVPSNIDFPWINYPLHELSEDEVWQIVKDFGTATKRAIASGFDGIEIHGANHYLHQEFFSAYSNVRTDFWGGSLEKRMNFALEVAREVFKVAKENAPKDFIIGYRISPEEVHEDNIGYTWHEAQLLVNQLTENFEFDYVHLSTNDYTATPTDSDKNYAQLLGERVKKPALLMIAGGIHTVEKMKDALQYVDIVSLGRPTLIDNQIGYKIKNGQADHIFLEFNEESVKESHLTPGLIDLLANTAYFDMPGIDYLKTLTDVKLGDAVTHDGTK

SEQ ID NO: 29820 - protein, 127 aa, Leuconostoc mesenteroides subsp. mesenteroides ATCC 8293
MNGLSLAYIGDAIYELEVRRHLLSLGLTKVNELQKRSKHYVSAKAHAALFEQMMVSNILTDDELDYFKRGRNAKSHTKAKNTDVITYRISTGVEALFGYLYMSEQHERILELMTWIFEQVETGSTNK

SEQ ID NO: 29821 - protein, 372 aa, Leuconostoc mesenteroides subsp. mesenteroides ATCC 8293
MTLFPNYQRAPLTFKKTKNATWTDGKNNEYTDLSSGIGVYNVGANNDAVESALIAQAKEIWHLPNLYENELQETVAAKLGGEDYTTYFANSGAEANEAAIKLARLVTKRETIITFKNSFHGRTYGAMSATGQDSIHYGLPMLDGFQYAEFNDINSLKELLNKDVAGVMLELVQGEGGVIPAHQDFVTELIQVVHDNGSLVMIDEVQTGMGRTGKKFAFENYHFQPDIFTNAKALANGVPVGAMLAKNEFASSFSYNAHGSTFGGNPLAMSAASATLDELSLILPNISEKINLFWQELAAFKELRNVVEVRGLGMMAGIELNIPVKQVVADLLDEKIVTLGAGHNTLRLLPPLTISESQLTTALQKIKQLLSQ

SEQ ID NO: 29822 - protein, 133 aa, Leuconostoc mesenteroides subsp. mesenteroides ATCC 8293
MSTYAQFMDAEPSVAQVAAALAGVSVDQIRNVTLAYEPTWAIGSGEAASAVQAQKAAHLIRQTLAKLYSPVIAEQVRVLYGGSVTPDNAREIMLQKDIDGVLVGTSALDPEKFLQLVAIAQDPEVPEFNIENT

SEQ ID NO: 29823 - protein, 325 aa, Leuconostoc mesenteroides subsp. mesenteroides ATCC 8293
MYNTVSDEMPYVEKWTEKTGHEVVTIDQPLNETTVDRAKGFDAITTQQTTAINAPVYAQLAQFNIKQIAIRQVGYDVLDLPEAFAHNIRLSNVAAYSPRAIAEYTLTQLFNLIRHNKKFDRAMNTGDYTWAAGGQAREIHDLTVAVIGVGRIGTALAEMLHALGATVLGVDPIYRAQNEPFVTYTTLDDALSRADVISFHTPLNDETRYMADENFFAKIQPGTIMLNFARGEIVDMVELEKALESKLLAGAAFDVTPNENDFMNQKQDITALPADVKRLIEYDNFLLSPHIAFYTNTAIKNMVEMALNDAVTMVNGGVTENEILR

SEQ ID NO: 29824 - protein, 206 aa, Leuconostoc mesenteroides subsp. mesenteroides ATCC 8293
  misc_feature (177)..(193): Xaa can be any naturally occurring amino acid
MKTKSKKVKLNFLHYCVYVISLGGFLFGYDTGVINGALAFMSRPDQLNLTPTLQGVVSSSLVIGACFGALGCGRVADKIGRRKTLRIIAIVFTIATVLCAVAMNFWLMSLFRFVLGLAVGAASSLSPMYLAEISPENLRSANVNKNAIFIVLGQLCAFIVNAILGNIWGHWGPIWRXXXXXXXXXXXXXXXXXLLNLPLLSISDVT

SEQ ID NO: 29825 - protein, 157 aa, Leuconostoc mesenteroides subsp. mesenteroides ATCC 8293
MSIYDYFATLENGETYSLNKLANHPVVIVNTATKCGYAPQFGELEKLYKKYKDKGLVILGFPSNQFKQELETASQAAQACQLTYGVTFPMHQLVAVNGKNTDPLFKYLKENSKGMLGSSTIKWNFTKFLVDKEGNVVKRYAPKTEPKDLEEDIEDVL

SEQ ID NO: 29826 - protein, 389 aa, Leuconostoc mesenteroides subsp. mesenteroides ATCC 8293
MAPTTLKSSLEDGSVSDNELKYYQMRSNGPGMIIVEAAYVNELGKGWEGGLSAADDDKIEGLSRLASAIHSGGAKAILQLFASGRQSNQTILRGEQIVSASAQPYPHGSHETPRELKHEEISQTIEDFAAATKRAILAGFDGVELHGANLYLLQQFFSPESNRRQDIWGGTLEKRMRFGLAVTAKVGDTIDKYAERPFLLGYRQSPEESTTPGITLADSLAFVQRLVTLQIDYLHLSLKDAFQKPFRDAKAVKQITTYYTEVLPDNVPLMVAGLIKQPMQVESLLDEGVTFAAMGRALIADPNWVQKVKLNDEKSIRYAVSPADFDLLGVPKPLKKWLLTRFKNGFPVTTDIEFDPKTPWKYYKSMPTQPRQQIDPTKLMTLKKRVDDN

SEQ ID NO: 29827 - protein, 324 aa, Leuconostoc mesenteroides subsp. mesenteroides ATCC 8293
MGSDNHSIEVSTIGLGTMGMSFAYGHLPDEQSMIPVLQEAVEMGEHFIDTAEVYGPFTNESLIGKALYPYRHDMVIATKGGIQIVNGKQVIDGHPQTLENSIEGSLKRLKVDAIDLYYLHRVDTSVPIEEVADFMGRMIKAGKIKHWGLSEAGVQTIRKAHAITPLTAVESEYSLWYREPEEQLLPTLKELGIGFVPFSPLGKGFLTGTMSVDQPLSSDDVRSTLPRFKQDAMVANMKLVDIIQNFAKTKDVTNAQIALAWLLAQDESIVPIPGTTKIQRIRENIDAEKVILSPTELKALTEAANTVKIVGNRYNEELAKRAGN

SEQ ID NO: 29828 - protein, 446 aa, Leuconostoc mesenteroides subsp. mesenteroides ATCC 8293
MNYDVIFIGSGHAAWHGAQTLARSGKKVALVEENKVAGTCTNFGCNAKILLDGPAEMMHHLNHYHGIGINDTPNIIWPELMAYKHQVIDPLSGGLAHMLSVDGIDIINGHAKFLNNEKIVVVDQVYQAEKFVIATGQRPAKLPISGSEFMKDSTDFLDLPDMPKSILFVGAGYIAMEFASIAHAAGSDVTLIEYGNHVLNGFDEVYSQKVIEDMTEKGIHFTFNQAVSSVSLLANGQYQVDTAQGETYYVDYVMDTTGRVPNIEELALDDINVLYDKQGILVNDHLQTSIDNIYASGDVISKAIPRLTPTATFESNYIASVLLGNQEPINYPVVPTVAFTLPRVAQIGVTIDEAAKDENLQVHEIPYGRVMRFQTLNDVHAAIKIIVNKNKQLVGAALIGDFAPEVVNALVPVINQQYTSSDIKSQIYAFPTDSGIILPMIANYLA

SEQ ID NO: 29829 - protein, 475 aa, Leuconostoc mesenteroides subsp. mesenteroides ATCC 8293
MEQADFGVVGLAVMGRNLALNIESRGYRVAVYNRSRERTDDLVQKHEDKAFIPSYTTEEFVETIKKPRRILLMVKAGKGTDAVIDELLPHLEKGDMLIDGGNTYFEDTIRRSDKLAQEGINFIGMGVSGGELGALQGPSLMPGGQREAYDLVAPILTQIAAKAPEDGKPTVTYIGPNGAGHYVKMVHNGIEYGDMQLIAESYDILKRVLHLNQEQLSQTFSGWNEGELNSYLVEITADILTRKDDLGTDKPIVDVILDRAGNKGTGKWSSQSALEVGAPQSLITESVYARYISAMKDDRVAASKTLQGPDYSFSGDEQSTVEDIRKALYFGKIMSYAQGFDQLRMASEHYDWHLPFGELAQLWRAGAIIRAQFLQRITDAFTTQADLHNLLLDPYFQHIAEEYQNAARRVVALAVTAGVPTPSLSAAVAYYDSYRSAVLPANLTQAQRDYFGAHTYERTDKPAGEMYHYPWYDEA

SEQ ID NO: 29830 - protein, 469 aa, Solanum tuberosum
MVKLEATKSTSSNLLDPSFSSYMINGTEETIVLNLESSRDLSKKVDDGEIDIFSAEKYFNEGVDEENNVTQNKHKIHDDQPVADIVSLQQKIRPLTPSIHSESSWNSRSALLQKVSINHHYQHQHHQPPRPTKTNNKSYGKKFLARFGCNCYCKDKNSVEIDDQLCEKSFKSKSKQNTIKTSTIGANHQNLHFKKIDELGVLGLKSDERFAVPVFDPKVGNPNPGVKIQLHKEEEEESRKSLEVFGFPITEKERSKMSLEKNIGMLTWDAIVPKAEEIDIINIGASSNGTYEEDYAESDASSDLFEIESFPSNNTANPSLVRQGSDSMSCYAPSEVSIDWSVVTASAADFSIMSDIEEVKIPSIRTTSNSNRSVSQNGRDKAKRRSGILLGCNSHKAVGVVGDAYKVSEKSSIEMHQRNFKTYEPIIPMTRFHAESKVNRFDGGNRKHEFTTRSFATTYSGRPADFLYI

SEQ ID NO: 29831 - protein, 270 aa, Bifidobacterium longum DJO10A
MIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQAGLEFVLL

SEQ ID NO: 29832 - protein, 480 aa, Bifidobacterium longum DJO10A
MRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADVIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMIYTDKVLKDAGKVADGDKIVILSSAQGEHQPGRTDSIYVHTVGACD

SEQ ID NO: 29833 - protein, 165 aa, Salvia miltiorrhiza
MELLEKAKNYVTEKLTNVAVPEATIADVDLKGFGLDGITLLAKGSPSPTRTASRSPIGEIAYAVKSNERVIASGTIPDPGSLKASDSTHLEVTVKVPHSAAISLVRDIGGDWDIDYTLALGLIIDLPVVGNITIPISYQGEMKLPSISDFFSGTSGEANENVEVK

SEQ ID NO: 29834 - protein, 439 aa, Desulfovibrio desulfuricans G20
MLEAANKLGIIFFPAYDWAISPTHPEREERLLYTQDQLREEGLFDIPGITEYKPLVAGREDVERVHFCIPDIERVCTKSHLVSAGGAIQAARLVMEGKEDKAFALVRPPGHHAMKVVHGNRGFCNVNIEALMIEHIREHFGPLRVAVIDTDCHHGDGTQDIYWNDPDTLFISLHQDGRTIFPGTGFPAELGGVNALGRTLNIPLPPRTSDRGFLHVIDHLVLPVLEHFKPDIVINSAGQDNHFSDPITDMRFSAQGYAALNSRLNPDIAVLEGGYAIQGALPYVNLGIALAMAGLDYSSVREPDFDPAAIEQSPRITEYVERLCEEMLKVYFNPPSQPRQGEKSGDWWVRTKDIFYDTDGINESQVESVRICPDCAGVMKIETWSTANPLSLGVQVPQNACEKCRGIGIRTVEEAHVKGNYRYIQLINRKDKQYVQYGF

SEQ ID NO: 29835 - protein, 509 aa, Desulfovibrio desulfuricans G20
  misc_feature (231)..(247): Xaa can be any naturally occurring amino acid
MLLVTVGFLWAASNSVEYVWRWNRIPQYFWVQKHVDVRAEQQGTLVETLTKDGARFVVLQEDDGTRVQQKLEPGMSLTPAQGDYVYLGDVLGTYRVSEPGVLLQGLWVTLEVSLISIVFGITFGVLTGLARISENPALKWGAITYIELIRGSPLLVQIFLWYFVAGTLVNNLLMQAGLGQVPPMWFGVLALSVFTGAYVAEIVRAGIQSVHRGQMEAARSLGLNYSQAMRXXXXXXXXXXXXXXXXXAAYLHAFAVCLLSGKQGRTMIKAKNLNKIFYTPEPLHALSDVSLDVAAGEVVVVIGPSGSGKSTFLRCLNRLEYADEGEVWIEGRNILDPACDINKVRAEVGMVFQSFNLFPHMSVLENLTMAQMTVRGRNRSDSESKAMGLLKKVGISDKHGVYPDQLSGGQQQRVAIARALAMDPKVMLFDEPTSALDPEMVGEVLDVMKTLAREGMTMVVVTHEMGFAREVADRVVFMDMGKIIEEGTPEHFFTSPRHERARNFLNQIL

SEQ ID NO: 29836 - protein, 244 aa, Desulfovibrio desulfuricans G20
MKPMIEIKDLHKSYGNVEVLKGIDLTVRQGEVVVIIGPSGSGKSTALRCINRLEEISSGCIKVDGFDLYAEDTDINYVRTEAGMVFQQFNLFPHLSVLQNVTIGPVKVRKMPRQEAEILGQKLLEKVGLPDKAHAYPEQLSGGQKQRVAIARSLAMQPKVILFDEPTSALDPELVGEVLDVMKRLAAEGMTMVVVTHEMAFAKEVADRVIFIDQGRIQEENIPSEFFDNPSNPRLREFLGKVAH

SEQ ID NO: 29837 - protein, 424 aa, Desulfovibrio desulfuricans G20
MSDLKKMYSTLQEDPFPAEMTLRLGDQELHYTKRTWTIDGQEKGLRYGENPDQPAALYQLDKGSLTLGGVTFRGPGAGLVSSLEEKHMIQAGKHPGKTNFTDVDNALNILQYLDAKPAALIMKHNNPSGAAWSGDGVATALERAFWCDRIAAFGGAVIVNRPLDKKAAELISSCYFEVVAAPDFEEGVVEMLKSRKNLRILQIPGISRLPELARMPFIDLKSLQDGGIIMQHSFRNRILSADDFLPATAEKDGVTVNARKPSPQEADDLLFAWAVEAGVTSNSVIFARNGATVSIGTGEQDRVGCVELAVHKAYTKYADTLAFREQGCSLYELKQKAAGDSAAAEALEDIEARTRADRGGLPGTAMVSDGFFPFRDGVDAAIAHGVAAIAQPGGSIRDHEVIMACNEAAPQVAMVFTGQRSFKH

SEQ ID NO: 29838 - protein, 471 aa, Desulfovibrio desulfuricans G20
MFFSSLRARWGMPNGYRDVLGVGLPLVISMASSTVMQFTDRLFLSHYSVDAIAAALPAAIVNLLFLLFFTGVAGYANVFIAQYCGSAAPARVGAALWQAIHFSLMGGVLLALLWFVAPFMFSFAGHPAPVVRLEVIYFRVLTVGAVFMLLSSALSCFFSGRGLTRPVMVANIAAMIINIPLDYALIYGAWGLPELGIAGAGIATVAGWALTFFFLALATFTRRHDAMFGVLRNWRFERALFLRMMRYGLPSGVNYFFEIFAITFFVFVIGRLGRVELAATNIVFSIDSLAFLPMLGLNIAVSTMVGQAIGAGKPDAAGTAAMNTLHLALAWMLCIGVMFIIFPGVLLDMFRPQDVSVQEYVPIREAGVVLMRFVAFYCLFDALSLVFFGAVKGAGDTYFVMWAMVVGCACMVAVIVIMRLWFDAGLIALWVVLTCYAVALSLSALLRYRGGKWRSMKVVETVRRSPDAGPC

SEQ ID NO: 29839 - protein, 240 aa, Desulfovibrio desulfuricans G20
MIEFNDIHKWYGEFHVLKGISESVEKGEVLVICGPSGSGKSTFIRCLNRLEDIQKGSIMLEGRSIHDKAVDVNELRTEVGIVFQQFNLYPHLTVLQNVTLAPLKVRRVERIKAETVAMELLERVGIHDQAGKYPVELSGGQQQRVAIARALAMRPKVMLFDEPTSALDPEMINEVLNCMKDLAREGMTMLCVTHEMGFAREVADRVVFMDAGRVLEEASPAEFFTNPKHERTKAFLKEIL

SEQ ID NO: 29840 - protein, 486 aa, Desulfovibrio desulfuricans G20
MMAKYDYDIIVIGGGAAGLTVTAGAAQLGVKVLLVESGHALGGDCLHYGCVPSKTLLRTAGVRHLMRHAARYGLPDAQLPPVDFAQVAQRISEVQAVIQQHDSVERFTALGAEVLFGAASFADDHTVEIRSDDSVVRATGAKIVIATGSGASVPPLEGLKESGYLTNREIFSLPVLPASLIVLGGGPVALEMAQAFRRLGTEVTVVQRSGQLLSNEDADMADIVRLRLESEGVRVLTRTEIQSIRRGADGVQVRLVHEGSEKLLSAAELLVALGRAPHVSGLTLENAGVVYSARGVGVDARMRTNVPHIYAAGDVTGRYLFTHAAGYEGGIIIANAVFRLPKKADYTNMPWCTFTDPELASVGLNERRAQAAGVDYTVRTELFSGNDRALAEGAPEGRIKMLLDPREKVLGVQICGAGAGEIINQWVAVQAGKVSLSRIAGAVYPYPTLGEISKRVAGNVMADKLFSGKVQSALCFLFRHQGKACS

SEQ ID NO: 29841 - protein, 463 aa, Desulfovibrio desulfuricans G20
MPVQPPEERIRNFDEVATGYTLEMAAEEAARCLQCKKPKCVKGCPVEVPIPQFIAHLAAGDIDAAYRTLKSTNSLPAVCGRVCPQEVQCEGECILTAKGQPVAIGRLERFVADEYMHRDACGLISGKPECPLIDPHKKVACIGSGPASLTAAGYLAARGCKVTVFEALHELGGVLVYGIPEFRLPKEKIVAKEVNALRELEVDFVRNRVGGKTFSIGELFAQGYRAVFIGVGAGLPRFLGIPGENLNGVFSANEYLTRVNLGRAYSFPDYDTPIIRGRRVTVFGGGNVAMDAARTALRLGADSVHIVYRRTVAEMPARHEEVEHAMEEGVKMQELCAPIAFVPDAEGCLSGVRLQQMQLGEPDQSGRRRPVPVEGSELLLPTDLAVIAVGTRSNPVLLEAEPELDLNRWGYISINSDTGETSIPDVFAGGDIVTGAATVILAMGAGRTAAKEIARRLGCQPDD

SEQ ID NO: 29842 - protein, 223 aa, Desulfovibrio desulfuricans G20
MNILIFGPNGSGKGTQGSLVKQKYNLAHIESGAIFREHIGGGTELGKKAKEYIDRGDLVPDEITIPMVLETLKSKGANGWLLDGFPRNMVQAEKLWDALQAENMKLDYVIEILLPREVAKNRIMGRRLCVNDNNHPNNIFIDAIKPEGDKCRVCGGALSSRADDQDEGAINKRHDIYYNTEDGTLAAAYFYKDLAAKGATKYIELNGEGDINSIKETLLAQLA

SEQ ID NO: 29843 - protein, 240 aa, Desulfovibrio desulfuricans G20
MYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 29844 - protein, 462 aa, Desulfovibrio desulfuricans G20
MGPASSGRETLSRLIQAGVRIFRLNFSHGDASQFVDLIALMRQLEAEYQTPITLLQDLSGPKIRIGELPDGALTLAKDDRILLGIPGKAAADGLPFVPFTHKTILDGMEPGDRVVLSDGGLQFHVESKVGPDLFCLVANNSGIITSRKGLALPGKPIHLAALTEKDKKDLQDGLRMGVDAVALSFVQTPEDVAEAKALIKAAGRNVPVIAKLERRNAVDRLEEILEVTDIVMVARGDLGVECPLPELPAMQKRIIRACNRKAKPVIVATQMLLSMVNSPSPTRAETTDVANAVLDGADCVMLSEETAMGNFPVETVQFMRQIVRAAEELHLEQSSVLPPLDEQKTPDFLAYSACLLADKTCAGAIVAHSMSGSAARVLSARRPRQTIHALTPDDEALRFLNFSWGVWPHKVDETLPGHLERAELFVDNAPQFEDGAEVVITAGQPKPGEKPRGTNLVKIYRK

SEQ ID NO: 29845 - protein, 1014 aa, Desulfovibrio desulfuricans G20
MHISRRSFIKATAASGIAAAFGGLGLSLVPSVSQAKLLPLRWAKQTTSVCCFCAVGCGLLVHTDKTSHRAVNVEGNPDHPVNEGSLCSKGASIYQVAENAERPATPMYRAPYSDAWQPVSWDWALTEIARRIKKDRDASFRFQNDMGLTVNRCDGIASVGSAALDNEECWVFQSILRALGLVWIEHQARICHSSTVPALAESFGRGAMTNHWNDIQHSDCVLVMGSNAAENHPISFKWVLRAMEKGAKLISIDPRFTRTSAKADLYVQIRAGTDIAVLGGLINYIIENDLIQRDYVVSHTNAPFLVSDSFSFKDGLFSGYKAGSKDSHYQGRYNKSLWDFAKDENGLPLKDETLAHPRCVYQLLKKHYSRYDIDTVVSVSGADKQGLLEFYRQYAATGKPDKAGTIMYAMGWTQHTVGTQYIRTMAMVQLLLGNIGVAGGGVNALRGESNVQGSTDHALLWQSLPGYLAVPDATHTSYKKHLEIKTAPHLAAAKDPKSAAWWQYYPKYMASFLKSMYPQAELADAYNWLPKADQGKTYTWLELFDAMHDGEFKGFFAWGQNPACSGAHAGKNREAMAKLDWMVNVNIFDNETGSFWRGPGMQPEKIKTEVFFLPCCVSIEKEGSITNSGRWMQWRYAGPDPRGAARSDGHIMVELMEKVRALYAEEGGTFTAPIEALSLDMWRDQKGYNPHNVARLINGTFLRDVTIKGTTYKKGQQVPSFALLQDDGSTCSGNWLYCASYTDEGNMGERQSRQQSPEQEKLGLFPNWTWCWPLNRRILYNRASCDLTGKPYNPQMPVISWTGEKWTGDVPDGGWKPGEKYSFIMKPHGHGRIYGPGLEDGPFPEHYEPMETPLKSHPLSRQRSNPACLSFNDEYKAVADPKFPYVATTFRVTEHWQTGLMTRHMPWLLEAQPQMFVELSEELARKLGVGNGDKVVVESARGSIWAVGMVTERVKPLRILGKTVHQISMPWCFGWFMPHDGSGGDSSNLLTAAVGDANTGIPETKVFMANVRKA

SEQ ID NO: 29846 - protein, 199 aa, Desulfovibrio desulfuricans G20
MRHHKGGMMTVSRRTFIKAAAGAATATAFAGLGVSLSPGVARAQLLKLEWARQSTSVCCYCAVGCGLIVHTSKDGQGRAINVEGDPDHPINEGALCAKGASIWQLAENDRRPASPMYRAPYSDHWQPVSWEWALENIAARIKKTRDESFITRNEKGEQVNRTDVIASAGSAALDNEECWVYQSFLRSLGLVYIEHQARI

SEQ ID NO: 29847 - protein, 273 aa, Desulfovibrio desulfuricans G20
MKQTQRWDIGLHDLTLGYGDSVVLDKLNATLPAGKISVILGGSGCGKSTLLRHILGLNKPKKGNVLLGGKDLFSLSGKEFRRLRRRMGVLFQDGALLGSLTLGDNVALPLAEHTALDKDTINTIVRHKLSLVGLADFAHYYPSQLSGGMRKRAGLARAIVMDPPILLCDEPTSGLDPINAAQMDALLLEMKKRFPDMTIVVVSHDLQSLDSIADYVLVLNEKHAVYEGDLQTLRQSEDPFLRQFLDRKAGAPQSVDAPLGETVRKALADWLDS

SEQ ID NO: 29848 - protein, 416 aa, Desulfovibrio desulfuricans G20
MVEKNRPAGRAGRHAAVAASRPVRLKDVTEQHHTPFGTGIAELDRILGRGLVPGAALLVGGEPGIGKSTLLLQVAGAVAASGRSVLYLSGEESLGQLRGRAERLGVLYDTMLAVSSSRVEDALPMLEEQPAPDLLIVDSVQTLTSTRAEGLPGSVSQVRAVSTELAEKCRACGTCVLFVGHVTKDGQLAGPKLLEHMVDTVISLEGDRRQQFRMLRVLKNRFGPNQELLVFRMVQQGLDLVDDPSTFFLDARDPSLSGTSVVMTVDGQRPFAVEMQALVTRSYLSIPRRTALGVDVNRLHLLLAVLEKRLRLNFGQVDIYAKVGGGMRVQDPGMDLALVAAILSSFYDVPLPARSVFWGEVDLNGQIRPVSAQSVRSVQAKRLGYSSMFCPEEGGTGVTTIGMLQEKLFRNPAADA

SEQ ID NO: 29849 - protein, 213 aa, Desulfovibrio desulfuricans G20
MFLALPQKTEYGGDMDFLPIRRALLSVTDKSGLVEFATFLTQNGVELVSTGGTQRTLTEAGLDVTPVSKVTGFPEIMGGRVKTLHPHIHGGILADKDNPEHLATLKELGIRTFDLICVNLYNFADAAARGLDLRGAVEEVDIGGPCMLRATAKNFHSMLVLPDPADYQAAMQEMRDNDMRVGLAMRQAMAVKTFRATSAYDGMIADYLGSKTA

SEQ ID NO: 29850 - protein, 465 aa, Desulfovibrio desulfuricans G20
MAPQFCTTPVPVPPVHTGYRHIATPLPVPESLALLEEMRACEPRSVDCQPPLVWHGAQGVQVYDPYGNIWLDFTSGVLVTNIGHCQPEMVQAARAELDAHRFFSYCFATEPRIRLARRLVDMLQPHIGTACKAFIMSTGSEATENALKLARAHGRSLHPEKNVIVSFDRAFHGRTLGAQQMGGYPAAKSWIGNLDPAFVQVPFPDGLHCTDTSFNLFSRRLAQLGIAPQRVAGVIMESYQGGGASFAPEEYVRELRSFCSRHEALLIMDEVQSGFGRTGRLFAFEHYGIAPDLVCLGKAVSGGLPVSAVAGRADVLDMHDPGSMTSTHGGNPVACASAAANLEVLLRDGLTEAAAATGHILRQGLEGLRQRHAGHIMAIHGRGMVQGIHVGRTEPDGTPCPDGALAFDVTERAFRKGLLLFAPVGTGGATIKICPPLIMQPDAVLEGIDVLTQCFDEALSAETDR

SEQ ID NO: 29851 - protein, 303 aa, Desulfovibrio desulfuricans G20
MAALVGNTPLVRLNRLARGCHAEVVAKLEFYNPCASVKDRIARSMIESALESGEINADSLLVEPTSGNTGVGLAFICAVHGLRLTLTMPESMSDERKKLLRSFGTTLVLTPAAQGMRGAIAEAERIVRETPGAVMLQQFANPANPAAHYATTAEEIWRDTDGRVDAFVAGVGTGGTITGTGRRLRELNAGVRIIAVEPEASPVLSGGAPAPHPIQGIGAGFVPEVLDTGIYDEVFKVSGDDAMNTARDLLRQEGILCGISSGANAFAALEAARRPEMKGKRIVFIVCDTGERYLSTPLFSGQS

SEQ ID NO: 29852 - protein, 471 aa, Desulfovibrio desulfuricans G20
MERCHAVILAGGSGTRLWPLSRALFPKQLLALNGELTLLQQTVKRALDIFPPQRIHIVTNEEHVFEVRAQAKALDAALEDNVLAEPMIRNTLPALMLGLNAAMKQDAAPLLAVFPSDHMIHNAASWQRAVQAGAELAAQNHFVTFGIPPAHPETGYGYIHRGARIADGCYAVEGFVEKPPREKAEEFLRGGMHFWNSGMFVFNGEDLIAALETYQPALAAWWNTRTATSLRQGYSAIPSLSIDYGIMEHVSRIAVVEADFGWDDLGSWEAIFRLGEKDEQGCVVQGDAMAIDCENSLLLSRGGKLAAIGLKDVIAVQTRDATLLCAKDQVQRVREVVSRLKAEGSPLTEVHLTVHRPWGSYTVLEENAGYKIKRIAVHPGARLSLQRHYHRSEHWVVIQGTALVQVGDKEMLLSQNQWAEIPETAVHRLTNPGRIPLEIIEIQTGPYLEEDDIERFEDVYGRPKGGKNKSN

SEQ ID NO: 29853 - protein, 392 aa, Desulfovibrio desulfuricans G20
MNVLKMTDLDLRGKRVLIREDLNAPIKDGAVANDNRLRAAAPTIRLAMQAGARVMVMSHLGRPAEGAFDESASMAPVAARLADILGCPVPVVRDWLDGVDVPEGGVVLTENVRFNKGEKKNDEELGRRMAALCDVYVMDAFGTAHRAQASTHAVAAFAPVACAGPLLAAELEALGKALGAPRHPVVGIIGGSKVSTKLTLLETLSSKVDKLIVGGGIANTFIRAAGFAVGKSLYEEDLVAEAARLMQAAAAAGGEIPVPVDVVVATEFAETATPVCKPVDQVADNEMIMDIGPQTAAMYAEVLRGAGTIVWNGPVGVFEFDAFGAGTEALCRAVAQSSAFSIAGGGDTVAAVDKYGVRDGVSYISTGGGAFLEFLEGKELPAVAMLEQRAKA

SEQ ID NO: 29854 - protein, 366 aa, Desulfovibrio desulfuricans G20
MEKVSLNGISKRFGDVRVIHDVSLSIRENEFIVLVGPSGCGKSTILRMIAGLESVSGGEIRIGGRVVNDVPPKERDVAMVFQNYALYPHMTVGENMGFSLKMQKRPGAEIESKVQEAAAVLGLTEYLHRKPAALSGGQRQRVAMGRAIVRKPQVFLFDEPLSNLDAQLRTQMRMELKKLHLKLNTTTIYVTHDQVEAMTLADRIVLLKDGHIQQVGAPVDVFERPANVFTGRFIGNPPMNVLQAVLHKDADDAGRHVAAEGLRIAVADTVGAALPHGTPVTVGIRPDAVKTGDALMHLPEHCHMDARVEVAEILGGQSLLEVSAAGVPLIAEVAGRVLVRPGDSIRIGVDPARVLLFDAQTQNAVD

SEQ ID NO: 29855 - protein, 463 aa, Desulfovibrio desulfuricans G20
MPNQPPAERVRNFDEVALGYTPEMARQEAGRCLQCKKPRCVKGCPVEVPIPQFIAALAQGDVEHAYRIIKTTNSLPAVCGRVCPQESQCEGACILQAKGQPVAIGRLERFVADEYMHRDACGLITGKPECPYIDPEKKVACIGSGPASLTAAGYLAAHGCKVTVFEALHELGGVLVYGIPEFRLPKEKIVAKEVNALRELQVEFVRNRVGGKTFSISDLFAQGYKAVFIGVGAGLPRFLGVPGENLNGVFSANEYLTRVNLGRAYSFPEYDTPIIRGRRVTVFGGGNVAMDAARTAMRLGAESVHIVYRRTQAEMPARHEEVEHAIEEGVQVAELCGPLEFRAGENGSLAAVVLQKMELGEPDESGRRRPVAVQGATVELPTDLAVIAVGTRSNPVLLENEPELKLTGRGYVSVDEETGETSMPGVYAGGDIVTGAATVILAMGAGRRAAKHIARSLGCAVED

SEQ ID NO: 29856 - protein, 369 aa, Desulfovibrio desulfuricans G20
MGSVREDIDAVDRELLALLNRRAELSLEVGRIKRDDPGVIFKPFRERDVLEKLRSLSAGPLPEEHLRSIYREILSSSRSLQRPQRVAYLGPEGTFSYFAGIQFLGHSVEFLPQKDLHGVIRSVHARECELGVLPLENSLHGTVGQSLDLFLRYEVFINAELFCRISHSLLTAEKRLSDITTVYSHPQPLAQCGEWLRLNLPGARIIPTESTAAAARRIKGEKGAAAIGHGNLAERLGLSVLASAIEDQPDNWTRFVVVGPVPADREGRDKTSMLFTLPDKSGSLAQVLNILAREDINMKKLESRPLRGEKWQYVFFVDVECDLNHEDYRQLVDELKHVCHSLRILGSYPAGMYFDVARTADGSERLVTE

SEQ ID NO: 29857 - protein, 270 aa, Desulfovibrio desulfuricans G20
MHTEHITSPADRLTMRIREANRQGRKALIPFLPAGFPDSGDFWRQLDELDAGGADVLEIGIPFSDPCADGPVVEQASLESLARGTTLRGVLEELERRKGRYRAGIVLMGYLNPFLQYGLDALARDAARAGVEGFIIPDLPLEEDALCRGALAAEGLALIPLVASNTDEDRMRAYAGVAQGYVYVVSVMGTTGARTDLPAGVTATLERARRCFDLPLALGFGVREPEQLAACGDRLDAVIFGSALISHIRTQGSAASFMERWRRPVAELVL

SEQ ID NO: 29858 - protein, 305 aa, Desulfovibrio desulfuricans G20
MQIAIIGLGRMGMNMARRLLRGGHEVAVWNRSPAKTQVMEAEGAAGFTSLQALAASLAPPRTLWFMLPAGEATQQRMDEVLPFLQPGDVVVDGANAYWKDDRPRADRLAAHGIRYVDAGVSGGIWGLENGYCTMLGGEAADIRHLAPVLDTLAPPQGWMHCGPAGAGHFVKMVHNGIEYAMMESYGEGFDLLRNGPFSGLDLQGIAALWNRGSVVRSWLLELLDAALKKDPGLASLKGYVDDSGEGRWTVTDAVDHAVPVPVLAQALFRRFESRQDDLFSNKVLAALRNEFGGHAVKNTDEGDAS

SEQ ID NO: 29859 - protein, 460 aa, Desulfovibrio desulfuricans G20
MTPERIYEVTEAQRAFFQSGATLDVDGRIASLRTLRGAVHDYTRRFIVAAAQDAGLSEHMVLAAEIAPVINDIDHMIKRLPALAKGRLVRRSRLHMWGWSRSVPRPAGIAVAVTAADMPVQRALMPVVSALAAGTPLLLALSPRTPAVNGIVERLVQQFFKPEQITVTTADNETTEAILGQRFDACLCSAPRETAVRFARAAAEHLVPAVIETAEHRNPAIVLEDADIRLAARRIVWAKTLAAGQTAAAPDYLVVHGAVRERLLAALRKELEAQHGAIPSASSAFGRMTDNAAYEEAAAFLTDGTPVIGGDTDPAGRFINFTVLENVQPDAPVMRSVTRSPVLPLFEVQSAEQAVELVNSRPAPLALYVFSTDVFTARKVLDATTSGTAAVNDVLVQTVYPALPFGDAAGGGMGSHRGEAGFFAFSRLRSVTRGTNFIDLPFRFSPDAGWKQKILRYIIR

SEQ ID NO: 29860 - protein, 255 aa, Haemophilus somnus 129PT
MVTKQLSGKRLFVIDAFCGANPDTRLAVRIVTEVAWQAHFVKNMFIRPSDEELQNFKPDFTVMNGSKVTNPNWKEQGLNSENFVAFNITEGVQLIGGTWYGGEMKKGMFSMMNYFLPLKGIASMHCSANVGKDGDVAIFFGLSGTGKTTLSTDPKRQLIGDDEHGWDDDGVFNYEGGCYAKTIKLSAESEPDIYRAIRRDALLENVVVREDGSVDFDDGSKTENTRVSYPIYHIDNIVKPVSKAGHATKVIFLTA

SEQ ID NO: 29861 - protein, 421 aa, Haemophilus somnus 129PT
MNNYLNIWRGNMTTKVSLDKSKIKFLLLEGIHQNALEVLKAAGYTNIEYHRKALEPDELKIAIKDAHFIGIRSRTSLTEDILAEATKLIAIGCFCIGTNQVDLEAAKARGIPVFNAPFANTRSVAELVLGEILLLMRNIPQANADVHRGLWNKSMVGSYEVRGKRLGIIGYGHIGSQLSIIAEALGMNVYFYDIETKLPLGNAQQMNSLEELLSTCDVVSLHLPENSSTKNLMNAERIAQLKANCIFINAARGTVVDIDALAQALESKKIRGAAIDVFPKEPASIEEEFISPLRAFDNVILTPHIGGSTVEAQENIGVEVANKFVKYSDNGSTLSAVNFPEVSLPEHSNAKRLLHIHHNRPGILNKINQIFVEQNINIAAEYLQTEAKIGYVVIDVETEDTAQLLAKLKQIEGTIRARVLF

SEQ ID NO: 29862 - protein, 251 aa, Haemophilus somnus 129PT
MTDLNKVINELGELGIYDVKEIVHNPSYEQLFEEETKPGLAGFEKGVVTTSGAVAVDTGIFTGRSPKDKYIVLDEKTKNTVWWTSDAAKNDNKPMNQETWQSLKGLVTKQLSGKRLFVIDAFCGANPDTRLAVRIVTEVAWQAHFVKNMFIRPSDEELQNFKPDFTVMNGSKVTNPNWKEQGLNSENFVAFNITEGVQLIGGTWYGGEMKKGMFSIYELLLTIKRYRLNALFCKRRQRWRCGDFLRPIRYR

SEQ ID NO: 29863 - protein, 210 aa, Haemophilus somnus 129PT
MFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 29864 - protein, 444 aa, Haemophilus somnus 129PT
MLSAAMDTVTEAKLAISLAQEGGIGFIHKNMTIERQADRVRKVKKFESGIVSEPVTVSPTMTLTELAELAKKNGFAGYPVVDEQKGLVGIITGRDTRFVSDLNKTVADFMTPKDRLVTVKEGATREEIFHLMHEHRVEKVLVVDDSFKLKGMITLKDYQKAESKPNACKDEFGRLRVGAAVGAGPGNEERIEALVNAGVDILLIDSSHGHSEGVLQRVRETRAKYPNLPIIAGNIATAEGAIALADAGASAVKVGIGPGSICTTRIVTGVGVPQITAIADAAEALRERGIPVIADGGIRYSGDIAKAIAAGASCVMVGSMFAGTEEAPGEIELYQGRAFKSYRGMGSLGAMSKGSSDRYFQSDNAADKLVPEGIEGRIPYKGLLKEIIHQQMGGLRSCMGLTGCATIEELRTKAQFVRISGAGIKESHVHDVTITKEAPNYRMG

SEQ ID NO: 29865 - protein, 281 aa, Escherichia coli
MSQTSTLKGQCIAEFLGTGLLIFFGVGCVAALKVAGASFGQWEISVIWGLGVAMAIYLTAGVSGAHLNPAVTIALWLFACFDKRKVIPFIVSQVAGAFCAAALVYGLYYNLFFDFEQTHHIVRGSIESVDLAGTFSTYPNPHINFVQAFAVEMVITAILIGLILALTDDGNGVPRGPLAPLLIGLLIAVIGASMGPLTGFAMNPARDFGPKVFAWLAGWGNVAFTGGRDIPYFLVPLFSPIVGAIVGAFAYRKLIGRHLPCDICVVEEKETTTPSEQKASL

SEQ ID NO: 29866 - protein, 411 aa, Pseudomonas aeruginosa UCBPP-PA14
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKSMFRADGLLSPQRKVDSLAE

SEQ ID NO: 29867 - protein, 468 aa, Pseudomonas aeruginosa UCBPP-PA14
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGVGEAEFLDGLVEEFERKILELGADRVGAFISEPVFGSGGVIVPPAGYHRRMWKLCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 29868 - protein, 171 aa, Pseudomonas aeruginosa UCBPP-PA14
MAPTEAFADQVRHFKLAHTVETRNTCTYCSVGCGLIMYSQGDGAKNVAQNIIHIEGDADHPVNRGTLCPKGAGLLDYIHSPNRLKYPEVREAGSSEWKRIEWDEALERIAKLMKEDRDANFVEKNEQGQTVNRWLTTGFLAASASSNEAGYITHKVMRSLGILGFDNQARV

SEQ ID NO: 29869 - protein, 467 aa, Pseudomonas aeruginosa UCBPP-PA14
MMESYDVIVIGAGPGGYNAAIRAGQLGLKVACVEGRETLGGTCLNVGCMPSKALLHASELYAAASGGEFARLGIRVSPELDLAQMMKQKDESVAALTRGVEFLFRKHKVQWIKGWARLQGEGRVGVALADGGHAQLEARDIVIATGSEPAPLPGVPVDNQRILDSTGALELAEVPRHLVVIGAGVIGLELGSVWRRLGAQVTVLEYLERICPGLDGETARTLQRALTRQGMRFRLGTRVVAARSGEQGVELDLQPAAGGATESLQADYVLVAIGRRPYTEGLGLETVGLASDRRGMLENQGQRSAAPGVWVIGDVTSGPMLAHKAEEEAIVCIERIAGHAAEMNAEVIPSVIYTQPEVASVGLGEEQLQAARREYKVGRFPFSANSRAKINHESEGFIKILSDARSDQVLGVHMIGPGVSEMIGEACVAMEFSASAEDLALTCHPHPTRSEALRQAAMDVHGRAMQN

SEQ ID NO: 29870 - protein, 489 aa, Pseudomonas aeruginosa UCBPP-PA14
MSDSRYTDLGLQPLAGEWRHGRAGRRLKVSNPFDGSLLLEIEQADRDDLDAAYAKAAEVQPAWAALGPSARAAVLYKAVEVFDRRHEEIVDWLIRESGSTRLKAEIEWGAARAITLESASFPARVHGRIVESDVPGKESRVYRSAIGVVGVISPWNFPLHLTQRSIAPALALGNAVVVKPASDTPVCGGLLLARIFEEAGLPAGLFSVVVGPGSEIGDAFVEHPVPGLVTFTGSTPVGRNIGRIASGGAHLKHVALELGGNSPFVVLGDADLEQAVNAAVFGKFLHQGQICMAINRIIVEDSLYDAFAARFVERVKGLRVGDPQRADTAVGPIVNARQLEGLLEKIRLARQEGAKPLYEGGVDGQLLAPHVFGEVSATMEIARDEIFGPLVGLLRARDEAHALELANASEYGLSSAVFSRDLERAVRFARQLRAGMTHVNDIPVNDEANAPFGGEKNSGLGRFNGDWAIEEFTTDHWISVQHAPRQYPF

SEQ ID NO: 29871 - protein, 417 aa, Pseudomonas aeruginosa UCBPP-PA14
MLFDGYDMVIYGSVVPRLMQEWQLSPVQAGTLGSCALFGMLFGGTLLAPLADRFGRRRLVIATTLLASLAAFLTGHARDPLELGAGRFFTGLALGALVPSAINLISEFAPAGRRSTLVTVMSAFYSVGAVLSALLAIAMIPAWGWQSVFYVAVLPVLAVPLMLRWLPESAAFLELKGRRAELDALLRKVDPDYRPGAERANAVAAEAPSGRVAQLFEGRQAVGTLLLWVAFAMCMLMSYGLNTWLPKLMAGGGYALGSSLAFLVTLNVGATLGALFGGWLADRLGAGRTLVLFFALAAASLAALGLGPGPWLLNGLLVVAGATTIGTLAVIHAYAAQFYPAWVRSTGVGWAAGVGRLGAIAGPMLGGSLLALELPFQQNFLAFAAPGVIGALAIACIHLRPRVPAEASVDATAKKPL

SEQ ID NO: 29872 - protein, 502 aa, Pseudomonas aeruginosa UCBPP-PA14
MTMTFQHDDLPLALYSAAQVRDLDARLIAAGTPGFELMQRAAHAAWRALRRRWPEAAALTVLAGHGNNAGDGYLIAALAQRAGWRVRVLAVAAPQRLAGDAAQAHAAALATGVVVEPWSECAVLEGVVVDALLGTGLAGAVREPFAQAIRLANAADLPVLAVDIPSGLSADTGAVLGEAIRADLTVTFIGLKIGLFTGEAPARVGELVFDELGSDAVVLQALQPRARRLARNALPRLAARPRTAHKGLFGHLLVVGGDTGMGGAVLLAAESALRCGAGLVSAATRVEHVPALLGRCPEVMAHGVASANQLLALAERASVLVLGPGLGQRAWGRSLLSAVRSRPLPQVWDADALNLLALEPVGAGPQTWILTPHPGEAARLLGRSTAEVQADRPAAALELARRYQAVVVLKGAGSLIAAPDGRLAVCSQGHPAMAGAGLGDVLSGITGALLAQRVEAFEAACLAVWLHAAAGERLGAQGRGLAATDLIPTVRQLLEECSPCLK

SEQ ID NO: 29873 - protein, 470 aa, Pseudomonas aeruginosa UCBPP-PA14
MADGKERLQLTRALASRHIFMLSLGGVIGTGLFMGSGVTINQGGPAGAVLAYLVAGVLMYLVMVCLGELSVQMPVSGSFQAHATRFIGPATGFMIGWVYWMSWASTVGLEFTAAGMLMTRWFPEVPVWLWSGFFVVVLFSLNALATRAFGEAEYWFAGIKVAAILVFIVVGGLVIFGGIELKSGAPAPMFSNLVGERLFPNGLSAVFAVMMTVVYAFQGCEIMGVAAGETERPEKSIPRAVRNVVFRVLIFYVLAIVVLSAIIPWQQAGLVESPFVQVFDMVGIPYAADLMNFVILTAILSVGNSGLYASTRILWAMSRTGMAPRGLSKLSARGVPLYALLITLCFALLSLLTSVIAADTLFMVLMAVSGMSGTVTWIVIAYAQYRFRREHMASGGTVAELKYAAPLFPLVPLACIAVCCSLFVFLALDPTQRPSLYWGFGFIAACYLAYYVVRRRQPQGLGDPALGRAG

SEQ ID NO: 29874 - protein, 309 aa, Pseudomonas aeruginosa UCBPP-PA14
MHPWARRNIPQLAGRLALVTGANSGLGWQAARTLAGKGATVVMACRNREQAERARRAILDEYPQARLELADLDLADLASIRACAAGFRQRHERLDLLFNNAGVMFLPLRRTRDGFEMQMGTNHLGHFALTGLLLDSLLAAPRPRVVGMTSGFNQFGRLPLDDLNAERGYNRYLAYCHSKQANLLFSLELQRRAGQRGVLLQSLAAHPGYAATNLQYAAPAMSGSRLGRWAMKVANGAFAQSAEMGALPALSALTEQRWYGGAYVGPDRWLETRGYPAAARIPRNARDLGLAARLWALSEELTGVRFWSE

SEQ ID NO: 29875 - protein, 449 aa, Pseudomonas aeruginosa UCBPP-PA14
MALGSAIGTGLFYGSASAIQMAGPAVLLAYLVAGAAVYMVMRALGEMAVHEPVSGSFGHYASSYLGPLAGFVTGWTYAFEMIIVCLADVTAFGIYMGFWFPDVPRWIWVLSIVLFIGGLNLCHVKVFGELEFWLSLVKVGAIVAMILAGLGIMFFGFSLDGAATSATGVHNLWQHGGFLPNGWAGLVASLSVVVFAFGGIEIIGITAGEAQDPQRVIPRAINAVPLRILLFYVLTLFVLMAIFPWQQIGSNGSPFVQIFDGLGIESAAAILNVVVITAAISAINSDIFGAGRMLYGMARQGQAPVGFSRVSRHGVPWMTVLLMAVALLLGVALNYLIPQSVFLLIASIATFATVWVWLMILLAQVGMRRRMGPRQVAALKFPVPLWPFAPAAAIVFMLFIFVVLGYFPDTRPALWVGAIWIAVLVIAYRRWVRPKGDAAHGVLQAQGGL

SEQ ID NO: 29876 - protein, 497 aa, Pseudomonas aeruginosa UCBPP-PA14
MTTLTRADWEARAKDLKIEGRAFVNGEYSNAASGETFDCLSPVDGRFLAKVASCDLADAEQAVKVARNAFDSGAWSRLAPAKRKQAMIRFADLLLENAEELALLETLDMGKPISDSLHIDVASAANSLRWSAEAIDKIYDEVAATPHAELGLVTREPVGVVAAIVPWNFPLLMSCWKLGPALATGNSVILKPSEKSPLTAIRIAQLAVEAGIPKGVFNVLPGYGHTVGKALALHMDVDTLVFTGSTKIAKQLMVYAGESNMKRVWLEAGGKSPNIVFADAPDLKAAAEAAAGAIAFNQGEVCTAGSRLLVERSIKDKFLPLVIEALKGWKPGNPLDPETNVGALVDTQQMNTVLSYIEAGHNDGAKLVAGGKRTLEETGGTYVEPTIFDGVTNAMKIAREEIFGPVLSVIEFEDAEEAVRIANDTPYGLAAAVWTSNLSKAHLTAKALRAGSVWVNQYDGGDMTAPFGGFKQSGNGRDKSLHAFDKYTELKATWIKL

SEQ ID NO: 29877 - protein, 442 aa, Pseudomonas aeruginosa UCBPP-PA14
MVGNPALAELLRAPRLIPWRNWSGAQSCLPLAREAPKDLDELVRVIRQASGRIRPVGSGHSFSALVPTDGTLLSLAYFSGLLSHDSATLQAEFGGGTPMSQMGAPLKEIGQALVNMADIDYQTLAGAIATSTHGTGVGFGSYSAQVRGLQLVTASGEVLECDAKRNVEVFDAARVSLGALGVVTRVRLQNRAAYRLRERQWIARTEELLEDVEKNTRENQHWEMLVVTHSDYALSIALNETDEPKTPPLDPAKEGGNEFVGLIEGLDKYLSDFPETRRTLLNSLRHFARFDERVDDSYAVYANVRNVRFNEMEYSVPAEHGPACLREILALIRDKDLRTWFPIEYRYVKADDIPLSMFEGRDSCSISVHQHYSMDHHNFFAAVEPIFWKYAGRPHWGKLHGLNAHQLQGLYPRWKAFAEVRQALDPRGRFLNAHLSSILGVT

SEQ ID NO: 29878 - protein, 490 aa, Pseudomonas aeruginosa UCBPP-PA14
MARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTTLKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGNGAYVAPTVFTDCSDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 29879 - protein, 321 aa, Pseudomonas aeruginosa UCBPP-PA14
MWRFVEHSRAFASDSPRLDAQRAAYARMCQAFAPPRPAGLRVLDSCLPAAPPVRVRRYRPDRPAPPGGWPALLYLHGGGWMLGGLDSHDFICADLAARLGLLVLAVDYRLAPEHPFPAALQDCLRAWQALSLGELDEALDGRRLLVAGDSAGGNLAAALCLALRDGGAPSPAAQILLYPLLSAAPSPSRIDCADAPLLGLGDVQACLDAYLPLAALHRQPLALPLEAADFTGLPPAFVAVAEFDPLRDDGERYGAALRAAGGEAGFYPGSGLVHGCLRGHGIDEVEALHEALRRAVQGFLAEDSGERQAGEESTAEHQPGE

SEQ ID NO: 29880 - protein, 479 aa, Pseudomonas aeruginosa UCBPP-PA14
MLIPVVLSGGAGTRLWPVSREGQPKPFMRLPDGQTLLGKTYRRAAGLLAGHGEIVTVTNREHYFQSKDQFQAARLGRHRGHFILEPTGRNTAPAIAVAALALQAEHGDAAVLVVMPADHLIRNEEAFREAVGHAARLAVAGHLVTFGVVPDAAETGFGYIELGDRLDEQGAAKVRRFVEKPDEETARRYVESGGFLWNSGMFCFTASTLVDELAQHAPALLEQARACLAASAAVKMADGIQHELAGEAFAALPDISIDYALMERSARVAVVPAAFDWSDIGSWGAMSALLDADAEGNRGSGDTLFVDTRNTFVQSDGRLVATVGVDDLVVVDTSDALLIARADRVQEVRRVVQRLKDERHEAYRLHRTVNRPWGSYTVLEEGPRFKIKRIVVRPGERLSLQMHHHRSEHWIVVQGMARVTNGDGARLVNSNESTYIPAGHRHRLENPGVIDLVMIEVQSGEYLGEDDIVRFEDQYGRVV

SEQ ID NO: 29881 - protein, 455 aa, Pseudomonas aeruginosa UCBPP-PA14
MHFADPREAREFLAAHPEVRSIELFLIDANGVPRGKLLHRDELLAVYESGRPLPSTILGLTINGDDVEETGLVWDVGDADCWTFPLPGSLTLQPWRQSPTGQVQVSMHPEFGLPAAAGDPRHVLQRVIHSLQAEGFHPVMAVELEFYLLDRERDSDGRPLPALQMNGQRPRATQVYGVYELEQLQPFLDDLYAACEAQGLPARTAISEYAPGQVEITLQHRFDALQAIDEGVRYKRLVKGVANRHGLQACFMAKPFADLSGNGLHLHVSLADAAGNNLFASKDPAGTPLLRQAIGGMKACLLESLALFCPNANSFRRFQANSYAPLAPTWGINNRTVSLRVPGGPPSSRHIEHRICGADANPYLAAAALLAAVRLGIRERLDPGAPITGNGYAQATQALPSDWLTALRALEGSAWAREALGEDFLKIYLAIKQAEYRAFMGEVGEQDWRWYLNQA

SEQ ID NO: 29882 - protein, 268 aa, Pseudomonas aeruginosa UCBPP-PA14
MSRLQTRFAQLKQENRAALVTFVTAGDPDYASSLEILKGLPAAGADVIELGMPFTDPMADGPAIQLANIRALDGGQTLARTLQMVREFRSGDSETPLVLMGYFNPIHHYGVERFIAEAKEVGVDGLIVVDLPPEHNEDLCHPAQAAGLDFIRLTTPTTGDQRLPTVLEGSSGFVYYVSVAGVTGANAATLEHVEEAVARLRRHTDLPIGIGFGIRSAEHAAAVARLADGVVVGSALIDRIAKARDNAQAVKDVLALCGELAEGVRNAR

SEQ ID NO: 29883 - protein, 475 aa, Pseudomonas aeruginosa UCBPP-PA14
MSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLEAIAAAAILNAWFPAIDTWIFALAVTFLLTVTNLFSVARYGEFEFWFALLKVIAIIAFIVLGAVAIVGGLPEREVSGLSSLMASHGGFVPNGYGAVLGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQVSGQPIEFRMWLYPWLTWAVILFIVAALSIMLIMPEHRHEVFATALLTIFTVCLGLLNARRKPRLGEDYAGKTARV

SEQ ID NO: 29884 - protein, 448 aa, Pseudomonas aeruginosa UCBPP-PA14
MNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPGMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKVLHGLQGAKNVIDIRNCGLAGAIQIAPRDGDPTVRPFEAGMKLWQQGFYVRFGGDTLQFGPTFNARPEELDRLFDAVGEALNGIA

SEQ ID NO: 29885 - protein, 320 aa, Pseudomonas aeruginosa UCBPP-PA14
MDRLPIIDIAPLYGADRGAWNDVARRIDQACREWGFFYIAGHPLPAARFEALLAAAREFFALPVEEKLKIDITRSRNHRGYGAIATEQLDPALPSDFKETFDMALHLPAEHPDVRAGKSFYGPNRHPDLPGWEALLEGHYVDMLALARTVLRALAIALGIEEDFFDRRFEQPVSVFRLIHYPPAAARQSADQPGAGAHTDYGCVTLLYQDAAGGLQVQNRQGEWIDAPPIDGTFVVNIGDMMARWSNDRYRSTPHRVISPRGVHRYSMPFFAEPHMDTEIRCLPGCFDADNPPKYPPTTCGEWLTSRFAQTYAYRRGETA

SEQ ID NO: 29886 - protein, 476 aa, Pseudomonas aeruginosa UCBPP-PA14
MVADIAYLQQSQQEINQLEALFARQRAAYLAQPMPDATQRVQWLKALRELLFKEQQALIEAIDRDFSARSADETLLAEIMPSLHGIHYAAKRVKKWMKPARRAVGLQFQPASAQVVYQPLGVVGVIVPWNYPLFLSIGPLTGALAAGNRVMIKMSESTPATGRLLKDLLARIFPEDQVAVVLGEVDVGVAFSKLPFDHLLFTGATSVGKHVMRAAAENLTPVTLELGGKSPAIISDSVPMKDAAERIAFGKSLNAGQTCVAPDYVLVPSRRVEEFVSQYKEVVQGFFPRLSDNPDYTAIINERQLGRLRGYLDDAREKGATLVPLFAEGQQRRLPQTLLLNVSDDMKVMQEEIFGPLLPVIPYERLEDALAYVNQRPRPLALYYFGYDKAQQQRVLHETHSGGVCLNDTLLHVAQDDIPFGGVGPSGMGHYHGHEGFLTFSKAKGVFSKPRFNAARMIYPPYGKSIQKLVYKLFVR

SEQ ID NO: 29887 - protein, 467 aa, Pseudomonas aeruginosa UCBPP-PA14
MGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIIEPLIQGAGGMRMYHPVYLKLLREACDRYGVHLIHDEIAVGFGRTGTMFACEQAGIAPDFLCLSKALTGGYLPMSAVLTSETIYRGFYDDYQTLRAFLHSHTYTGNPLACAAALATLDIFEEDKVIEANRALSTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 29888 - protein, 455 aa, Pseudomonas aeruginosa UCBPP-PA14
MIDSLNHLPRPDAGADTLAERFADLAPPLNARQAALESARCLYCYDAPCVNACPTEIDIPGFIRSIAQENVQGAAQKILSANILGGSCARVCPTEILCQRACVRNNAQECAPVLIGQLQRYALDHAGFGEHPFKRSPATGKRIAVVGAGPAGLSCAHRLAMHGHDVVLFEARAKVGGLNEYGIARYKLVDDFARREVEFLLQIGGIELRHGQRLGDNLALGALHDEYDAVFLGIGLAASKRLGLEDEDAPGLLAATDYIRELRQSDDLLDLPVADRCIVIGAGNTAIDMAVQMSRLGARDVNLVYRRGFEEMGATGHEQEIAKASQVRLLTWARPERVLLDEQGRVRGMRFARTRLENGRLGDTGEHFELAADAIFKAIGQAFEGASLGDPLAAQLRRDGERIQVDGQMRTSIPGIYAGGDCVALGEDLTVQAVQHGKLAAEAIHAQLMLNVEAA

SEQ ID NO: 29889 - protein, 298 aa, Pseudomonas aeruginosa UCBPP-PA14
MKQIAFIGLGHMGAPMATNLLKAGYLLNVFDLVQSAVDGLVAAGAGAARSARDAVQGADVVISMLPASQHVEGLYLDDDGLLAHIAPGTLVLECSTIAPTSARKVHAAARERGLAMLDAPVSGGTAGAAAGTLTFMVGGDDEALEKARPLFEAMGRNIFHAGPDGAGQVAKVCNNQLLAVLMIGTAEAMALGVANGLDAKVLAEIMRRSSGGNWALEVYNPWPGVMENAPASRDYSGGFMAQLMAKDLGLAQEAAQASASSTPMGSLALSLYRLLLKQGYAERDFSVVQKLFDPTQGQ

SEQ ID NO: 29890 - protein, 1060 aa, Pseudomonas aeruginosa UCBPP-PA14
MFKASHVLQGEDQTRSAAEFFPVISANYAVDEEAYLGELLQLADPGPDGIEAIRRNARALIETVRSRDNAVDTLDALLRQYSLDTQEGLMLMCLAEALLRVPDAATADALIRDKLSAADWQRHLGQSDNVLVNFAAWGLVMTGKVVNIDERTDGRAPSVISRLVQRSGEPVIRAAMNQAMKLMGKQFVLGRTISEALKNGRPCREQGYTYSFDMLGEAALTAADAEKYMADYRQAIDTVGAEPQVGPGPRPSISIKLSALHPRYEVAQRERVLSELFANVLELAVRARKLNVGITIDAEEADRLELSLELYEKLMRDPAIAGWGEFGLVIQAYSKRCLPVLVWLTLLGRELGARIPLRLVKGAYWDSEIKQCQVQGADGYPVYTRKEGTDTSYLACARYLLSEHTRGVIYPQFASHNAHTVTAILALADEARAAGGEERDFEFQRLHGMGDALYDTVIEKYRRNVRIYAPVGAHKDLLPYLVRRLLENGANSSFVHKLVDPRVPVETLIQHPVTQLRQFKTLANDRIPLPQAIFGAGRKNSQGINMNIQNQWNELELAYKPHLTRQWQAAPIVNGEKLSGPAHEVRCPYDLERLVGSVQYASAEQAGKALDVLQAAWPRWSATPVDERAGILERLADLLEAQRGELMALCTLEAGKSLQDGIDEIREAVDFCRYYAQQARQRLVREELRGPTGERNELFYEGRGIFACVSPWNFPLAIFLGQISAALVAGNTVLAKPAEQTSLIAARTVELMFEAGLPRDVIALLPGDGATLGGVFCRDARVAGVAFTGSTDTARIINRQLAEKPGAIATLIAETGGQNAMIVDSTALPEQVIKDAVQSAFTSAGQRCSALRVMYVQQDIAERVIELLKGAMAELKVGPTDVRVSDVGPVIDAEAKAGLEQHIAALKAAGKLIAETKVPGNLNGHFVAPVAFEISGIDELKKENFGPVLHVVRYAAQDLEKVVQAINATGFGLTMGVHSRNEETARRIEELARVGNLYINRNQIGAVVGVQPFGGHGLSGTGPKAGGPNYLLRFVSERTTSVNTTAVGGNASLLSLADAE

SEQ ID NO: 29891 - protein, 406 aa, Pseudomonas aeruginosa UCBPP-PA14
MSAPHAQVERADFDRYMVPNYAPAAFIPVRGEGSRVWDQSGRELIDFAGGIAVTSLGHAHPALVKALTEQAQRIWHVSNVFTNEPALRLARKLVDATFAERVFLANSGAEANEAAFKLARRYANDVYGPQKYEIIAASNSFHGRTLFTVNVGGQPKYSDGFGPKFEGITHVPYNDLEALKAAISDKTCAVVLEPIQGEGGVLPAQQAYLEGARKLCNEHNALLVFDEVQSGMGRVGELFAYMHYGVVPDILSSAKSLGGGFPIGAMLTTGEIAKHLSVGTHGTTYGGNPLASAVAEAALDVINTPEVLDGVKAKHERFKSRLQKIGQEYGIFGEIRGMGLLIGAALTDEWKGKARDVLNAAEKEAVMVLQASPDVVRFAPSLVIDDAEIDEGLERFERAVAKLVRG

SEQ ID NO: 29892 - protein, 328 aa, Pseudomonas aeruginosa UCBPP-PA14
MTAIEIARPGGPEVLVATSRPLPTPGPREVLVEVRAAGVNGPDVLQRKGVYDPPPGASDIPGLEIAGTVRAVGSEVSRFAVGEAVMALIPGGGYAQFAVADERTTLHLPDGLGMEEAAALPETFMTVWVNLFQRGGFKAGETLLVHGGASGIGTAATMLGKAFGAAKIFTTISSEAQREASLRLGADLAINYTEQDFVEEVLRGTEGRGVDVIVDIVAGDYVTRNYQAAAMNGRIVQIGVIKGKAAEVDLFPMLSKRLVHLGSTLRSRSHDEKGAIIAELERQVWPHVRAGTVRPQVFRTFPLEQARQAHELMDSGQHIGKIVLTSAP

SEQ ID NO: 29893 - protein, 444 aa, Pseudomonas aeruginosa UCBPP-PA14
MNNHNGTLHRGWQSLQRWRIQIFVITWLAYAAFYFTRKAFSVAKLGIAEDPSFELDKSAMADLDALYLAAYAVGQFMWGVFADRFGTRVVVLGGLLTSALAALAMGTFATLPIFAACMVVQGLAQSTGWSGLCKNIGAFFATYERGRVLGLWSTCYAFGGLVATPFAGWCAYRLTHDWRMAFLSSAGVVLAVAVLFFFLQRNRPQDVGLPPVEAEAAPPANAPRPSHSGALLKALRNPHVLVLGIAYFLLKPARYAILLWGPVIIYERMPEIGKVASAIVPSAFEVAGLAGPILIGLASDKLFGARRMPACVLSLAALTLSLALFVPAMQSGSLYLVVGLLFMMGVTLYGPDSMISGAAAIDFGTSEAAGTATGFVNGCGSVGAILGGLLPGYFDTLTVFFVFTATALLASLLLVPFWNSRPGARRVEPKAHAGGPLLAAGKPR

SEQ ID NO: 29894 - protein, 180 aa, Pseudomonas aeruginosa UCBPP-PA14
MLLSALALAGLPLSGWAADCPELLQGQLTKLRSKESIDLCQRYAGKPLVVVNTASHCGFTPQFKGLEALYQRYKGQGLEVLGVPSDDFKQEAADTAETAKICYGNYGVTFAMTQPQHVRGDEAIPLFRQLAEQSGQAPRWNFYKYVVDRQGRVVAQFSSKTTPDDPQLQAAIEKAIASQP

SEQ ID NO: 29895 - protein, 370 aa, Pseudomonas aeruginosa UCBPP-PA14
MLFSPYAFGHLTLPNRIVMPPMTRSRAASGEVATALMAEYYSQRAGAGLIVSEGTQISRQGQGYAWTPGIHSAEQVAGWRQVTDAVHAAGGRIFAQLWHVGRVSHTSLQPGNAAPVSSSALVAEGVKVFVDPQGRGAQAGGGEMVQHSAPRALAVEEIREIVADYAQAARNALDAGFDGVELHGANGYLINQFIDSQANARNDQYGGSLENRLRFLREVAEAVTAVVGRERIGVRLAPLTTLQGAVDDTPQATYLAAARLLDEIGVAYIHIAEADWEDAPAMPAAFKEALRIVYRGSLIYSGMYTKARAEEALAKGWADLIGFGRPFIANPDLPYRLEHDLALADGDRSTYFGGGAAGYTDYPSLPQAAG

SEQ ID NO: 29896 - protein, 477 aa, Pseudomonas aeruginosa UCBPP-PA14
MNSPALPLSRGLRIRAELKELLTLAAPIMIAQLATTAMGFVDAVMAGRASPHDLAAVALGNSIWIPMFLLMTGTLLATTAKVAQRYGAGDQPGTGPLVRQALWLALLIGPLSGAVLWWLSEPILGLMKVRPELIGPSLLYLKGIALGFPAAALYHVLRCYTNGLGRTRPSMVLGIGGLLLNIPINYALIYGHFGMPKMGGPGCGWATGSVMWFMFLGMLFWVNKASIYRASQLFSRWEWPDRATIGPLVAVGLPIGIAVFAESSIFSVIALLIGGLDENVVAGHQIALNFSALVFMIPYSLGMAVTVRVGHNLGAGLPRDARFAAGVGMAAALGYACVSASLMLLLREQIAAMYSPDPAVIAIAASLIVFSALFQFSDALQVTAAGALRGYQDTRVTMIMTLFAYWGIGLPVGYSLGLTDWFQEPTGPRGLWQGLVVGLTGAAIMLCIRLARSARRFIRQHERLQREDAAAASVLGR

SEQ ID NO: 29897 - protein, 319 aa, Pseudomonas aeruginosa UCBPP-PA14
MDKNLHQPLGGNEMPRFGGIATMMRLPHVQSPAELDALDAAFVGVPLDIGTSLRSGTRFGPREIRAESVMIRPYNMATGAAPFDSLNVADIGDVAINTFNLLEAVRIIEQEYDRILGHGILPLTLGGDHTITLPILRAIKKKHGKVGLVHIDAHADVNDHMFGEKIAHGTTFRRAVEEDLLDCDRVVQIGLRAQGYTAEDFNWSRKQGFRVVQAEECWHKSLEPLMAEVREKVGGGPVYLSFDIDGIDPAWAPGTGTPEIGGLTTIQAMEIIRGCQGLDLVGCDLVEVSPPYDTTGNTSLLGANLLYEMLCVLPGVVRR

SEQ ID NO: 29898 - protein, 477 aa, Pseudomonas aeruginosa UCBPP-PA14
MTADKKAKILATLGPATRSRDDIRALVEAGANLFRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNGHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 29899 - protein, 296 aa, Pseudomonas aeruginosa UCBPP-PA14
MAKIGFIGTGIMGKPMAQNLQKAGHSLFLSTHHDAAPADLLEAGAIALANPKEVAQEAEFIIVMVPDTPQVEDVLFRKDGIAEGVGPNKVVIDMSSISPTATKGFAEKIKATGAQYLDAPVSGGEVGAKAATLSIMVGGCPNTFERALPLFQAMGKNITRVGGNGDGQTAKVANQIIVALNIQAVAEALLFAARNGADPAKVREALMGGFASSRILEVHGERMVKGTFDPGFRISLHQKDLNLALAGARELNLNLPNTANAQQVFSTCAAIGGSNWDHSALIKGLEHMANFSIRDE

SEQ ID NO: 29900 - protein, 454 aa, Pseudomonas aeruginosa UCBPP-PA14
MNFACEQEAQDFLAANPDIELFELFILDANGVPRGKLLHRDELLAVYRSGRPLPSTILGLTMNGEDVEDSGLVWDVGDIDCRAYPLSGSLVRLPWRQIPTAAVQVSMHPSEGLPASVADPRHLLVRTIDALKSEGYHPVMAAELEFYLLDRQRDANGRPQPARDADGGRPRATQVYGLRELEQIEPFLADLYAACKAQGLPARTAISEYAPGQVEITLDHGDALVAMDQAIRYKRLVKGVAHKHGMLACFMAKPFDDLAGTGMHLHVSLADEQGHNLFASDDPAGTPLLRQAVGGMLASLLDSLLLFCPNANSYRRFQANSYAPLAQTWGVDNRTVSLRVPGGPASSRHIEHRICGADANPYLAAAALLAGVHRGIREGIDPGAPVEGNGYAQAGKRLPTDWLTALDALQGSEWAREAFGEPFLGVYLAVKRAEYRQFMGEVGEQDWRWYLTQA

SEQ ID NO: 29901 - protein, 449 aa, Pseudomonas aeruginosa UCBPP-PA14
MSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYSSAAVVGGVALLFLLLQRNRPEDVGHPPVEPQVASEAVRYAGFRPEGGNGGNGGNGGNGGSLQVLAKVVRNRTVLCLGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTGEAAGTASGFVNGCGSVGAILGGLLPGYFDTYTVFIGFTVAALIATAVLLPHWNSRPDGVVKGHRNIPSLGDFRPIRS

SEQ ID NO: 29902 - protein, 458 aa, Pseudomonas aeruginosa UCBPP-PA14
MSVPLRAVQLTEPSLFLQEHPEVQFVDLLISDMNGVVRGKRIERNSLPKVFEKGINLPASLFALDITGSTVESTGLGLDIGDADRICYPIPGTLSMEPWQKRPTAQLLMTMHELEGDPFFADPREVLRQVVARFTEMELTIVAAFELEFYLIDQENVNGRPQPPRSPISGKRPQSVQVYSIDDLDEYVECLQDIIDGARAQGIPADAIVAESAPAQFEVNLHHVADPMKACDYAVLLKRLIKNIAYDHEMDTTFMAKPYPGQAGNGLHVHISLLDKHGNNIFTGEDPEQNAALRHAIGGVLETLPASMAFLCPNVNSYRRFGSQFYVPNAPSWGLDNRTVALRVPTGSPDAVRLEHRVAGADANPYLLLASVLAGVHHGLTNQVEPGAPIEGNSYEQLEPSLPNNLRDALRELDDSEILAKYIDPKYIDIFVACKESELEEFEYSISDLEYNWYLHTV

SEQ ID NO: 29903 - protein, 456 aa, Pseudomonas aeruginosa UCBPP-PA14
MSNPPPTAERTQLRKSLKLWQIVMIGLAYLTPMTVFDTFGIVSGISQGHVPTAYLLALAGVLFTAISYGKLVRQFPTAGSAYTYAQRAINPHVGFMVGWSSLLDYLFLPMINALLAKIYLTALFPEVAPWVWVVMFVLIMTLINIKSVNLVANFNTVFVLVQLAIIVVFIGLVIHGLNNGEGTATVLSTQPFFSEHAHLSAMVAGATILCFSFLGFDAVTTLSEETRDAAKVIPRAIFLTALYGGVIFITVSYFLQSYFPTNVRFKEPDAALPEIALYVGGKLFQSIFLCATFINTLASGLASQASVSRLLYVMGRDNVLPERIFGFVHPKWRTPSINVLIVGMVALSAISFDLVTATALINFGALVAFTFVNLSVIVHFYVRGGRNRSLKEHFHYLVLPLLGAAIVAVLWLNLESTSLVMGLIWAGLGFGYLFYLTRSFSRPPPRFQESELSPTQ

SEQ ID NO: 29904 - protein, 468 aa, Pseudomonas aeruginosa UCBPP-PA14
MNDPQGFEAISRREQGLQRRLSAAQMSMIAIGGAIGTGLFMGSAFAIGFAGPSVLLSYAIGALITLLLMGCLAEMTVAHATPGSFGAFAEHYVGPLAGFLVRYAYWAAIVLAVGTEVTAVAMYMKYWFAGIPEWVWIISFSTLLIGLNASSVKAFGNFEYCFSTLKIAAIVAFILLGAYLVFGSANPAYGVHNYSAHGGFFPHGLKGMWIAVVVSIFSYLSVEMIAVAAAEAEHPEQAVKSAFRSTIVRLVVFYLLTLALMLAIVPWDQAGQSQSPFVTVMQAIGLPGATGVMNFVVLVAALSAMNSQLYITTRMMFSLSRAGHAPKGLGELSRQGVPLNALLLSSVGIALATLLNLVYPEQSFTLMMAVSMFGALFTWLMIFFTHLCFRRHRARHGGAPLAFRMRLAPWSTLLGLALMAAILVTTFFTEAFRMTLVFGVPFLALLSALYLVFVRKPGRDCPIERATP

SEQ ID NO: 29905 - protein, 482 aa, Pseudomonas aeruginosa UCBPP-PA14
MNGHARHWIDGAWLDSAQRGQSFDPASGQPIGTYADGGRAEADAAIAAAVRAFEDGPWKDDHALRATALEEIAAAFERHADALIDLLALENGKIKPEAAFEVGMVPGKLRYYAGLARSERGTSGTPRPDVVSLVLREPMGVAGIIVPWNSPVVLMIRSLAPALAAGTTTVVKMPGQTAQTNALVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFDREEEGVALANRSEYGLAAGVWTREVARAFRVARKIRAGTVWINDWAKVYDEFEEGGYRQSGLGRLNGVAALDDFVEYKHISLTTGAA

SEQ ID NO: 29906 - protein, 417 aa, Pseudomonas aeruginosa UCBPP-PA14
MNNIETFERLESNVRMYCRDLPLVFDTAQGSRIRGEDGREYLDFFAGAGALNYGHNDPRMRDALIAYLSANGVTHALDLHTTTKRQFLEAIERDLFKPRGWDYKVQFTGPTGADAVEAALKLARKATGRTKVVSFYGAYHGMTAGALAVTGNRTRRGPGLSTDVVFVPYEDSPYGEFDSIGFLERLANDQGSGSELPAAVIVESVQIQAGVYPASNQWLQRLRKWTTDHGVLLICDEIQAGCGRTGDFFGFERSGVVPDLITCAKSIGGFGLPMAIVLLRAGLDVWQPGDHIGTFRGNQLAFLTARIALSYWHDEQFLKLLADNCAAMERAVAGFAEIPGVASARCRGMIAGIDFGRGNVEVAKDAQQRVLQAGVLVDRCGPNGEIIKLMPPLNTPTDQLEDGLRAFGESVAAALGE

SEQ ID NO: 29907 - protein, 474 aa, Pseudomonas aeruginosa UCBPP-PA14
MQTKLLINGALVAGESESHAVYNPSQGNVLVRITEASGAQVHAAVQSADAAFDAWSQTPPKDRAALLLKLAERIDAQAHVFARLEADNCGKPFNAVLLDELPAVSDVFRFFAGAVRCLQGSAAGEYVAGHTSMIRRDAVGVVASIAPWNYPLLMAAWKLGPALAGGNTVVLKPSEHTPLSTLKLGELLAEIFPAGVVNIVHGRGASVGEPLTSHAQVRMVSLTGSVRTGSRIIEGTAESVKRMHMELGGKAPVLIFDDADIDAAVEGIRAFGFYNAGQDCTAACRLYVQKGVYQEFVRKLGEAVSSIRCGLPDDPATEMGPLITKEHLERVEGFVNRARELPHIEVVTGGKRAEGAGFFFEPTVLAGATQEDEVVRREIFGPVVTVSSFEDEAQALAWANDSDYGLASSVWTADVGRAHRLAARLQYGCTWVNTHFMLVSEMPHGGVKLSGYGKDLSMYGLEDYTVVRHVMFKH

SEQ ID NO: 29908 - protein, 353 aa, Pseudomonas aeruginosa UCBPP-PA14
MTLQIRGYAAQSASAPLAAHRFERRAPRADDLVIDILYCGVCHSDLHQARNEWHNSLYPLVPGHEIIGRVASVGEAVSGFAVGELVGVGCMVDSCRHCAACSEGLEQYCAEYPTLTYNGRDRHDGLPTFGGYSERIVVSARFVLRIPQGLDPKAAAPLLCAGITSYSPLRHWKIGPGSRVAVVGLGGLGHMGLKFARALGAEVALFTRSPGKEEEARRLGADQVILSTDPQRMAAVAGRFDLILDTVPHQHDLNPYLATLKRDGTLVLVGLLEPLEPAVHGAQLVMGRRSIAGSAIGGIAETQEMLDFCATHGIACDIEMIEIQQINQAYERMLASDVKYRFVIDMASLPKSF

SEQ ID NO: 29909 - protein, 211 aa, Pseudomonas aeruginosa UCBPP-PA14
MGKSLSQEGMDDLDSKAVAKGIEDALGKKKQQLTDEELTEAFAFLQKRAEERMAAIGDENAKAGKKFLEENGKRDGVTTTASGLQYEIVKKADGPQPKATDVVTVHYEGRLTDGTVFDSSIERGSPIDLPVSGVIPGWVEALQLMHVGEKIKLYIPSELAYGAQSPSPAIPANSVLVFDMELLGIKDPSKPDAEPEAGAAAQPEAKADAKK

SEQ ID NO: 29910 - protein, 456 aa, Haemophilus somnus 2336
MTKHYDYIAIGGGSGGIASINRAASYGKKCAIIEAKYLGGTCVNVGCVPKKVMFYGAQVAEAIAKYAPDYGFDVTLNHFDFAKLVESRQAYIDRIHTSYNNVLAKNNVDVLNGFAKFFDAKTIEVSYANGEKELVTADHILIATGGRPSRPTIPGAEYGIDSDGFFALTELPKRIAVVGAGYIAVELAGVVNSLGAETHLFVRRQTPIRSFDPLIIETLVEVMKQDGIQLHTQAIPQEIIKNADNSLTIKLEDGRTQDVDCLIWAIGREPATDVINLASTGVETNERGFIKVDKYQNTNVEGIYAVGDIIEGGIELTPVAVAAGRRLSERLFNNKPDEHLDYHLVPTVVFSHPTIGTVGLTEPKAIEQYGAEAVKVYTSSFTPMYSAVTSHRQPCRMKLVCVGKEEKIVGLHAIGFGVDEMIQGFAVAIKMGATKADFDNTVAIHPTGSEEFVTMR

SEQ ID NO: 29911 - protein, 228 aa, Haemophilus somnus 2336
MTPYLIAPSILSANLARLGEDVENVLKSGADVIHFDVMDNHYVPNLTFGPAICKALRDYGIKAPIDVHLMVKPVDRIIPDFAKAGADYITFHPEASEHIDRSLQLIRDCGCKAGLVFNPATPLSYLDYVLDKIDVILLMSVNPGFGGQAFIPSTLEKLKQARKIIDESGLDIRLEVDGGVKVNNIAEIAQAGADMFVAGSAIFDQPDYKKVIDEMRQQLSTIREKETK

SEQ ID NO: 29912 - protein, 410 aa, Haemophilus somnus 2336
MTTKVSLDKSKIKFLLLEGIHQNALEVLKAAGYTNIEYHRKALEPDELKIAIKDAHFIGIRSRTSLTEDILAEATKLIAIGCFCIGTNQVDLEAAKARGIPVFNAPFANTRSVAELVLGEILLLMRNIPQANADVHRGLWNKSMVGSYEVRGKRLGIIGYGHIGSQLSIIAEALGMNVYFYDIETKLPLGNAQQMNSLEELLSTCDVVSLHLPENSSTKNLMNAERIAQLKANCIFINAARGTVVDIDALTQALESKKIRGAAIDVFPKEPASIEEEFISPLRAFDNVILTPHIGGSTVEAQENIGVEVANKFVKYSDNGSTLSAVNFPEVSLPEHSNAKRLLHIHHNRPGILNKINQIFVEQNINIAAEYLQTEAKIGYVVIDVETEDTAQLLAKLKQIEGTIRARVLF

SEQ ID NO: 29913 - protein, 454 aa, Haemophilus somnus 2336
MTIKTPVQATLASNQYFLDRQDIMESNVRSYPRKLPFAYQKAQGVWVTDVEGNEYLDFLAGAGTLALGHNHPKLIQAIKDVLDSGLPLHSLDITTPLKDAFTEELLSFFPKDKYILQFTGPSGADANEAAIKLAKTYTGRGNVIAFSGGFHGMTHGALSLTGNLGAKNAVQGLMPGVQFMPYPHEYRCPFGIGGEAGVKAVEHYFENFIEDVESGVVKPAAVILEAIQGEGGVVPAPISFLQKVREVTQKHGILMIVDEVQAGFCRSGKMFAFEHANIEPDIVVMSKAIGGSLPLAVLAIKKEFDAWQPAGHTGTFRGNQLAMATGYVSLKIMREENLAQNAKERGEYLTKALTELSQEFPCIGNVRGKGLMMGIDIVDEHQAKDATGAYPRDCDLAVAIQKYCFKNKLLLERGGRGGNVVRVLCAVNITQAECEEFIKRFKQSVAEAVKAVRG

SEQ ID NO: 29914 - protein, 255 aa, Haemophilus somnus 2336
MSKIIKIGKVANNSDAIDAISTQPRHSVIVGTIKRLQTDRIDLLYQHRVDPNVPIEEVAGAIKDLMKQGKVLNWGLSEAGEKTIRKAHAIQPLTAVQSEYSLFFRGREKDVILVCEELGIGFVPWSPLAMGALAGYVDENSRFEADPSKDLRGIIPRFTPEAMQQNVKLIQLVQKWAKRKLCTPAQLSLAWLMAQKAFIAPIPGTSKARHLLDNLGADDVKFTEEELAQFRQELEAIEIVGLRLPEAILNFSEAK

SEQ ID NO: 29915 - protein, 179 aa, Haemophilus somnus 2336
MKKHHVDVLITEEDVRSRIQELGREITQFYQHKHVNKLVVVGLLRGSFMFMADLVREIKLPIEIEFMTTSSYGNEMTTNHDVRIAKDLDGDIKNEDVLIVEDIIDTGYTLEKVREILLLRSPNSLAICTLLDKPSRREVDVPVEWVGFTIPDEFVVGYGIDYAQCYRNLGYIGKVTLEE

SEQ ID NO: 29916 - protein, 487 aa, Haemophilus somnus 2336
MLRVIKEALTFDDVLLVPAHSTVLPNTANLSTNLTKEIRLNIPMLSAAMDTVTEAKLAISLAQEGGIGFIHKNMTIERQADRVRKVKKFESGIVSEPVTVSPTMTLTELAELAKKNGFAGYPVVDEQKGLVGIITGRDTRFVSDLNKTVADFMTPKDRLVTVKEGATREEIFHLMHEHRVEKVLVVDNSFKLKGMITLKDYQKAESKPNACKDEFGRLRVGAAVGAGPGNEERIDALVKAGVDVLLIDSSHGHSEGVLQRVRETRAKYPNLPIIAGNIATAEGAIALADAGASAVKVGIGPGSICTTRIVTGVGVPQITAIADAAEALRERGIPVIADGGIRYSGDIAKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGCATIEELRTKAQFVRISGAGIKESHVHDVTITKEAPNYRMG

SEQ ID NO: 29917 - protein, 472 aa, Haemophilus somnus 2336
MSNTTAITNVFKLIEENDIKFVLLRFTDVKGKEHGVSLPVSLVDEDLFEDGKMFDGSSVEGWKAINKADMLLMPIAETAVVDPFAQIPTLSIRCSIFEPTTMQSYDRDPRSIAMRAENYMRSTGVADDVFFGPEPEFFLFDDVRFDVSMNGNSYTVDDIEAAWNTNKHYEGGNKAYRPLKKGGYCAVAPNDIAHDIRSEMCLLMEEMGLVIEAHHHEVATAGQNEIATKFNTLTLKADETQIYKYIVQNVAYEHGKTACFMPKPIINDNGSGMHCNMSLSKDGKNIFQGDKYAGLSETALYFIGGIIKHAKALNAFTNPSTNSYKRLVPGFEAPVLLAYSASNRSASIRIPAVTNPKAIRIEARFPDPLANPYLAFSALLMAGLDGIQNKLYPGDAMDKNLYDLPPEELKDIPAVASSLSEALDNLEKDYEFLTHGKVFSKEFIDTFIAMKRKEVERLNMTPHPVEFEMYYA

SEQ ID NO: 29918 - protein, 474 aa, Haemophilus somnus 2336
MNKEIKTQVVVLGAGPAGYSAAFRCADLGLETVIVERFSTLGGVCLNVGCIPSKALLHVAKVIEEARSLSAHGIVFGEPTTDIDKIRGWKEKVINQLTSGLAGMAKQRKVQVVNGYGKFSGPNAIIVAGDEGETKITFDNAIIAAGSRPIQLPFIPHEDPRIWDSTDALKLKEVPENLLIMGGGIIGLEMGTVYHALGSKIDVVEMFDQVIPAADKDMVQIYTKRIEKKFNLLLETKVTAVEAKEDGIYVSMEGKAASETRRYDAVLVAIGRVPNGKLIDAGIAGVEVDDRGFIRTDKQMRTNVPHIFAIGDVVGQPMLAHKGVHEGHVAAEVIAGQKHYFDPKVIPSIAYTEPEVAWVGKTEKECKAEGINYEVAKFPWAASGRAIASDCADGMTKLIFDKDTHRVIGGAIVGTNGGELLGEIGLAIEMGCDAEDLALTIHAHPTLHESVGLAAEVFEGSITDLPNPKAKKKK

SEQ ID NO: 29919 - protein, 429 aa, Haemophilus somnus 2336
MTKRVSNVRQEIIAGLTTFLAMVYSVIVVPNMLSAAGFPAESVFIATCLVAGLGSILIGLWANAPMAIGCAISLTAFTAFSLVLGQGVSIPVALGAVFLMGIVFTLISATGIRSWILRNLPSSIAHGAGIGIGLFLLLIATTNVGIIVANQNGLLVKFGDFTSFSVLMSLVGLAVIIGLEKMQVKGGILWVMIAITIAGLIWDQNVQFKGEIFRLPTFGEQSLFLELDIMGALQPAILPIVFALVMTAVFDATGTIRAVAGQANLLDKDGQIINGGKALTADSVSSLLSGALGTAPAAVYIESAAGTAAGGKTGMTAIVVGILFLLMLFFQPLASLVPNYATAPALMYVGLLMLSNVSKLDFSDFVGAMSGLVCGVFIVLTANIVTGIMLGFATLVIGRLVCGDWKKLNVGTVIIAIVLVAFYIGGWAI

SEQ ID NO: 29920 - protein, 484 aa, Haemophilus somnus 2336
MSQKGDIGVIGLAVMGQNLILNMNDNGFKVVAYNRTTSKVDEFLAGATKGTNIIGAYSLEELAGKLEKPRKVMLMVRAGEVVDQFIEALLPHLEQGDIIIDGGNSNYPDTNRRVKALAEKGIRFIGSGVSGGEEGARHGPSIMPGGNEEAWQYVKPILQAISAKTDKGEPCCDWVGKEGSGHFVKMVHNGIEYGDMQLICEAYQFLKDGLGLSYDEMQQIFAEWKKTELDSYLIDITTDILGYKDADGEPLVEKILDTAGQKGTGKWTGINALDFGIPLTLITESVFARCVSSFKDQRVAASKLFNKTIGKVEGDKNVWIEAVRKALLASKIISYAQGFMLIREASENFGWNINYGATALLWREGCIIRSRFLGNIRDAYEANPDLIFLGSDPYFKGILENALSDWRKVVAKSIEVGIPMPCMASAVTFLDGYTSERVPANLLQAQRDYFGAHTYERTDKPRGEFFHTNWTGRGGNTASTTYDV

SEQ ID NO: 29921 - protein, 391 aa, Actinobacillus pleuropneumoniae serovar 1 str. 4074
MSVIKMADLDLAGKRLFIRADLNVPVKDGKVTSDARIRATIPTLKLALQKGAKVMVTSHLGRPTEGVFEEANSLQPVVDYLNASDLGVPVRLVRDYLDGVEVAENEIVVLENVRINKGEKKNDPELAKKYAALCDVFVMDAFGTAHRAEGSTYGVAEYAPVACAGPLLAAELDALGKALKEPQRPMLAIVGGSKVSTKLTVLDSLSKIADQLIVGGGIANTFIAAEGHPVGKSLYEADLIPEAKRLAAATNIPVPVDVRVGTEFSEIAPATEKAVSEVQADESIFDIGDKSAEELANIIKSAKTILWNGPVGVFEFPNFRKGTEVISNAIAEATANGAFSIAGGGDTLAAIDLFGIADKISYISTGGGAFLEFVEGKVLPAVEILEKRANG

SEQ ID NO: 29922 - protein, 269 aa, Actinobacillus pleuropneumoniae serovar 1 str. 4074
MSRFDTLFANLKAKNEGAFVPFVTLCDPDFDCSFEIIETLIANGADALELGFPFSDPLLDGPVIQAANKRALDGGYSTDACFEMIAKIRSKYPEIPIGLLLCANLVFVPTQDVFFKRCAETGVDAVLIADVPVLAAEEFTQAAKKHGIQSVFICPPNADQATIERIARLTEGYTYLVSRAGVTSAENQAHAKNLDNLIESLKRSNSAPILQGFGIAKPEQVKEALVLGCDGAISGSAIVKIIERNLDSQTQLLSELAKFVSVMKAATKS

SEQ ID NO: 29923 - protein, 243 aa, Actinobacillus pleuropneumoniae serovar 1 str. 4074
MALLSIRNLHKKYGETVAIPNLDLDLAKGEVVVILGPSGCGKSTLLRCVNGLEEKQGGSIVMQDVGEFGKDLSWEASRQKVGMVFQSYELFAHLNVIENILLGPLKAQQRSRQEVEAQADKLLARVGLLDRKNAFPRELSGGQKQRIAIVRALCMNPEVILLDEITAALDPEMVREVLDVVLELAEEGMSMLIVTHEMGFAEKVADRIVFMDKGVIIEQAPPHQFFKQPQTERTKQFLNGMDY

SEQ ID NO: 29924 - protein, 474 aa, Actinobacillus pleuropneumoniae serovar 1 str. 4074
MSKEIKTQVVVLGAGPAGYSAAFRCADLGLETVIVERYSTLGGVCLNVGCIPSKALLHVAKVIEEAKHAEKNGITFGEPNIDLDKVRAGKEAVVSKLTGGLAGMAKARKVTVVEGLAAFTDPNTLVARDRDGNPTTIKFDNAIIAAGSRPIQLPFIPHEDPRVWDSTDALKLKEVPKKLLIMGGGIIGLEMGTVYNALGSEVEVVEMFDQVIPAADKDVVAIYTKQIEKKFKLMLETKVTAVEAKDDGIYVSMEGKACNDTKRYDAVLVAIGRVPNGKLIDAGKAGVNVDDRGFIAVDKQMRTNVPHIFAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 29925 - protein, 454 aa, Actinobacillus pleuropneumoniae serovar 1 str. 4074
MTIKTPVQAVLASNQYFLDRQDAMESNVRSYPRKLPFAYQKAQGVWVTDVEGNEYLDFLAGAGTLALGHNHPVLMQSIKDVLDSGLPLHTLDLTTPLKDAFTEELLSFFPKDQYILQFTGPSGADANEAAIKLAKTYTGRGNVIAFSGGFHGMTHGALSLTGNLSAKNAVQNLMAGVQFMPYPHEYRCPFGIGGEVGAKAVEHYFENFIEDVESGVVKPAAVILEAIQGEGGVVPAPISFLQKVREVTQKHGILMIVDEVQAGFCRSGKMFAFEHAGIEPDVVVMSKAVGGSLPLAVLAIRKEFDAWQPAGHTGTFRGNQLAMATGYASLKIMREENLAQNAQERGEYLTNALRELSKEFPCIGNVRGRGLMMGIDIVDERKPQDATGAYPQDGELAVAIQKACFNNKLLLERGGRGGNVVRVLCAVNINQAECEEFIKRFKQSVADALKAVRG

SEQ ID NO: 29926 - protein, 482 aa, Actinobacillus pleuropneumoniae serovar 1 str. 4074
MKINPLEGSPTMSVKRVFDLIKDNDIKFVMLKFTDIKGKEHGVSLPVSLIGDDLEDLFEEGKMFDGSSVEGWKAINKADMLLMPIAETAVVDPFARIPTLTLRCSIYDPNTMQSYDRDPRSIAIRAENYLKSTGIADSVMFGPEPEFFLFDDVRYNIGMNNVSYKIDDIEAAWNTNRKYEDGNTGYRPLKKGGYCAVAPIDSAHDIRSEMCLILEEMGLVVEAHHHEVATAGQNEIATKFNSLTLKADETQIYKYVVQNVALEHGKTACFMPKPFAGDNGSGMHCNMSLSKDGKNVFMGDKYAGLSETALYYIGGIIKHAKALNAFTNPSTNSYKRLVPGFEAPVLLAYSASNRSASIRIPAVTSPKATRVEARFPDPLANPYLCFAALLMAGLDGVVNKIHPGDAMDKNLYDLPPEELKEIPAVATSLEEALDSLAADYEFLTQGGVFTKEFVEAYINIRRKEVERLNMTPHPVEFEMYYA

SEQ ID NO: 29927 - protein, 353 aa, Actinobacillus pleuropneumoniae serovar 1 str. 4074
MAKFRYLQTPFKLKNLELKNRIVMPPMCQYSATDGVPNDWHFVHYTARAIGGVGLIIVEMTNVAPNGRITPKCLGLWNDEQRDAFKPIVDSVHKYGSKIVVQIGHAGRKAQDCDDVVAPSAIHYGELDYAGQNLKTPRELSKAEIQEVIQSYQDAVKRAVEAGFDAIEIHGAHGYLIHQFSSPKSNQRSDEYGQDRFLFGEQVIKAAKAVMPADMPLIVRISAQEFGANGFDADYGVEMARRFAAAGADCMHVSAGGDGVLAEGKHPPFNAGYQVYLARAVKQATGLPTIAVGMLDDANVVDHVLSIGDADLVAVGRALLRDPQWVLNVQYAQNATNSSGVEFVPAQYQRGYF

SEQ ID NO: 29928 - protein, 372 aa, Actinobacillus pleuropneumoniae serovar 1 str. 4074
MEFIKTRAAVAWAPNEPLKIEELDLMPPQKGEVLVRLVATGVCHTDAYTLSGQDSEGVFPCVLGHEGAGIVEAVGEGVTDFKVGDHVIPLYTAECRKCKFCLSGKTNLCSAVRETQGKGLMPDGTVRFFKDDQPIFHYMGTSTFSEYTVVSEYSLAKIQENAPLDEVCLLGCGVTTGIGAVTRTAKVKKGDTVAIFGLGGIGLAAIIGARMAGAGRIIAIDINPAKFEKAKELGATDCINPKDYEQPIQNVIIEMTDGGVDFSFECVGNVDLMRSALECCHKGWGESIIIGVAPAGAEIRTRPFQLVTGRVWRGSAFGGVKGRTELPGIIDQFMKGEFKLRDFITHTMPLEDINKAFDLMHEGKSIRTVIHF

SEQ ID NO: 29929 - protein, 214 aa, Actinobacillus pleuropneumoniae serovar 1 str. 4074
MQIQNINWQKVDQLLPVIIQHFQTSEVLMLGYMNPEALEKTLAEKVVTFYSRTKQHLWTKGETSGHFLNVVDMSLDCDNDTLLILVNPIGPTCHTGEGSCFHQFESQSEGDWTWFAKLEQVLAERKYTDPESSYTAKLYAKGVKKIAQKVGEESVETALAAVSQDKEEVVSEAADLAYHLTVLLHSMNLEWGDVIAKLKERHQGIGLHPEGSNK

SEQ ID NO: 29930 - protein, 179 aa, Actinobacillus pleuropneumoniae serovar 1 str. 4074
MKKHHVETLISREEVQSRIMELAKEINHHYAHAHCENLVVVGLLRGSFMFMADLVRLIDVPVEVDFMTASSYGSGTESSRDVKILKDLDGEIHGKDVLIVEDIIDTGFTLSKVRDILNLREPRSVAICTLLDKPSRREVEVPVEWVGFAIPDEFVVGYGIDYAQKYRNLDFIGKVVMDA

SEQ ID NO: 29931 - protein, 380 aa, Actinobacillus pleuropneumoniae serovar 1 str. 4074
MKMTKYSNIETTLVQLGNRTDPRTGAVATPIVLSTAYGRGGLGESTGWDYIRTKNPTRAVLEQGIADLEGGDAGFAMASGMAAIQLVMSLFKAPDEWIISSDVYGGSYRLFDFSHKHHNTVKPVYVNTADLAAIEAAITPNTKAIFVETPSNPLMEECDVDAISKIAKKHNLMLIVDNTFLTPILFRPIEHGADIVIHSATKYLSGHNDVLAGLIVAKDSEATKNEAGQKLSERLFYFQNCAGAVLSPFDSYLAVRGLKTLALRMERHQSNATELARFLSEQPEIECVLYSGKSGMLSFRLQKEEWVPKFLKAIKLITFAESLGGTESFITYPSTQTHMDIPEAERIARGITNNLLRFSVGLEHVEDLKVDLRQAFGQLK

SEQ ID NO: 29932 - protein, 269 aa, Actinobacillus pleuropneumoniae serovar 1 str. 4074
MTLKIGIVGAGGRMGRNLITAVQNAEGVELGAAFERKGSSLVGADAGEVAGIGATGVKISDDLNQNTNFDVLIDFTRPEGTLEHIKFCVANGKKMVIGTTGFDDAGKQAIQTAAEQISIVFASNYSVGVNLVFKLLEKAAKVMGDYCDIEVIEAHHRHKVAAPSGTALSMGEHIAKTLGRDLKTHGVFAREGITGERKRDEIGFATIRAGDVVGEHSVWFADEGERVEIAHKASSRMTFANGAVRAAKWLNTKQNGLFDMTDVLDLNNL

SEQ ID NO: 29933 - protein, 422 aa, Actinobacillus pleuropneumoniae serovar 1 str. 4074
MNFETLCLHAGYTPKNGEPRALPIVQSTTFTYDSAESIGKLFDLEEAGFFYTRLANPTTNAVEEKIAALEGGVAAMCTASGQSAVFYALMNLLESGDHFISASSIYGGSYNLFAHTFRKMGIEVTFVDQFAPIEELKKAIRPNTKAVFGETIANPALRVLDIEKFAALAQAAECPLVVDNTFATPYFCRPFEFGANIVVHSSSKYLDGHAVALGGVIIDGGNFDWNNPKFKAFHQPDETYHGLVYTETFGKAAYMVKARVQLMRDLGATPAPQNSFLLNLGLETLSLRMKQHFANAKAVAEFLEAHPQVKSVYYPALASSPDFALQQKYTPNGLCGVLSFELKGNKETAMKWLNALKLVSREVHVADIRTCALHPATSTHRQLSTEDLKAANISETLIRLSVGIETLEDILADLTQAFEQAV

SEQ ID NO: 29934 - protein, 152 aa, Pasteuria nishizawae str. North American
MADGGVRYSGDIVKVIAAGADAVMIGSLFAGTEESPGETEIYQGRRFKVYRGMGSHGAMRLGSKDRYFQADETDTSKLVPEGVEGRVPYKGSLADTVHQLVGGLRAGMGYCGVGSLQQLQSQTKFIRISPASLYESHPHGVQITRETSNYNI

SEQ ID NO: 29935 - protein, 484 aa, Dechloromonas aromatica RCB
MKQILNFINGEFVATGKQFEKRTPLDNSLIGMVHEAGKAEVDAAVKAAHDALEGPWGKMTVVERTDILNKVADEITRRFDEFLEAECADTGKPKSLASHIDIPRGAANFKIFADVIKNAPTEFFEMATPDGKGALNYAIRRPVGVVGVVCPWNLPLLLMTWKVGPALACGNTVVVKPSEETPSTATLLGEVMNACGVPKGVYNVVHGFGPNSAGEFLTTNQNVNAITFTGETRTGAAIMKAAADGARPVSLEMGGKNPAIVFADANLDVAIEATLRSCFSNCGQVCLGTERVYVERPFFETFVAALKAGAEKLKLGVPSDPSANMGPLVSQEHRNKVLSYYKKAVEEGATVVTGGGIPDMPGELANGAWVQPTIWTGLDDNAAVVREEIFGPCTTVMPFDSEDEVIKRANNTTYGLAASVFTQDVNRAHRVAGRIEAGLVWVNSWFLRDLRTPFGGAKQSGIGREGGVHSLEFYTELKNVCIKL

SEQ ID NO: 29936 - protein, 404 aa, Dechloromonas aromatica RCB
MDKKSFLQAGHTPTLLAAFLYFDLAFMVWVLLGPLGISIAKDLGLSHAEKGMMVATPVLAGALLRIIMGILVDRLSPKKAAIIGQVVVIATMIYAWQVGVHSYAEVLILGLFLGVAGASFAAALPLASRWYPAEHQGTAMGIAGAGNSGTALAALFAPGLAAAFGWVNVFGVVLIPLVIVLIAFIFMAKDAPDAPPPKTFAEYLKVLKDKDAWWFMFFYSVTFGGFVGLASSLVIYFNTQYGLDPKMAGYFTAGCVFAGSLVRPIGGNVADRIGGVKSLTVMYMFAALFLSIVSFGLPEAWMALLVFVGAMLSLGMGNGAVFQLVPQRFRKEIGVMTGLVGMAGGVGGFYLASSLGYSKQLTGSYQAGFLIFASLAVLALLGLTGVKTRWRTTWGASHLTAAKI

SEQ ID NO: 29937 - protein, 182 aa, Dechloromonas aromatica RCB
MLDREGYRPNVGIILCNGRNEVFWGKRIREHSWQFPQGGIKRGETPEEAMFRELYEEVGLLPEHVRILGRTKGWLRYEVPTHWIKREWRGSYKGQKQIWFLLRLVGRDSDVNLRATNKPEFDAWRWNDYWVPLDAVIEFKRLVYEQALNELVRFLDFDRKGPRHKKEQEPFSDVVDSVRSEE

SEQ ID NO: 29938 - protein, 344 aa, Dechloromonas aromatica RCB
MKSGRVITSRCSDNDNEEMTMPHAIRFHQTGGPEVLSWEDVDLPAPAPGEATVRHHAVGLNYIDTYHRTGLYPLTLPSGIGMEGAGVVEAVGEGVGEVKVGDRVAYAGGPLGAYAEVRNIPAHRLLKLPDSISFATGAAMMLQGLTAAYLLRKTYRVQPGDAVLIHAAAGGVGLIACQWAKALGATVIGTVGSSAKAELAKAHGCDHVINYSSENFTQRVREITAGEGVAVVYDGVGKDTFIGSLDSLRPLGMMVSYGNASGPVPPLDLLLLSQKGSLFITRPTIATYTAKRADLEALGAELFDAVVSGKVRIEVNQTYALKDAAQAHRDLEARKTTGSTILLP

SEQ ID NO: 29939 - protein, 185 aa, Dechloromonas aromatica RCB
MFSSLKRCFGIAALITVGVVPVAAAAECPPLLNHSFASLQDGKPMPLCQYAGKVILVVNTASYCGFTSQYDGLEKLYARLKDKGLVVLGFPSNDFGEQEPGSEKEIADFCRLTYGVEFPMVSKTVVKGKGAHPFYLKLAEITGSKPKWNFHKYLINRDATQVVAYTSFTKPDDKDLLKKIDEFLK

SEQ ID NO: 29940 - protein, 270 aa, Dechloromonas aromatica RCB
MSDDILVDIENLHFNYDGRPVLQGINMKIPRGKVVAIMGGSGCGKTTLLRCIGGQLRPTGGRVRLEKHQVCEMSEAELYRLRRRMGMLFQFGALFTDMTVFDNVAFPMHEHTDMSEEMIRDLVLMKLEAVGLRGAHKLMPGELSGGMARRVALARALALDPMLVMYDEPFTGLDPIALGVIGQLIRKLNDALGATSIMVTHDIHESLLIVDYIYFLNGGQVVAEGTPDEIRASKDPFVHQFVYAEPDGPVHFDYPAPSVRDEFLSGVGHA

SEQ ID NO: 29941 - protein, 132 aa, Dechloromonas aromatica RCB
MADLDNSQDWLEALKWDADGMIPAIAQDENGRVVMFAYMNRDSLQETVLCGNAVYWSRSRKRLWRKGEESGHFQKVNSIRTDCDGDVLLLSIEQVGGIACHTGRESCFFNELNGDRWIPADPVLKDPKEIYK

SEQ ID NO: 29942 - protein, 463 aa, Dechloromonas aromatica RCB
MNKVYATSEAALDGLLFDGMTVAAGGFGLCGIPENLIDGLLRAGTSDLTIVGNNAGVDDFGMGPLLKTRQVKKVVASYVGENKEFERQVLAGELELELVPQGTLAERLRAGGAGIPGFYTRTAFGTRLAEGKETRHFDDQEYVLEPAIRADVAIVKAWKGDHAGNLVFRKTARNFNPMIATCGRVTVAEVEELVAPGELDPDQIHTPGIYVDRIIQGAGYQKRIEFRTTAGGATPGKQDPLRERMARRAAQELRSGYYVNLGIGIPTLVANFIPEGIHVTLQSENGLLGIGPFPGSEDVDADLINAGKQTITSIPGSSFFSSADSFAMIRGGHINLSILGGLEVSENGDLANWMVPGKMVKGPGGAMDLVSGVGRVIVLMEHTAKDGAPKILPVCSLPLTGKGVVDMIITDLCVFTVNPGGGLTLSELHPGVSVDEVRANTACSFAVAPELCTEHVTELAAVS

SEQ ID NO: 29943 - protein, 160 aa, Dechloromonas aromatica RCB
MLVGHSERRALYGETDTVVSAKFEAVQRAGLVPVLCVGETLAERESGMTSVVVARQLSAVLGRVGVAAMASAVVAYEPVWAIGTGVTASPAQAQEVHAAIRAKVAELDLGVANGLRILYGGSVKPQNAMELFGQDDIDGGLIGGAALVADDFLAICRAAN

SEQ ID NO: 29944 - protein, 174 aa, Dechloromonas aromatica RCB
MVWAAPTVEMTTNLGKFTLELFPEKAPKTVEMFLYNAKHGFYEATIFHRVIDGFMIQGGGFSRAMEEKKTLTPALQNEATNGLTNDRGTVAMARTQDPHSARVQFFINLKDNEFLNHRNSTDPRGWGYAVFGKVTQGMDVVDKIAKVPTGNAGYYENVPTTPVVIQNVKIISEK

SEQ ID NO: 29945 - protein, 393 aa, Dechloromonas aromatica RCB
MADLPNYRPETLAVRAGQERSQFGEHSEALYLTSSFVFKSAAQAAKRFSGEEEGNVYARFSNPTVTMFEERLAALEGAEDCVATSSGMSAIMAAVLAHLKQGDHIVASNSLFGATVQLFNNILSRTGITTTFVSHTDPAAWAAAIRPETKLFFLETPSNPLTEIADIRALVAIAHAKGILVAVDNCFCTPILQRPLDMGADLVIHSATKFLDGQGRVLGGAVCGPKKLTEEVFKYLRTAGPTLSAFNAWVLLKGLETLKLRVEAQSANAAGLAAWLEAHPKVARVFYPGLPSHPQHELAKTQQKSGGAIVAFEVKGAREQAWQVVDNCRLLSITANLGDTKTTITHPASTTHGRISPEARAAAGINEGLLRIAVGLEAVEDLQADLERGLAPI

SEQ ID NO: 29946 - protein, 268 aa, Dechloromonas aromatica RCB
MSRIKSAFERLNGEGRKALIPFITAGDPDAALTLPLMHTLVEAGADVIELGVPFSDPMADGPTIQRASERALARGMTLRKVLQLVVEFRKTDGKTPVVLMGYANPVEAMGLEKFAAAAAQAGVDGVLIVDYPPEEAAAFGAAMKAQGMDPIFLLAPTSSAERIAHVAEIASGYVYYVSLAGVTGSGALNVEAVAERLPLIREKTGLPVGVGFGIRDAATAARIAGIADAVVVGSRIIEEIEKSTAETACANVKALVADIRRGVDEVKK

SEQ ID NO: 29947 - protein, 390 aa, Dechloromonas aromatica RCB
MSHVMNTYARLPVTFSHGNGSRITDTEGKEYLDALSGIAVSTLGHAHPKLVAAIAAQAGRMLHTSNLYRIGEQEQLADKLCELSGMQEVFFGNSGAEANEAAIKLARFYGHKKNIEIPTVVVMEKAFHGRTMATLSATGNRKTQAGFEPLVAGFVRVPYGDLEAIKAVAEHNKNIVAVMLEIIQGEGGIHLADPSFYRGVRELCDAQDWLMICDEVQCGMGRTGKWFGYLQAGVQPDIATLAKGLGSGVPIGACMAGGKAAGLFGPGNHGSTFGGNPLVSTAALTTIEVIEQDDLLGNAERIGLLIRKLFAEALAGVKGVVDIRGHGLMIGLELDRPCGALVGKALAAGLLINVTADTVLRFLPPLIFSESDAHELVERTAPLIKEFLAA

SEQ ID NO: 29948 - protein, 486 aa, Dechloromonas aromatica RCB
MLQDKILNFINGEFVATNKWFENRTPISNAVIGQVAEAGKAEVDAAVAAAQAALKGPWGKMTLAKRVELLEALVAEINNRFDEFLEAECADTGKPKSLASHIDIPRGAANFKVFADVIKNVPGEFFDMATPDGGTAINYTFRSPVGVVGVICPWNLPLLLMTWKVGPALACGNTVVVKPSEETPRTAALLGEVMNKVGIPKGVYNVVHGFGPNSAGEFLTTHPDVDAITFTGETRTGEIINRAASVGSRPVSLEMGGKNAAIVFADCDFDAAIEGTLRSAFANCGQVCLGTERVYVERPIFEKFVAAMKAGAEKLKIGVPEDPATGMGPLISKEHQNKVLSYFQIAKEAGATIVTGGGVPDMPGELKDGCWVQPTIWTGLPETARVIKEEIFGPCCHIAPFDTEEEVLEKANDNIYGLATAIWTKDVSRANRVAQQMEVGIAWVNSWFLRDLRTAFGGAKQSGIGREGGVHSLEFYTELKNICIKL

SEQ ID NO: 29949 - protein, 474 aa, Dechloromonas aromatica RCB
MSKQFDVLVIGGGPGGYIAAIRASQLGFLAACAESNPYADPKGEPRLGGTCLNVGCIPSKALLHTSHLFEEANHSFEAQGIKVGKATIDVPVMKARKDGVVNQLTSGIKMLLKKNKVSFLAGHGSFVGKEGDYWKVKVGAEEVLTKQVIVATGSKARHLPNLPVDQKIVMDNEGALNQESVPKKLAIIGAGVIGLEMGSVWRRVGSEVTVLEAMPDFLAAADVDVAKEALKLFSKQGLNIQMGVKIGDIKATKKSVSIAYTDKDGKEQKLDADRLIVSIGRVPNTDGLNGEAVGLKLDARGFVEVDGHCKTNLPGIWAIGDVVRGPMLAHKAHEEGVMVAELMAGQAGHCNFDTIPWVIYTSPEIAWVGKTEQQLKAEGVEYKAGKVPFLANGRALGMGDPSGFVKMLACKKTDRILGVHIIGANASEIIAEAVVAMEFGGASEDLARICHAHPTLSETVHEAALACDKRTLNF

SEQ ID NO: 29950 - protein, 324 aa, Dechloromonas aromatica RCB
MSKWFADNSQSIGRTPLIKLNRVIDGAKATVLAKIEGRNPAYSVKCRIGAALINDAEKRGLLGPGKELVEPTSGNTGIALAFVAAAKGIPLTLTMPETMSIERRKLLTAFGAKLVLTEGAKGMSGAIAKAEEIAASDAKYVLLQQFKNPANPAIHELTTGPEIWDDTDGAIDILVSGVGTGGTITGVSRYIKNTKGKAIQSVAVEPTASPVLTQARAGEPIKPGPHKIQGIGAGFVPAVLDLSLLDAVEQVSNEDAVLYARRLAKEEGIISGISSGAAVAAAARLARIPENAGKTIVAILPDSGERYLSSILFEGLFNEAGLAA

SEQ ID NO: 29951 - protein, 487 aa, Dechloromonas aromatica RCB
MRLLQKALTFDDVLLVPAHSQILPRDVSLATRLTRNITLNLPLLSAAMDTVTEGRLAIAMAQEGGIGIIHKNLSPKAQAAEVAKVKRFESGILKDPITVSPLMTVRDVIEITRQYKISGLPVIDKSGKVVGIVTNRDMRFETNLDQPVKAIMTPRKRLVTVKEGASVEDAKELIRRHRLERVLVIDDEWHMRGLITVKDILKSTEHPLANKDSSGRLRAGAAVGVGAGTEERVELLAEAGVDVIVVDTAHGHSQGVLDRVQWVKKNFPQIEVIGGNIATADAARALVDMGADGVKVGIGPGSICTTRIVAGVGVPQITAIQNVSDSLKGTGVPMIADGGIRYSGDIAKAIAAGADTVMLGGLFAGTEEAPGEVELFQGRSYKSYRGMGSLGAMQAGSSDRYFQETTSNVDKFVPEGIEGRVPYKGSVLAVIHQLMGGLRSSMGYLGSPTIDHMHDNACFVEITSAGIRESHVHDVQITKEAPNYHLD

SEQ ID NO: 29952 - protein, 427 aa, Dechloromonas aromatica RCB
MSSIVDVIAREILDSRGNPTVEADVLLESGVMGRAAVPSGASTGTREAIELRDGDASRYLGKGVMQAVENVNTEISEAIIGLDAQEQAFIDQTMIDLDGTDNKSRLGANAILAVSMAVAKAAAEESGLPLYRYFGGMSPMQMPVPMMNIINGGEHANNSLDIQEFMVMPVGAANIREAIRCGAEIFHALKKLLNKKGHSTAVGDEGGFAPNLGSHAEALQIIMEAIEIAGYVPGQDVLLALDCAASEFYKDGKYKLAGEGLELTSAQFVDYLANLADQFPIVSIEDGMSEADWDGWKLLTDRLGDKVQIVGDDIFVTNTKIFKEGIKKGIGNSILIKINQIGTLSETFAAVEMAKRAGYTAVISHRSGETEDSTIADIAVGLNAGQIKTGSLSRSDRIAKYNQLIRIEEDLGDTASYPGRETFYNLR

SEQ ID NO: 29953 - protein, 460 aa, Dechloromonas aromatica RCB
MSREKYPKQLLPLVGDKSMLQETVARLDGLAGLSEPLLVCNEEHRFVVAEQLRVLGKHGQILLEPFGRNTAPALTLAALLARQNGDDPVLVVMPADHVILEGDVFREAVANAVKLAEQGYAVTFGITPDCPETGYGYIHRGAAIACEEEAFLLRRFVEKPDRGTAQAYLDSGDYLWNSGIFVLRVSTWLSALEICRPDILAACGKALNCVSQDGDFVRLDRAEFERCPSDSIDYAVMERLSGGEANLPKSAVIPLSAGWSDVGAWDALWKVLPKCEAGNAIRGDVMLESCSNTLAFSESRLVTCIGLKDLVVVETNDAVLVAHQNATQDVKKIVDRLKADKRSVAQWHRKIHRPWGWYDGVDSGQRFQVKRICVKPGASLSLQMHHHRAEHWIVVTGTAKVTKGDEAFLVSENQSTYIPLGTKHRLENPGIVPLEMIEVQSGSYLGEDDIVRFEDTYGRN

SEQ ID NO: 29954 - protein, 306 aa, Dechloromonas aromatica RCB
MTYNSPAMKPLGSLKYSRIRIIGAASGLGAQDQACEDGPVAFHHSQAWHELEHHPLVDWGKTLFAPDNDGTSTTARIAELCRHLADEVALTLRADEFPVVIGGDHSIAIGTWSGLARVLGQPFGLLWIDAHLDSHTPETSYSGAVHGMPLACLLGRGDKRLLNIGLNGPQVSAAHTVILGPRSYEPEELEFLQRMGVRIIDSEEIQLRGFAACLDEAIAIVAGAPAGFGVTLDLDAIDPRSAPGVGSPEPDGLTSYDVLTAMHWIAAQAGLKALEIVEYNPDRDRHGTTAALISNMIEQILPVGAK

SEQ ID NO: 29955 - protein, 308 aa, Dechloromonas aromatica RCB
MTTTAFITHRDCQLHDMGSHHPECPQRLTAINDHLIAQGIDAYFTYYDAPLATFEQLLRVHPASHLERIKRASPELGVVHLDPDTAMNPHTWQAALRAAGAGCMAVDLVLNKEVENAFCAVRPPGHHCEKATPMGFCFFNNIGVAARHALKVHGLERVAIIDFDVHHGNGTEDCFAGDEQVLMCSIFQHPFYPYSGADKPAANMCNVPLAAGCGGEEFRDAVMQVWTPRLKEFKPQMIFISAGFDGHYEDDMGGLKLVEKDFAWCTEHLKKLAAEMCEKRIVSMLEGGYVMTSLARSVGAHLRALADL

SEQ ID NO: 29956 - protein, 471 aa, Dechloromonas aromatica RCB
MATPQDVIKMIKENDAKFVDFRFTDTRGKEQHVTVPVSAFSEDKFENGHAFDGSSIAGWKGIQASDMQLNPDPATAYIDPFFDETTVVLTCDVVDPADGRGYDRDPRSIAKRAEAYLKSSGIGDTAYFGPEPEFFIFDGVEWNVDMSGCSLKIHSAEAAWGSGEKNDGNGSTGHRPTVKGGYFPVPPVDSLHDIRSAMVLTLEALGCPVEVHHHEVATAGQCEIGTVFNTLVKRADQTQILKYVVHNVAHQYGKTATFMPKPIVGDNGSGMHVHQSIWKDGKNLFAGDGYAGLSELALFYIGGIIKHAKALNAITNPGTNSYKRLVPHYEAPVKLAYSAKNRSASIRIPYVASTKARRIETRFPDPIANPYLCFAALLMAGLDGIQNKIHPGDPADKNLYDLPPEEDAKIPTVCASLEEALAALDKDREFLTRGGVFSNDWIDAFISLKMDEVNKVRMTTHPVEFDLYYSC

SEQ ID NO: 29957 - protein, 484 aa, Dechloromonas aromatica RCB
MNLQNTELLRSTNLIGGIWARADDGAQLAVINPATGEKLADVPLCGATETRRAIDAANAAWPAWRALTARRRSQLLQAWFSLIIKNADDLAQLVTAECGKPLQEAKGEVIYGASFVEWFAEEGKRTYGESIPSPAANTRLLVIKQPIGVCAAITPWNFPLAMITRKVAPALAAGCPVVVKPAEATPLTALALAVLAEQAGFPAGVFNVVTGKPAEIGGELCANPIVRKLSFTGSTGVGRLLMAQCAPTIKKLSLELGGNAPFIVFDDADVNAAVDGAIAAKYRNTGQTCVCANRFLIQAGIYDEFAAKFAEKASALKVGAGIEADVAQGPLINAAGLSKVEAHVADAVGKGARVLCGGARHERGGNFFQPTVLADVTTAMMVAREETFGPVAPLFRFETEEQAIAMANDTEFGLAAYFFTRNVGRCWRVGEALEYGMVGINTGMISNEVSPFGGIKQSGLGREGSKYGIEDYLEIKYLCFDVNT

SEQ ID NO: 29958 - protein, 477 aa, Dechloromonas aromatica RCB
MLRHTKIVATLGPASSTPEVLDRMVLAGIDVVRMNFSHGTADDHRARAEGIRAAAARHGRTIGILGDLQGPKIRVGKFEAGKITLVPGEKFILDAQCPLGNQERVGLDYKDLPKDVVNGDILLLDDGRLKLEVTGVRGHEIYTRIIVGGDLSNNKGINRQGGGLTAPALTGKDMDDIKTAADIGVDFVAVSFPKSAADMYMARQLLRAAGSTAVLIAKIERVEAITNLAEILDASDGIMVARGDLAVEVGDASVPALQKKMIRMARDRNKLTITATQMMESMITSPVPTRAEVSDVANAVLDGTDAVMLSAETASGKYPVETVESMARICVEAERSAEVTLDREFLDRIFTRIDQSIAMAAIWTAHHLKVKAIAALTQSGSTALWMSRMNSGVPIYALTPDAESVGRMVLFRGVCPLPMKQQHTDRDRLLAEAEQLLIDRGVVEKGDLIALTIGEPIGTTGGTNTLKIVRVGEHQLD

SEQ ID NO: 29959 - protein, 393 aa, Dechloromonas aromatica RCB
MNVIKLTDLDVSGKRVFIRADLNVPQDEAGNITEDTRIRASLPSIKYCLEKGAAVMVTSHLGRPTEGELNHEDSLMPVAVRLGQMLHTSVRLITDWVDGGFEVKPGEVVLLENCRVNKGEKKNNDELAQKMAKLCDIYVNDAFGTAHRAEATTHGIAKYAPVACAGMLMGAEIDALSKALHEPKRPLVAIVGGSKVSSKLTILKSLASKVDQLIVGGGIANTFLLADGKRIGHSLAEPDLVKEAHTIMDIMKERGAEVPLPTDVVVADEVSALARANKISVDDVHANDRILDVGPKTAAKFAEIIANAGTIVWNGPVGVFELPQFAGGTKMMASAIAHSEAFSIAGGGDTLAAIAKFHIADDVGYISTGGGAFLEFLEGKTLPAIAILEERAA

SEQ ID NO: 29960 - protein, 413 aa, Methanococcoides burtonii DSM 6242
MNTLTAKDFLTIDDFDIGDRTILVRVDLNSPMSPGGGILDDMRIKSHIPTLMDLEDAKVVLLAHQSRPGKNDFTTMQLHADVMSSSLGRKVTYIDDIFGTHARDSIASMEKGDVILLENVRFYSEESLRRPVDEHQGTHMVRKLAPLFDIFLNDAFAVSHRSHLSITGFSGVLPSGAGRLMEREITSLDVSLKGSESPCIFVLGGAKVDDSLKVAEHVLSSGGADRVLVTGVVANVVLAASGVDIGGPNMKFIESQGYLDQIDKAKNILERFDGKLGFPRDVALNDNGERIEANIDDVASSNLPINDIGLETIVAYSSEIENAKTVVLNGPAGVSEIEGFEIGTSEIIKAATNAGYSIAGGGHITAEVRNMGYEKMFSHISTGGGACIDYLAGDLLPGIEALKVAAKRYREFE

SEQ ID NO: 29961 - protein, 252 aa, Methanococcoides burtonii DSM 6242
MQDMTETLIEFRDVWKIYQMGEVQVDALKNVCIEIEHGEFTAIIGPSGSGKSTMMNLVGCLDVPSKGDIFLKSRNIADMTESDLSTLRGKTIGFVFQQYNLIPGMTALENVLLPLEIQEVEDDIALEKATEALELVGLSDKLSNRPSQLSGGQQQRVSIARSLACDPELILADEPTGALDSKTGRDVMGILYRLWKEKGKTIVMVTHDMDLAQYAARHIVLKDGMVVRDEINDNSSKNEDQNNNIPKKESLV

SEQ ID NO: 29962 - protein, 247 aa, Methanococcoides burtonii DSM 6242
MKTIENPENDDPAVVRANDVCRSYQVGDMMVPVLKNVNLVVKKGEFVAIMGPSGSGKSTLMNLIGCLDRPTCGSVSLMGTDVSTISDDELARLRGLEIGFVFQSFNLVPRLTALENVELPTYANSRPGVDTRKRAKELLELVGLEDRINYRPTELSGGQSQRVAVARSLINDPSLILADEPTGNLDSKTGKEIMDLFTELNKKGRTVIMITHDPNLAKVYADRVINLKDGYIEDRIIYNGTSSIIQQ

SEQ ID NO: 29963 - protein, 263 aa, Methanococcoides burtonii DSM 6242
MINAGVTGASGRMGKLIIENIIKMEGIQLSSAFDLMNIGKDVGEVAQTGKLDVNISDVADMATVLKESKTNVVIDFTIAPATVANAPVVAGAGVDLIIGTTGFSDEQRATIEGAIIKNGTSAVISPNYSVGVNVFFKILQETAKYLSEYDIEIIEAHHNQKKDAPSGTAMKAAEVISETLGGKDFVYGREGLAPRDKEIGIHAVRGGDIVGDHTVLFAGDGERIEIKHQAHSRNAFASGAVKAAIWINNAGPGIHTMDDILGS

SEQ ID NO: 29964 - protein, 453 aa, Methanococcoides burtonii DSM 6242
MKDNRKYDLAIIGGGAAGLATATHVKRCSDLSVIVISKDSHISYSECGIPFKLAGKVHDFDSLIVKTPEFFDKMGIDIALETEALSIDILNRTIKLENYDILFDKLIIATGGKQRIPQPLQKYIGMDGVFTLQTLADGMKIETALLSAETVVIIGAGAIGVEIAAGIAKRGIDTTLINRGPAILSRLIDPDMAEIVSEYLKSVGVTLVTGNVPDTIEGKEGVESVLISGERIPADIVIISTGILPDVELAEKAGISTGELGGIIVNQHLQVFVDGNFSTDIFAGGDCCEITDFITNKKTLVQLAPAARHMATIMANNVCGKDTVLKPLLGPSIYVAGDLLIGSVGLTSKRARAEDIYIITGYATGTTKASYYPGSSDIHIKLIFSDDRLTGAQIIGKSGVKERIDSLAFMIKKKATIEEMLSIETCYAPPVSTVVDPLMYAVKDAFRKIKART

SEQ ID NO: 29965 - protein, 235 aa, Methanococcoides burtonii DSM 6242
MIQLVLLRHGESISNKENRFTGWADVDLSNRGIVEAKDAGKILRESGFVFDLAFTSVLKRTIKTLWIVLEKMDLMWIPVRKSWHLNERHYGALQGLNKEESLKIDGENQLLIWIKSYDTRPSGLEKNDMRYAGNDPKYKDVDGKRIPVSESLKDSVERVLPYWHHNIVPIIKSGKKVLIVAHGNSLRALIKYLDDIPDEEIVKLDISTNIPLVYELDENLKPIKHYYLDNSGVCR

SEQ ID NO: 29966 - protein, 509 aa, Methanococcoides burtonii DSM 6242
MTILDGWGYSPEVEGNAIHAANTPNLDDLLETYPNTLLSASGEDVGLPEGQMGNSEVGHLNIGAGRVVYQDLTRINRDIGNGDFFKNPVLKQAIENAKAQGSALHLMGLFSYGGVHSHMKHLRALIEFAKDEGITEIFIHAFLDGRDVSPRAALEDMKEHVEYCNNLSVGKIATVSGRYYAMDRDNRWDRTEDAYNAITRGDGVYYSKGPVDAISEGYGRGENDEFIKPTVIVDENGRPIGRMNENDTVIFFNFRPDRARQLTYAFVNDEFDNFERKSHPKVHFVCMTEYDEKLEVPIAFPSEELKNTLGEVLSKEGIKQLRIAETEKYAHVTFFFNGGVEKQNEGEERCLIPSPKVATYDLKPEMSAYEVTEELIERIGSGKYDVIVLNLANMDMVGHSGIMEAAVKAVEVVDDCVGKIITAIKEVGGEAMVMADHGNAEKMVEFCNNTERQCYTAHTSNPVRCIYVTQEKRVELQKGRLSDVAPTILKIMGIEKPPEMTGVPLIKNT

SEQ ID NO: 29967 - protein, 402 aa, Methanococcoides burtonii DSM 6242
MVYNKQNLRKTGIVLILIILLTVPTASADWSSIAVMTSITGKVVLPGDTVEFPITIEKGHNNSDEAWCSLSIKDKNDGWSAGFYDDGDQITCLTFPEDKNSPEEVILRVKPPIDTPNGAYTIWADFKPNDGDTISHEFVVNVDNEAVLDLDIYSDMPGLETRPNDPVEFYVTLENDYDHRVTADINVVEKPDNWDVEFLEEGNGKYRITKTSIAANDKQNFIVKVRPSTNSSDGTYPVIVDVALENSQMGVSQQLDLTINRGIEEEKMLTIFPESKSINLNPGSSREIVVNLRNSGDRTLNNVELKIQGVSGITTFVRSFGAIDELEPGESREIPVEIKVRADTSSDTKEILMRAVSDEAESEDERVEVSVVKSSSGGFIGIGMIIGALLLLVFIVSKFGRR

SEQ ID NO: 29968 - protein, 360 aa, Methanococcoides burtonii DSM 6242
MLFEPITMAGLTVKNRFVRSATNEGMAELDGTVTKGIGDMYEDLAREDVGLIITGYSYVDVKGQSDERQQGIYDDRFIGPYREIVSRVHKYDSKIFLQIVHGGRQSIVKEGVALLAPSAVEDPASGKVPVEMTEEDIFDTIENFAEAARRSKEAGFDGVQIHCAHGFLLSSFISPYTNHRTDKWGGSVENRARIVTEIVKRIQEKVGKDFPVMVKMNATDGFDVFSGKIGLDAPECVEIASLLEKAGICAIEVSGGIFEAGPVMSQNGIDSEDKEAYFRRYSKMILDTVKIPVILVGGIRTKAVMESILRGYADMISLSRPFIAEPDLVVKLKEGSDRVKCVSCNGCFRTDGVSCTYNFD

SEQ ID NO: 29969 - protein, 385 aa, Methanococcoides burtonii DSM 6242
MYADRINSLPPYLFATIDEAKAVVKAKGVDVIDLGVGDPDMPTPEHIVESMCEAVRDPATHRYPSYTGMIEFREAVANWCKDTRGLELDAATETLTLIGSKEGVAHIPLAFVNPGDVALIPDPGYPVYKIGTQFAGGEPHVMPLLEENGFLPDFDAIPADKLAKAKLMFLNYPNNPTSATADVKFFKEVVEFAKNNDITVVHDNAYSEMVYDDYTAPSFLSVDGAMDVGMELYSMSKTYNMTGWRLAFAVGNKDLIAGFGKVKSNIDSGAFDAVQRAGITAVSSSQQCVTDMNSIYQKRRDALLKGLRGIGLDAKAPKATFYMWVPTPDGYDSMGFSKLLLEESGIVATPGVGFGEYGEGYIRFALTQSVERIEEAVARMDKLTI

SEQ ID NO: 29970 - protein, 477 aa, Methanococcoides burtonii DSM 6242
MNLPDHKTKIVCTIGPASSSEEMLRELIFAGMNVARINFSHGSFEDHSKVIRLIKKLCDELNVIVSVMADLPGPKIRVGEIKDSPINLQKGDKVKLTTKRIVGSKDLIPVDFDKLPYCIAKKSDVYFNDGFIQMRCSGICSNEAECEVIVGGQLSSHKGVNLPGIDLLLDPVTEKDLKILDFALDEGVNCFSVSFIEQGSDIQKIRDHATKKGRSVFLVAKIERGHSVGNIDDIMEATDALMIARGDLGVEIPIEEVPIVQKELIHKANLRGMPVITATHMLESMTDNVRPTRAEATDVANAILDGTDAIMLSGETAVGKYPLEAVHTMVRIARKTEAWRDSTGNGMGNIRNAIGETEMGISDVISLQVYDAIRKLSIELVVTPTHSGATPRRISRFKPDNWIIAMSHVELTCEQLAYSYGVYPISVSDSSEDLEKKMLGALLSRGIGKSGNTIVLTQGSSGGTNLLKIIELDQLVE

SEQ ID NO: 29971 - protein, 446 aa, Methanococcoides burtonii DSM 6242
MGDAMNINTKEDVLKAIENNNVKFIRLQFTDIQGVVKDVEIPVTQIEKALSVGISFDGSSIEGFVRINESDMVLKPDTSSFAILPWNQKKGVVARMICDIYLPDGTPFEGDPRYTLKKVMKEAKEMGFSLNVGPELEFFLFERHDGKATTIPHDFGRYFEFAPADLAEDIRRDIVLTLMDLGFEIEASHHEVAFGQHEIDFKYGDALTTADNVTTFKYVTRTIAKLNGLHATFMPKPIFGENGSGMHVNLSLSKNGENIFYDADGDMQISDEARYFIGGLLKHVKAITAISNPLINSYKRLVPGYEAPVYIAWSGANRSSLIRIPAARGKGTRVELRSPDPSCNPYITFAAVLAAGLDGIRNKIDPGDNREENIFELTDKGLRDFGIETLPSTLNDSAKYLADDELLKEALGAHVHNSVLSLAKAEWDSYRIQVHDWEIERYLNTV

SEQ ID NO: 29972 - protein, 451 aa, Methanococcoides burtonii DSM 6242
MTSINPANGTVNGEFEFHSPDEVDLILKRSSESFQYWSSLKGVERAVYIENVAKVLRSDKQELAETITMEMGKPIRQALAEVEKCASMFDHFATNICSLLEPDVVKESPSAFISYEPMGAVLAIKPWNFPLWQVLSAASHILAGGNTMVLKHSGYVPMCALNIESVFEKAGFPEGVFQTVLVDGPTASSLISRPEIAAVSFTGGLSAGQNVAEVAGRNMKKCVLELGGSDPFIVLEDADIEKAAKAGVAGRFLNTGQTCISSKRFIIESSVVDEFTSAFVENTRKLKIGDPLDADTDLGPLVRDKQVSLLEHQIYNAISMGAKVELGGGKVEGDGYYFSPVVLSNVSLYMQVMKEETFGPVAPIISVETESEALDVANATEFGLGASIWSGDKDKASLLASQVQSGVVGVNGFFKPEADLPFGGVKKSGIGRELSRFGFYEFMNIRSTVLF

SEQ ID NO: 29973 - protein, 373 aa, Rickettsia rickettsii
MSQNYYQILGVSKTASQADLKKAYLKLAKQYHPDTTDAKDAEKKFKAINAAYDVLKDEQKRAAYDRLGHDAFQNQQSRGGGGNHGGFHPDINDIFGDFFSDFMGGSRRSSRPTSAKVRGSDLKYNLTINLEEAFHGIEKNINFSSAVKCNTCHGSGSEKGETVTTCDACSGVGATRMQQGFFTIEQACHKCQGNGHIIKNPCKKCHGMGRYHKQRNLSVNIPAGVENGTRIRHTGEGEAGIRGGNSGDLYVDITIKPHDIYKVDGANLHCKLPISFVNAALGGEIEVPVIEGGKVSLTIPAGTQNGDQLRLRSKGMSKMRSTIRGDMLTHIHVEVPKNLSKRQRELLEEFKKESINEKENDGSFFNKMKSLWS

SEQ ID NO: 29974 - protein, 166 aa, Rickettsia rickettsii
MQNYFQLLGLPQEYNINLKILEKQYFAMQVKYHPDKAKTLQEKEQNLITAAELNNAYSTLKDALKRAEYMLLLQNINLNDEKTRSLLSPLELSIFWDEMEIIENTILFSDLEKIKDKYELMKKLEIDALKQAFEEQNLSDATIKTSKLKYIGTLLHKLQEKIKSCK

SEQ ID NO: 29975 - protein, 161 aa, Rickettsia rickettsii
MSNSSKKHLDLPYRPGVGMMILNADNHIFVGKRIDTKISAWQMPQGGIVPGETPSIAAMREMLEEIGSDKGYIIAESKCWYSYDVPSFLIPKLWNGNFRGQKQRWFLIRFTGNNEDININTSNPEFDQWRWASLDELLSIIIPFKRKLYQAVVKEFESLIQ

SEQ ID NO: 29976 - protein, 459 aa, Rickettsia rickettsii
MQEFDLVVIGSGPAGYTGSIRAAQLGMKVACIEKSDTLGGTCLNIGCIPSKALLNSSEKYEAALKHFENIGITADVKLDLQKMLANKDKVVLDLTKGIESLFAKNKVTRIKGEAKISSSNIVEVNKEQIKAKNILITTGSSVIEIPNIKIDEEFIVSSTGALKLSKVPENLIVVGGGYIGLELGSVWRRLGAKVTVIEYAPSIVPMLDKEIATQFMKLQQKQGIEFKLNTKVLSAEVKSGKVNLTIEEDDKSSVVTSDVVLMAVGRKAYTQNLGLESVGIITDKQGSIEINDQFQTAVSNIYAVGDVVKGAMLAHKAEEEAVAAVEIMAGQAGHVNYNLIPSVIYTYPEVASVGETEEQLKEKGINYKVGKFPFLANSRARAIGSTEGMVKILADSKTDRVLGAHIIGADAGTLIAALTAYMEFGAASEDIARTCHAHPTLSEAIKEAALSVDKRTINI

SEQ ID NO: 29977 - protein, 444 aa, Rickettsia rickettsii
MTKKHYICSNCGNISPKWSGQCFDCGVWGSIVEEIISTNQAIVKVGSKQDFDKLSGHVTEQLRIPTPIGEFNRVLGGGLVLGSAILIGGDPGIGKSTLLLQLAASNFASKMNCLYITGEESLDQIKLRAIRLNLTNYNTDILAATNLEDIIASIEANKNNIDLIVIDSIQTITTKELSSPPGTVSQIRTCANELVNYAKQNNIIILLSCHVTKDGQLAGPKILEHLVDTVLYFEGDHNNHFRILRSYKNRFGGVGEIGVFEMNGSGLIEVTNPSELFLMQREQNVIGTSIFAGIEGSRPLLMEVQALIVPSNMVTPRRSAVGWDANRLSMILAVLSSRIGLNLANYEVYLSIAGGLKIADPASDLAVTASLISAATGNPVPEHSVFFGEISLSGEIRKTAKAETRIKEAVKLGFNKIICSKFENLTYDFISSVSHLKDLKEIIK

SEQ ID NO: 29978 - protein, 1140 aa, Rickettsia rickettsii
MDTNKLYLFKDRRFLPNFIVQLCGCLNDNILKNALVILITYGISGALSQYNNLLVLIANATFVLPFIIFASIAGQIADKYERANLIKIIKICEIGIIAFAIYGLHNNNLLILFCSICLMGMHSTFFGPIKYSVLPDHLNKDELLGANGFVEAGTFIGIFIGTIIGSYYTISNNFIIYSLITIAFLGFITSLFSPKSKNVNRDIKINFNIIDESINMIKYAKAKQQIYLAILGISWFWFIGAAIISQIPLLAKITFKADENVANLFLAVFSLGVGVGSFLCSKIFEDEITVKYLFISALGISIFGIDLFFASRISSVNYEPTQLKSILVFLSKRHNWRIVIDLLFLAAIGGLYIVPLFAILQHYANPAHRSRIIAVNNLINSIFMVGSTIILSLLFYLNFTIPWIILFISLANIIVTIHIYRLIPEVKIIPFKLLRRIFQICFDLMYKVEVKGFENFQKAGKKVVVVANHISYLDPPLIATYLREEMTFAISPDIQKIWWIKPFLRMARTLPVDPSNPMAIKTLVKEVQKDQKVAIFPEGRISVTGSLMKIYEGPGMIADKAGATILPVRIDGTQFTHLSKLKNILKRKIFPKITITILPPVKFANMDATSNQERRSYISRTLYDIMADMMFESSDYQNTVFSSLIEAAKIHGFKKKIVDDFENNAVTYRDLILKSFILGDLIKKNNIFGRNLGLMLPNTTDTLITFYAMQSSGYVPAIINWSSGISTVINSCKLAQIKVVYTSKQFIEKANLYELITNLLDFGIKIIYLEDFKNQIGTALKLKAKIGSYCAQTYYNYFCRNRDDEKPAVIIFTSGTEGKPKAVLLSHRNLQTNRYQITAKVPFSPEDIVFNALPLFHCFGLSGAIITTLNGIKLFLYPSPLNYRSIPEVIYDIGATILISTDTFLNGYANYAHPYDFYSLRYIFAGSEKLKESTRQFWLNKYGIRIFEGYGITEASPIIACNTPMHNKAGTVGRLLPKIDYKLEKVEGINEGGRLFIKGPNIMLGYLDLEGHRTYKEWYDTGDIVKIDSEGYITTLGRLKHFAKIAGEMISLTKIEELASEIDPDSLHAAISIPDKTHEDKIILLTTGSNINRENFADAVSKAQIPLLHLPKVIITDSEIPLLTNGKIDYLEIMKNVDRF

SEQ ID NO: 29979 - protein, 238 aa, Rickettsia rickettsii
MQLIVVKYMGVDSLHNLSYKEEFEGDMKRSTTAYKKVSEDASIGSTYIADTSEVGSQISGEPVQRIKIPEHRQILQFNVPNLEVSKVYKLPLEGGYARSLIKPVIMAGGNGKRLWPLSSKDKPKQFKKILSDLTLLQQTLNRNKFLGQPTIITFKKYESITKEQAAEIDVEIALITEPLQKNTAVCAIITTLSATALGFDIVVLLPSNHHIADDINYLNTINKALHYVNECGICTIFL

SEQ ID NO: 29980 - protein, 459 aa, Rickettsia rickettsii
MEQYDVAVIGGGPGGYVAAIRAAQLKKKVVLIEKEHLGGVCLNWGCIPTKSLLKSAEVFEYIKHAKDYGIDAKGAEINIKKIVERSREISNKLAGGVKLLLKKNKVTVIDGVASLAGNKVININDKPTVKAGNIIIATGARSRVLKGFKPDGKQIWTSKEAMIPQHVPKSMIIVGSGAIGIEFASFYNSIGVDVTVIEAHNRILPAEDMEISGIAHKNFEKKGIKIITNAKLIKQTKSKDKIEVELELADKTQKLQAEILLMAVGITANTENLGLEKTKIKVENGYITTNGLMQTAVSGIYAIGDVAGVPCLAHKASHEGIIAAESIAGLKPHTINKHNIPGCTYSSPQIASVGLTEEAATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 29981 - protein, 335 aa, Haemophilus influenzae R2846
MEQTMKIAIYSTKSYDRKYIELINAKYNFDLEFFDFMLNESTVRLAEHCEVVCIFVNDNGSRKVLEKLAALGVKIVALRCAGFNNVDLKAAQELGIQVVRVPAYSPEAVAEHTIGLMMTLNRRIHRAYQRTREANFSLEGLIGFNMYGRTVGVIGTGKIGIAVMRILKGFGMNILAYDPFKNPVVEDLGGQYVELDELYAKSHVITLHCPATPENYHLLNREAFAKMKDGVMIVNTSRGSLIDTQAAIDALKQRKIGALGMDVYENERDLFFEDKSNEVIQDDIFRRLSSCHNVLLTGHQAFLTEEALTNIADVTLSNIYKLKLGKVCENIVLPS

SEQ ID NO: 29982 - protein, 369 aa, Haemophilus influenzae R2846
MTQQYAIDTLLAQAGNRSDERTGAVSAPIFLSTAYGHCGIGESTGFDYTRTKNPTRTVLEETIAKLENGDRGFAFSSGMAAIQVLMTLFTALDEWIVSSDVYGGTYRLLDFSYKNNNSVKPVYVNTASASEIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKDQPQVESVLYPNKGGMLSFRLQDEAWVNTFLKSIKLITFAESLGGTESFITYPATQTHMDIPETERVARGITNTLLRFSVGIEDVEDIKADLLQAFANLK

SEQ ID NO: 29983 - protein, 382 aa, Haemophilus influenzae R2846
MAKKDYYEVLGLQKGASEDDIKRAYKRLASKHHPDKNQGSKEAEEKFKEINEAYEVLGDDQKRAAYDQYGHAAFEQGGGTGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKTCRSCHGEGRVHKKENLSVKIPAGVDTGNQLRLAGKGAAGENGAPAGDLYVVIHVREHNIFERDGSNLYCEVPISFATAALGGEIEVPTLDGRVKLKIPAETQTGKLFRMRGKGVTSTRSGYAGDLICRIVVETPVNLTSEQKELLQKLEESLQGKDLSKHAPKSSGFLDGVKKFFDNLGKSDK

SEQ ID NO: 29984 - protein, 430 aa, Haemophilus influenzae R2846
MMDEQSLLAFDTQHIWHPYSSVSSDMPLYAVERADGVMITLKDGRRLIDGMSSWWAALHGYNHPRLNAAAQNQLAKMSHIMFGGFTHDPAVELAQLLVQILPNGLDKIFFADSGSVAVEVAMKMAIQYQHAKGEVQRQKFATIRSGYHGDTWNAMSVCDPTTGMHHLFHHSLPVQYFLPQPNIPFNESWNDCAIEPLADLLKKKGSEIAALILEPVVQGAGGMYFYSPTYLVKAQALCKQYGVLLIFDEIATGFGRTGKLFAAEHAGISPDIMCIGKALTGGYLTLSATITTTEIAQIICRGEAKCFMHGPTFMANPLACAIAAESIRLLLESPWQQNIQRIEHSLTQQLSPLAEKDYVKEVRALGAIGVVEMKSAVNMKTLVPRFVEQGVWIRPFGKLVYVMPPFVIKNDELQKLTEGMILALTQEYEH

SEQ ID NO: 29985 - protein, 315 aa, Haemophilus influenzae R2846
MKIVFLDSTAIPKHILIPRPSFEHTWTEYDHTSSAETIERARDADIVITSKVIFDRETLQQLPKLKLIAITATGTNNVDLVAAEEMGIAVRNVTGYSSTTVPEHVIGLIFSLKHSLAGWLRDQTEAKWAESKQFCYFDYPITDVRGSTLGVFGKGCLGTEVGRLANAVGMKVLYAEHKDATVCREGYTPFDEVLKQADIVTLHCPLTETTKNLINVETLSKMKKGAFLINTGRGPLIDELALVDALKTGHLGGAALDVMVKEPPEKDNPLILAAKTMPNLIITPHIAWASDSAVTTLVGKVMQNIEEFVQQLNQK

SEQ ID NO: 29986 - protein, 458 aa, Haemophilus influenzae R2846
MAKATKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPNDQLKMLSETSVEQICNLSDQLKPQIIVVDSIQVMHLADIQSSPGSVAQVRECASFLTRYAKTRQVAIIMVGHVTKDGTLAGPKVLEHAIDCSLLLEGEADSRYRTLRSHKNRFGAVNELGVFGMTEQGLREVKNPSAIFLSRGDEITSGSSVMVLWEGTRPLLVEIQALVDHSMLANPRRVAVGLEQNRLSLLLAVLHRHGGLQMADQDVFVNVVGGVKVSETSADLALLLALISSFRNRPLPQDLVIFGEVGLAGEIRPVPSGQERISEAAKHGFKRAIVPFGNKPKSAVENMQVFTVKKLTDALAVLDNL

SEQ ID NO: 29987 - protein, 464 aa, Haemophilus influenzae R2846
MNFRLLSQYHTDIKKLIKISLPILLAQIAQNSMGLADTIMAGRVSSTDMAAISIGASIWMPLMFFGQGLLLALPPTISYLNGSGQHHRIAHQVRQGIWLVLGVSIPLGLLIYFCEIPLQYMQMESKMSDLARNYLHAMLWGLPAYLMLINFRCLNDGIEKTKPAMVITFLGLLINIPLNYIFIYGKFGMPAFGAVGCGIATAIVNWAMCLMMIFYSYTNTQERSLKVFSQLIEMPNPKTLKKLLRLGLPIAIAICCEVALYALTSLMLSPLGATIVASHQITLNTSSFIFMFPMSIGMATTILVGQALGAGSPQNAKKIGYAALLLGLTVTIVTALITIFFRYEIASIFVTDEIVIAMAANLLLFAALYQFSDTIQMVVGGILRGYKDTKVILYITLFSYWVIGVPLGYTLGRTDWLVPHIDAKGFWIAFVVSLTFAAFLLSLRMKKMQAMNDNAILQRLEKLK

SEQ ID NO: 29988 - protein, 174 aa, Haemophilus influenzae R2846
MFNPFQIFDLPVDFQLDEKVLNARYLKLQKALHPDNFVSSSALEQRIAMQKSTEVNDALKTLKDPILRAEAIIALNTGEQLDLEQKSTQDVAFLMQQLQWREQLEEVESQQDERALNVFAKEIKQETQSLLTALFESLKSQQWARASQYCDKLRFTHKLSEEIERVEERIFELD

SEQ ID NO: 29989 - protein, 410 aa, Haemophilus influenzae R2846
MTNKVSLDKSKIKFVLFEGVHQSALDTLHAAGYTNIDYYKKALDGDELKEAIKDAHFIGLRSRTHLTAEMIEAAPKLIAVGCFCIGTNQVDLNAAKVRGIPVFNAPFSNTRSVAELVLGEILLLMRNVPQANAEVHRGVWNKSATGSHEVRGKKLGIIGYGHIGSQLSIIAESLGMDVYFYDIENKLPLGNAKQLRGLQELLSSCDVVSLHVPELPSTKNLMNAERIAQLKQGAILINAARGTVVDIDALAQALKDGKLQGAAIDVFPVEPASINEEFISPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 29990 - protein, 386 aa, Haemophilus influenzae R2846
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAINLFGIADKISYISTGGGAFLEFVEGKVLPAVEILEKRAKN

SEQ ID NO: 29991 - protein, 224 aa, Haemophilus influenzae R2846
MKPYLIAPSILSADLARLGNDVQNVLNAGADVIHFDVMDNHYVPNLTFGPAVCQALRDYGITEPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQMRTQLASVSA

SEQ ID NO: 29992 - protein, 255 aa, Haemophilus influenzae R2846
MLKVSNIQKNFNGNHVLKGIDFEINKGEVVAILGPSGSGKTTFLRCLNLLERPEQGILEFTDGSLKIDFSQKISKADELKLRRRSSMVFQQYNLFPHRSALENVMEGMVVVQKQDKAQAREKALSLLEKVGLKNKADLFPSQLSGGQQQRVGIARALAVKPDIILLDEPTSALDPELVGEVLQTLKMLAQEGWTMIIVTHEMQFAQDVADRVILMADGYIVEQNTADKFFTCPQHERTKQFLLQAKIPLELDYYI

SEQ ID NO: 29993 - protein, 456 aa, Haemophilus influenzae R2866
MTKHYDYIAIGGGSGGIASLNRAASYGKKCAIIEAKHLGGTCVNVGCVPKKVMFYGTHIAEAINNYAPDYGFDVEVKKFDFSKLIESRQAYISRIHTSYNNVLAKNNIDVINGFGKFVDAHTVEVTLADGTKEQVTADHILIATGGRPYRPNIKGQEYGIDSDGFFALTELPKRAAVIGAGYIAVELSGVLNSLGVETHLLVRRHAPMRNQDPLIVETLVEVLAQDGIQLHTNSTPSEIVKNADGSLTVRCDGQSDITVDCVIWAAGRVPATDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 29994 - protein, 378 aa, Haemophilus influenzae R2866
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGFMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFDLAKQFGATDYLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDQINEAFELMHEGKSIRTVIHY

SEQ ID NO: 29995 - protein, 174 aa, Haemophilus influenzae R2866
MFNPFQIFDLPVDFQLDEKVLNARYLKLQKALHPDNFVSSSALDQRVAMQKSTEVNDALKTLKDPILRAEAIIALNTGEQLDLEQKSTQDVAFLMQQLQWREQLEELESQQDEKALNAFAKEIKQETQSLLTALFESLKSQQWARASQYCDKLRFTHKLSEEIERVEERIFELD

SEQ ID NO: 29996 - protein, 410 aa, Haemophilus influenzae R2866
MTNKVSLDKSKIKFVLFEGVHQSALDTLHAAGYSNIDYYKKALDGDELKEAIKDAHFIGLRSRTHLTAEMIEAAPKLIAVGCFCIGTNQVDLNAAKVRGIPVFNAPFSNTRSVAELVLGEILLLMRNVPQANAEVHRGIWNKSATGSYEVRGKKLGIIGYGHIGSQLSIIAESLGMDVYFYDIENKLPLGNAKQLRSLEELLSSCDVVSLHVPELPSTKNLMNAARIAQLKQGAILINAARGTVVDIDALAQALKDGKLQGAAIDVFPVEPASINEEFVSPLREFDNVILTPHIGGSTAEAQENIGFEVAGKFVKYSDNGSTLSSVNFPEVSLPEHEGTKRLLHIHENRPGILNKLNQIFVEANLNIAAQYLQTDPKIGYVVVDVETNDASPLLTKLKEIDGTIRARVLY

SEQ ID NO: 29997 - protein, 221 aa, Haemophilus influenzae R2866
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIELHPEGGNK

SEQ ID NO: 29998 - protein, 386 aa, Haemophilus influenzae R2866
MSVIKMTDLDLVGKRVFIRADLNVPVKDGKVTSDARIRATIPTLKLALEKGAKVMVTSHLGRPTEGEFKPEDSLQPVVDYLKNAGFNVRLEQDYLNGVEVKEGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLMPVAKELAANTDIPVPVDVRVGLEFSETAAATEKAVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 29999 - protein, 484 aa, Haemophilus influenzae R2866
MSVKGDIGVIGLAVMGQNLILNMNDHGFKVVAYNRTTSKVDEFLQGAAKGTNIIGAYSLEDLAAKLEKPRKVMLMVRAGDVVDQFIDALLPHLEEGDIIIDGGNSNYPDTNRRVKALAEKGIRFIGSGVSGGEEGARHGPSIMPGGNQEAWQYVKPIFQAISAKTEQGEPCCDWVGGEGAGHFVKMVHNGIEYGDMQLICEAYQFLKEGLGLSYEEMQAIFAEWKKTELDSYLIDITTDILGYKDVDGQPLVEKILDTAGQKGTGKWTGINALDFGIPLTLITESVFARCVSSFKDQRVVANQLFGKTIAPVEGDKKVWIEAVRKALLASKIISYAQGFMLIREASEQFGWDINYGATALLWREGCIIRSRFLGNIRDAYEANPNLVFLGSDSYFKGILENALSDWRKVVAKSIEVGIPMPCMASAITFLDGYTSARLPANLLQAQRDYFGAHTYERTDKPRGEFFHTNWTGRGGNTASTTYDV

SEQ ID NO: 30000 - protein, 224 aa, Haemophilus influenzae R2866
MKPYLIAPSILSADLARLGNDVQNVLNAGADVIHFDVMDNHYVPNLTFGPAVCQALRDYGITAPIDVHLMVKPIDRIIPDFAKAGANYITFHPESSEHIDRSLQLIRDCGCKSGLVFNPATPLSYLDYVLDKVDVVLLMSVNPGFGGQSFIPATLKKLQQARKIIDESGYDIRLEVDGGVKVDNIAEIAAAGADMFVAGSAIFGKPDYKQVIDQMRTQLASVSA

SEQ ID NO: 30001 - protein, 480 aa, Crocosphaera watsonii WH 8501
MAFTQNPIKFGTDGWRGVIAADFTFERVALLAPLCAKILEENYGTSDRGRKIIVGYDRRFLAEEFAEVTANAIIEAGYDVILSQSYAPTPAFSWAAKAQNALGAIVLTASHNPGKYLGLKVKGAFGGSVAPAITQQIEALIPNPPQFSASPGSLSHFDPWESYCQGLRQKVDIKAIQEAITAEKLRVFADVMHGAAASGLERLLGCPIEEINSDRDPLCEGGAPEPLPRYLSKLFLTIKTAISQGDNSLKVGLVFDGDSDRIAAVDGQGNFLSSQILIPILIDHLAKRKGFTGEIIKTVSGSDLIPRLADVYNLSVYETPVGYKYIADRMLDSETLIGGEESGGIGYGTHIPERDALLSALYVLEAVVESGQDLGQYYGQLQEKTDFYNAYDRIDLPLANMEVWGKLLQRLQTEPLTEVAGQKVESCDTKDGYKHRLTDGSWLLIRFSGTEPVLRLYCESLTMKQVHQTLNWAKNWANSV

SEQ ID NO: 30002 - protein, 486 aa, Crocosphaera watsonii WH 8501
MVIKTPEWVKNAIFYQIYPDTFARKVPDRQKWLLDVPLEDWEAPPTSQGYKGGNLWGVIDKLDYLQDLGVDALYLTPIFRSACNHRYHTQDYYAIDPLLGDREAFDHLLKTAHDKGFKVVLDGVFNHASRGFFFFNDILENGPNSPWLDWFKIEGWPLSAYDGSRPANYVSWIDYRALPQFNHDNPAVREYIMQVGEYWLQQGIDGWRLDVPNCVEAEGFWEEFRERVKAVNPEAYIVGEIVSDATQWLDGKQFDGVMNYPFARLTACFVIGDRLDKETIPSFYKPYETLDAAEYAKGLEELLARHPWEIQLTQLNLLDSHDTSRFLTMAGGDRTSLQLATLLLFTFPGTPNIFYGDEIGIEGGKDPDGRKGFPTEEKWEQETLTYHKQLIQIRKKYTALRTGEYRVITAQENVYVFARILGEEGLIIAVNNGEDKTEIQIDKFDKVSSILQTKPSQIIYGEGSINWHDNQLKITMHPRSGLVIAP

SEQ ID NO: 30003 - protein, 387 aa, Crocosphaera watsonii WH 8501
MNIIIGRNKTARRAYGIDEIALVPGNRTLDPSLADTSWTIGGIERSIPILASAMDSVVDVKMAGLLSDLGAIGVLNLEGIQTRYEDPKPILDRIVSVGKSEFVGLMQELYAKPIQPELIKQRIIEIKNNGGIAAVSLTPAGASKYGNIVAEAGADLLFVQATVVSTAHLSPESITPLNLEGFCQEMPMPVIFGNCVTYEVALNLMKAGAAALLVGIGPGAACTSRGVLGVGVPQPTAIADCAAARDDYQRETGRYVPVVADGGIVTGGDICKCIACGADAVMIGSPIARAAESPGRDYHWGMATPSPVLPRGTRINVGTTGTIQEILTGPAKLDDGTHNLLGALQTSMGTLGAKDLKEMQEVEVVIAPSLLTEGKVYQKAQQLGMGK

SEQ ID NO: 30004 - protein, 233 aa, Crocosphaera watsonii WH 8501
MIQSTKSTVISPSILSADFSRLGAEIKAVDQAGADWIHVDVMDGRFVPNITIGPLIVDAIRPYTQKPLDVHLMIVEPEKYVADFAKAGADIISVHAEHNASPHLHRTLGQIRELGKQAGVVLNPSTPLDLIEYVLELCDLVLIMSVNPGFGGQSFIPEMVSKIRKLRQMCDEKGLDPWIEVDGGLKPNNTWQVLEAGANAIVAGSAVFKAADYAEAIEGIRNSKRPERELAAV

SEQ ID NO: 30005 - protein, 422 aa, Crocosphaera watsonii WH 8501
MTHTILPEKPTQSFDPQHFDTYVMHTYGRFPIAIERGEGCRLWDTNGKEYLDFVAGIATCTLGHGHPALVKSVSEQIRSLHHVSNLYYIPQQGELAQWMIENSCADKVFFCNSGAEANEAAIKLIRKYAHTVLDFLEQPVILTAKASFHGRTLATITATGQPKYQQDFEPLMPGFAYIPYNDIKAVEHAIADMDEGNRRVAAIMLEPLQGEGGVRPGEIDYFLRLRKICDENNILLVFDEVQVGVGRSGKLWGYENLGVEPDVLTSAKGLAGGVPIGAMMCKEFCNVLTPGTHASTFGGNPLASAAALTVLKTIEEDNILQNVQARGEQLRTRLRAIAQKDPTLFIDVRGWGLINGIEINEEMSITSIDIVKAAMDEGLLLAPAGPKVLRFVPPLIVTEEEINEAAEKLETAISEVCAAAVN

SEQ ID NO: 30006 - protein, 367 aa, Crocosphaera watsonii WH 8501
MGIDYPYVAEEAQPGTQVLLDDGLLELGVETVEGKAVTCKVIEGGILKSHKGVNFPSLNLRLPSMTEKDKKDLEFGISQGVDIISLSFVRQAADIQTLKAFLAERNVDIPVLAKIEKPQAIEHLEAIVDECNAIMVARGDLGVEMRPEKVPLLQKRIIRMSNQKGIPVITATQMLDSMIRNPRPTRAEASDVANAIIDGTDAVMLSGESAVGDFPVQAVNMLASIARDVEPEITFANYPPRNRDKAHALSEAINAVDQVLDLQCIVALTETGYSAKLAAAERPKVPVVALTPSIEVYHRLNLVWGVRPVLFEYDDLTLEDLVKQMDSLLLERNFVTKRDQVLILGGLPLRQARSTSFLDIHTIGEPN

SEQ ID NO: 30007 - protein, 511 aa, Crocosphaera watsonii WH 8501
MEPRQELNSIVVTTEQMANIEGKIFAGGMPVAALMEKAALLTSQRIQQLYPLHTVDKVGVLVGPGHNGGDALVIARELHLQGYDVCVYCPFTKLKELTQQHANYAHSLGIPYHNDLESLNHCQLIIDGLFGFGLKRPLSGNLAIDVDRLNQWSIPVVSVDIPSGLHTDTGEVLGTAVKATHSLCLGLWKPVYFQDQALAYTGIAEKIDFGIPLKDIFSTIPQPIPLQLLHKTLALGFLPLPRPQLTHKYQQGHLLLIAGSHRYAGASILSSNGAKASGVGMLSVAVPESLKPLLVGKIPDGLVIDCPVSEKGVIASLPPLATDFASYDIIACGPGLTREATEVVTRVLEAKCPLVLDADALNILAQLGTVNRLSKRQNATVLTPHLGEFKRLFPDIHNPEKDRISATKQAASQSGAIILLKGARTIIANPQGKIWIIPESTPALARGGSGDVLTGLIGGLLAQNKTTNHTLEAMVATAAWWHAQAAILAAKERSELGVDAGTLSQYLHTIF

SEQ ID NO: 30008 - protein, 1337 aa, Crocosphaera watsonii WH 8501
MFPTDSTVVNLLQHRASNHAQKLSYTFLTSGETEEIALSYSNLESQAKTIAAQLQNLNMQGERALLLYPSGLEFIAAFFGCLYAGVVAVPVYPPQGKQPLSRLEAIAKNAQAKIILTTSNYKAEIKQYFSQISKFDDLTYLTTDNLDSSLGFDWKKPNINSNTLAFLQYTSGSTGNPKGVMVSHGNLLKNSANIYQAFNHNSDSHGVIWLPPYHDMGLIGGIIQPLYGGFPVTLMSPSSFIRKPIRWLKAISRYQATTSGGPNFAYQRCLETITPQQKAELDLSSWQVAFTGAEAIATQTLEEFAEAFACCGFQREAFYPCYGLAEATLFVTGKVMEAEGTERQEMIPPTPLTKGGKLPTQTFQEGNVGVLERLSPISLQETCELREPKIIKVDSKELQKNKVVLTSEETIKTQKIVSCGRPAIDENIIIVDPETALPCPPETVGEIWVSGASIAQGYWQDEDATEKAFNAYLPDNKKPFLRTGDLGFLHQGELFVTGRIKDIIIIRGRNYYPQDIENTVKNCHPALRDHSCVATSITSEEGEKLVIIGEIKRKLEQKINFQEIVNTIRSHVSRKHGIQTNKIVLVKQGSIPKTSSGKIQRLAGKKAYLENNISIIFQEDSSEKNTKESQEKTMSHSIELNKTQKRKDKKLSELISWLRNYANENINSRLIDERRCIPPHIVLDFGNQGLLGMQVPLEYGGLGLNNGETMNVMEQLGAIDTTLSLFVGLNNVLGIRPLLNFGSPSLREELLPRLATGRELAAFALTEPSAGSNPQAIASSAIPQSPEQWIINGTKIWSGSAAWAGIINVFVQEKDSQGNFQGISGFTVKRGTPGLKQGPEALTMGMRGMVQNTVYFNDVAVDASQKLGNTGEGMKVAQYAMMYGRLTIAAASVGGMKRCAQLWHRYSSRRQISTGRLLENPLVLARLNGLTAAITTIETLVTSITTWLDQGQEVPVEAYAVCKMAAPEFYWEAADNLVQFLGGRGYIESNMAPQILRDARILRIFEGPTETLTAFLGSRVIYQPESFKTFLCDTLSMPEIYERFEQTVQQIQDYRQSPFTEETKTKNWTAILCGEVAMWGVLLAVLEAKAMSSTSESLNRAIAWTKEHFQQKIAQGFAQTPDELVISSANKTTELISDYENAIGNLEQTLAGEDREVDEFLRLGDSETRRLGDWETGRLGDSETGRLGDWETRRNIENWLMNWLEEKLNLSPQNIDPKQAFADYGIDSVMAVELAQDLQEWLGYTQQLEASLAWNFPTIKSLAQYLSTIESEDEIVEEKFAVNDSKIALNGQSQGTSSTENPEIISDISNYSEDEIQTAINQEMAELESLLKGGYPS

SEQ ID NO: 30009 - protein, 1292 aa, Crocosphaera watsonii WH 8501
MGWKFTENQSLSKQSLTIAKKYQRLTDYLLKNLTEAGILNKIDDHWQVIKTSNSATIERQKQELLKEYPFAEIELTLLHRCASQLAQVLQGKCDPVQLLFPQGDLSTATQLYQDSPGAKMMNTLVQETLSVALETLPQGKKVRILEIGAGTGVTTAYLLPYLDSAQTEYCFSDISPIFSEKAKQKFSDYSFISYQTLDIEQDPQKQGFSAESYDIIVAANVLHATENLEETINHVHQLLAPKGMLLLLENTSALLWLDLIFGLTEGWWRFNDEVRNDYPLISAQKWQKLLIDREFEHTAILKPEQKQGETVSQQSIILGQKKASAPKNWLILGDKDVFAENLVNYLQEKGQYAILSQEIDNLDEFQHIIYLGSLDSPEPSNLTTQDLETASEIGCTNVLTLVQTLANSSTPPTLSIVTRGAVSTETEDILPGLTEASLWGIGKVINLEHTQLNCRCIDLDTKIAPEKQIQALLSVIESTEKETQVALRDDQLQVSRLVRHGKIEPYKLEIPQNEAFKLDISQKGTLSNLELVPTSRISPEQGEVEIKVGATGLNFIDVLDGLGLLPFEREWFGVECVGEVVRVGEGVNELKKGDRVLALAPGSFSQYVTITTQLVSHCPKNLTIEEAATIPANFLTAYYALHRLGKIKKGDRILIHSAAGGTGMAALQIAQQVGAEVFATASPNKWEFLKSLGVKNVMNSRTLDFAAEILTITEGKGVDVVFNSLSGEFITKSFSVLADEGRFLEIGKRDIWTREQVHKVKPNASYFAIDLLTIAQQQPQLIQSMLTELKQKFEEDRLKPLPRNVFPIEQTIQAFRYMQKGKHIGKIVVSYNPELKNISSSEQLNNISVGANGRSPIQKMPLGFSEDGTYLITGGLGGLGLLVARWMIEKGAKNLVLMARSKANSQQKQEIQALEALGGNITVAQGDVSNKEQLANILENIQTTTPVPPSPQPPLSPSPPLPVPPSPQPPLKGIIHAAGVLDDGVLLQMNWERFNKVMAPKVQGAWNLHNLTRDKPLDFFILFSSAASLLGSPGQGNHVAANTFLDSLAHYRRSQGLPALSINWGVWSDIGAAAKRQVDAQMKARGIGAIAPQQGLDILEKLFTEESTQVGVVPINWPQFLSSGATSPYFEDFAQTKETKQREASELRQQLTDILPQNRLSFLVNHLQEEVAPILGLKTNPNPQQGFFDLGMDSLMAVEMKNRLETGLSVTLPSTVIFEYPTINALAEYLVEEMFPSQWESTGVKTKINNEETSLSQTLEEDINASQTLEEDSAIAQELEELENLLKNRNND

SEQ ID NO: 30010 - protein, 318 aa, Crocosphaera watsonii WH 8501
MNDLHYLPTFPILTLFPLIYSDTFLNHDTGSFHPERPQRLEAIVNALKTVSWSDRLQWRQPTTLAQRDPLAYIRNSHINEYIQRVEAIATNGGGLLDEDTVISPQSYQVALLAVNAWLDGVDTVTQTQKQAFVLSRPPGHHAVQKTGMGFCLFSNAAIAANYALQCKGAQRVAILDWDVHHGNGTQAIVEDNPNIAYCSLHQFPAYPGTGRASETGKYDNILNIPMTPGSDLKSYQLAFSDQVIPFLAAFKGDLLIVSAGYDANQADPLASINLKPNDYAVFTQQLLTITSSILFGLEGGYDLSALSDSVLATIQACF

SEQ ID NO: 30011 - protein, 3515 aa, Angiococcus disciformis
MTPSGDEALQSSIALVGMAGRFPGAPDVESFWRNLVAGVESISFFSEEELRQAGVSEQIRRRPEYVPAKGVLEDLELFDAGFFGYSPREASHLDPQQRLLLECSWEALEDAGLRPDQLPGWVGVYVGAGDTSYRFQLLRGHGDPLSGSKDVAGFFGNYPDFLATRVAYKLNLRGPALGIHTACSTSLVSINMACSALRGFECDMALAGGVSLRLPARSGYLYEEGGVASKDGHCRPFDARATGTVTGDGVGVVVLKRLEDALKARDPIHAVIRGWALNNDGASRAGFTAPSVEGQSEVIALAHAAAGISARDITYVEAHGTGTPLGDPIEVAALTRAFRAHTADTAFCTLGAVKSNIGHLDAAAGVAGVIKTVQALRHRLIPPTLHFERPNPALHLEQSPFFVNTQPLPWESPRGPRLAGVSSFGIGGTNAHTLFEEAPPPPASGPTRPNQVLLLSARSTSALEHIAGRLAAHLRRHPDLELADVAFTLQVGRARFPYRRALTCRTLAEAMERLEAPEPRPPEPLAHEGERPPLVMLFPGQGTPLVGTARALHESEPTFRQAVEQCARLLRQTLGLDVREVLFPSAEQEEQARRLAAQTRVAQPALFTLEYALAQTWLGWGLQPQALAGHSLGELVAACLAGVFSLEDALQLVAARGQLMQGCPPGAMLAVPLPEAELAALLGSELCIAAVNGPRACVASGPLPAVEALTAALESRGVSSRRLETSHAFHSASMEACQGPLTTLLRRMRLQAPRLPCVSGLTGRWLTGEEATEPTYWARQLREPVRFSEALETLWSLKEPVLLEVGPGTTLTALARRHPTRPARTQEVASLPVQPDTAVPCIEEAVGELWQAGLELDWSALHAAPRHRAHLPPYPFERQRYWIEPEAAPQPRAQQPTPASLVPPEQPSREALEDWFYVPTWEQAPATSGGGQPLAGPVLAFMDSSGLAEQVLAALWPADSGALLTRVEPAGHYEQLSEHAFRLRPESEEDWDALFQALQSQGRLPRRILHAWALTAEPGPCTPDGEAVLEQGFFSLLRLARALGRHAPERPVQLEVLSSFVHAVGPREPLEPLKATLLGACAVLPLEYPHVQCRTIDVRPGSEPREVLVRSLAAELAAPMGESPVAWRDGQRYVRRATRQRLEASRPLRSLRERGVYLVAGGLGGIGLVLARALAQRARARLALLTHSPFPPREQWEQWLEEAPAHPEPAWRSEADPSERRRTQHRIRCLLELEQLGAEVQVYTADVAEEAAVRSVVEQVHARWGKIHGVLHAAATFDDGVIQLRTHEQSSRALRTKVRGSMVLHEVLASEGLDWFALCSSLASALGSFGQADYCAANAFQDAYAHHLRRQGFTGALALDWGTWRDTGAAMRLVARTRRGGHEKPPTPLTHPLFDCEQREPGGTHWLGLTLRGGEDWVVDEHRLQGVPTLPGVAYLELARAACAQALGAEAVELAELLLLEPLTVPRGESRQVRVVLQPEGQAHALRVESRSEEARGWNEHARGRVRAVPRLAERIQPELLRAACEHEQPVPGEPQEQGPVHAGARWHGLFQWVRRGPRQALAQLALPEPFHGDLERFELHPALMDMATSFAIPGGVPWLAFGYERVLIHGPLPPQVLSHVSLPEESQAGAQQLRLQVRLLDLEGWERVRIDGYLLRPLKPSDASVEPAAPNVEVAVGTPGLLESLGLRRCTRPAPGPRQVEIEVEAAGLNFLDVLGALGMMPALEAEESVLGRECSGRIAAVGEGVSGLRVGDEVLAVAPGCFRSYVLVDESQVVRRPASLGLAEGAAQMVPFATAYFALHTVGRLRRGERILIHAAAGGLGLAAVQLASRTGAEILATAGSEQKREYLRSLGIAHVLDSRSTSFVSEVRERTGGRGVDVVLNSLAGELLLAGLSVLAPHGRFLELGKRDLYADQQVGLRTLARGQTFAAIDFGPHHPDFRAVLEEVATQLTQGQLEPLPTRLFPARQVAEAFSFMARALHIGRVAVSMQGATALPASMTRGSRPAPVAVPPWEDPRLAGGISSEEGAEAFLRALEQGAPQLIISPQDFSSLLRGLGGSQGVREKERLVTGRAAAAEPQALPPSSLEQLIEQVWRKHLGVERVQPTDSFFQLGGDSLLGIQVAADLRRHLGVELPTATLFSHPTLAALAAALRARQGEAAAPTAPAPALVPDPAARFEPFPLTDVQEAYWVGRRSAFELGGVAAHGYFEIESPGLEVERFIQCWRQLLQRHDMLRMVVLPDGRQQVLEQVPEYTPEVVELRGLSPQEAESRRLQLRERMAHQVLRSDRWPLFELVLCRYEGGVRIHMSMDALMLDAWSSAVLRQDFAQLYHEPGRPLEPLAITFRDYVLAERRLREGEAHERARAYWWARLDTLPPPPELPLVKEPSQLEHARFTHREARLEPHRWARLQERARAHGLTPSAACMAAFAEVLARWSRHPRFTLNLTLFQRLPLHPQVDELVGDFTSLVLLEVEAHAASTFAERASRLQAQLWRDLEHGSVSAVQLIRELVRTGRRSPGAIMPVVFTSILSLDARRGPQGSLSFFEGELVYSISQTPQVWLDHGVHEEEGALVLAWDSVEALFPPGMVDDMFHAYQRLLGALAEEEQAWEGELPELLPPAQRELLARYNATQAPRPSGRLEEGFFTQARLHPELPALLAPERTLSYGELARRAQALAARLRELEVQPQELVAIAMHKGWEQATAVLGVLQAAAAYLPLDPEQPPLRLHQLLEEGPARVVLTQSSLLHTVPWPPGVQVIAVDELEPATEAPPLPPRGTPEHLAYVIYTSGSTGKPKGVAIEHRAALNTVVDLNTRFGVGPEDRVLGLSALTFDLSVYDVLGLLGAGGALVLPAAEAEKDPAHWWERLVAGRVTVWNSTPALMLLLVEYAEQRGLKLPAALRLVMLSGDWIPVALPDRIRALGRDVQVVSLGGATEASIWSIAYPIGQVAPQWKSIPYGMPLANQRFHVLDGRLEARPWWVPGELYIGGEGLAREYWRDEPLTATRFIRHPRTGERLYRTGDQGRMLPEGSIEFLGREDLQVKVQGFRVELGEIEAALAQHPALSASVVVARGEPRGVRRLVAYAVPRSGQTPAAGELRRYLAERLPAYMVPSAFVLLESLPRSRNGKIARDQLPEPQQTQGLAAQAAAADPLVERLAALVKEALRLERVEPQDSLLDLGADSVALIRLINRLEAELQFRPRLADIYENPTVQGLATLHQEKTKSQGEGGAPRLTAPRSTLLPAEEWGRFKANRPGLRRFPDGTPEVALPGSGLAPAPEELTALERRRSVRTYSLEPVSHEQLGRLLAPLREWEVQGSRRYLYASAGGLYPVQLYLHLKPGRARGLEPGTWYYDPSTHRLVLLSAGAGLDRRIHDPHQNQAIFDSAAFSLFLIARMGAVEPVYAEHALHFATLEAGLMTQLLDLGAAPSGLGLCHIGDLDFAQARGLFHLEEEHVLLHSLVGGVLPTRGQEAASVPAEGGTEARQLAQLLQQVKTLTPEAARALLEARRGSKGRPHE

SEQ ID NO: 30012 - protein, 2837 aa, Angiococcus disciformis
MSHDTQLEGAVAVVAMAGRFPQAPTLEDYWRIIHEGVDAFTQLTDEQLLASGVGPSLLRQPGYVRRAALLDRMDQFDAAFFGFSPREAEVLDPQHRLFLECAHEALERAGHGSERARGRVGVFASASLNSYYLHSLHGNARLREVLGDFQLAIANDKDFLPTRVSYKLGLRGPSVAVQTACSSSLVAVHLACQSLLNGECALALAGGSSLSVPQAQGYLYQEGGIASPDGYCRPFDAAAAGTNRGNGVGVVLLKLLEEALADGDTIHAVIRGSAVNNDGAHKIGYTAPSVEGQASVISEALEVAAVSADSIGYVEAHGTATALGDPIEVQALTRAFRKHTERRGYCALGSVKANIGHLDAAAGIASLIKAVLVLERRQLPPCPHFTSPNPRIDFERSPFYVSGRGQPWEPVDGPRRAGVSSFGIGGTNVHVVLEEAPPRPAPRRAARPYQLLPLSARTERAREEVEARLREHLRQQPQEPLEEVAHTLQVGRRHMAWRTALVSSSPAQAVELLERRRPEALLRGQSAAQARSVAFLLPGQGSQYVGMGAALHESEAPFREQVDLCAGKLQGVLGLDVRRLLYPGPREREWAQERLRETRVCQPVLFTVEYALARLLEAWGIRPTALLGHSLGEYVAACLAGVFSLEEALEVVAARGQLMGSMPPGGMLAVGLPAQEVEPLLPAALALAAHNSPQACVVAGPTEPLAELRARLEQRGIACTPLAVSHAFHSPMMEPAVAPFVARLRRMHLRPPSLPFISNVTGTWIEAEEATSPEYWGRHLLQPVRFAQGLERLCEGVQPRLLLEVGPGHTLGRLAARQSSGPVQVVSTLGSSREESSEVERLLTAIGRLWVEGAEVDWAGLHRGERRRRAVLPTYPFEHQRYWVETAPQPSPPERPGTPAESPVTSSFYVPGWSRAALPSAAPSRRVGRLLLLAEAHGWSQGLAERLRARGHSVTLVEPGERLERLTPEHWRLPPGRREDFQRLLEDSGELPSRVLHLWLLGSSQSPQERGFYTLLALAQALGAHGTRPAVELTVVTDQLYAVAEGEPIQPLKALLQGPASVLPQELPGCTCRLVDMALPPGGVAEELLERLVAEVESTASERSVAYRGAARWVREFVPVPLPPPEPSQLPLRQRGVYLIVGGLGGVGLALAEHLARRVSARLVLTGRSPTPPRESWSAWLGTPTRLRLSQELEWLRGAAEQIEHQRPLHSLADSPGLEESLRLLCASYLYHFLFPLQAPLRLGEPRAMQALRERLGLQPGFERLFSFMIGTLEQAKLIRVGEGMLEGQVEPAHVPTPRALHERLLEGYPEVSGLLELLEHCVRHYPEVLRGSLPALSVLYPSGRSEEDSARSGVEWSSMGQCVALLRHFLARHAERTQGRTLRILEVGGGSGVVLQALLPLLRHHPVEYHFTDIGPSFVRAMEGVGRRQGLTFLHTSVLDISRPPPEQGHPPGSYDLVIALNVVHATPRVPQSLAHLESLLVPGGHLCLVETVKQQPWVDMIWGLAEGWWSYEDELRTRSPLLEVGDWEHALRDVGFAEVEVLPAAVEQRSRWDNVLLIAQRPGESGLQPVGGRAAMQERIRRLRAIEEAGGEVLPLVADVTDRERMGEVLAEVKRRHGALHGVIHAALVLEDGLMQLKTRESAGRVLASKVEGTLVLDELLRDEPLDFFVLCSSLSALLGALGQADYAAASAFLDAYAHSQRGRTDRRTISMDWDRWLEVGAAMRLGLGLAAGALGLQRTAPGEYTVRWQAERCWWLDEHRLEGRATLPGVAYLELVRAALVQELGEAPVELEQLVLLSLLEAPAGEEVEVRFHLRPEDEGYALEIRSRAGGLANGGWRSHAMGRVRMLPRGSARPTHPLRELEERLGLTQAPREHEPAQGPRELAPALGRRWSSLSWHRAWKGEEGLALIELPEELAEDLRQWPLHPALLDAATGFAPLPPGAWLPLSYGNTRIHGPLPRQLYSHIRRLEPASAQAGVVRLEVRLMDGEGRELLCVEEFVLRRVEVDSLARPQPAGKAPRQAVLPRPGALDSLRLQPLERLPPQEGEVEVQVLAAGLNFKDALLALGALPVELANGAPLALGVECAGIISAVGPGVRGLRVGEAVVAAAAGAFASHVRVPQEQVFPKPAGLSFEQAAMVPVTLFTAWYALEELARLRAGEHVLIHAAATGVGLAGVKLALRRGATVYATAGSEPKRELLRSLGVTLAMDSRAPGFDDQLLQHTQGRGVDVVLNSLSGEFLSRSLGVLARHGRFVELGVRDMLSGGTLPLAPFERGLTFLAAQIDPGMKGYRELMGEALRQIERGELEPLPYTAWPLERVAEALQLVSKGRHVGKVVLTPEEPLSRPPALPSSSRPVQPRAGVAIVGLRSAEGCEAFERILAAGLPQVAVSTRELRARMAEIERLRVSSWEPALPSVPRGSPARTERSKPYVAPRTERERALAALWQDLLGVSEVGLDDDFFELKGDSLLAIQLMGRLRKELEVELPLSSFLARPTLRTLLSAMPAPATDEPASATGAIPAAAPQPSPAVSSEPARKWRHLVPIQPQGESPPFFWAAPLMGTVFPYFTLARCLAPTHPFYALQPPGLQEGQEPMDKVEELAALYVRELRELQPRGPYRLGGWSFGCVVAYEVALQLEAAGEQVALLSLLDFPAPSGQRASLWATARFFSGSVLRGLAPYTLDYLYLAARAPLNPDAASRLSSSLTRGWERLRKGGLVQELLDHAAMARVVPEDSRLLLLREPGIAPMLRLTRAHQRAMLSYRPRGRLRQRIVLFRTSEQAWSFARDLGWGALSASGVDVREAPGDHMTLLRPPHVERVAEQLRALLSSAPLPTRR

SEQ ID NO: 30013 - protein, 177 aa, Plantago major
MASSMLSTSSTAVAGRAQATMVAPYAGLKSTSVFPATRKTGNAKLARNAGKVRCMQVWPPLGKKKYETLSYLPDLTVEQLAKEIDYLLRSKWIPCLEFELEHGFVYRENNRSPGYYDGRYWTMWKLPMFGCTDASQVIAELEECKKEYPNAWVRIIGFDNVRQVQCISFIAAKPPGL

SEQ ID NO: 30014 - protein, 145 aa, Plantago major
MAKVLVSDEARKEFFALRRAFDDVNTQLQTKFSQEPVPIDWEYYRKGLGSRLVDMYKQAHDEIKIPKYVDNVTPEYTVKFDALSVEMQQAEQESLEVTKRLEKEIADVEELKNKVSTMTADEYFAKHPEVKEKFDEEIRNDYWGY

SEQ ID NO: 30015 - protein, 174 aa, Plantago major
MASAMMSSAATVTAQTSMVGQFSGLKFGSTFPIAKKTGRVSSPSSGLKVRCMQVWPPTGKKKYETLSYLPDLTVEQLAKEIDYLLRSKWIPCLEFELEHGFVYRENARSPGYYDGRYWTMWKLPMFGCTDASQVIAELEECKKEYPNAWVRIIGFDNVRQVQCISFIASKPPGL

SEQ ID NO: 30016 - protein, 258 aa, Plantago major
VIFHTFCEDIASQLPAVVVSVEYRLAPENRLPIAYDDALNAILWAKDQALGKGGRDPWMEYADFTKVFILGSSAGANIAYHVALRALDFDISPLQIKGVMMNQGYFGGVARTASEIRLKDDAYVPLYVNDVLWTLALPTNLNRDHEFCNPISGGTYLGRIYRLPKIYIKGDYGDPLVDRSVQLAQYLINNGRTVFYRFNAGGFHGIELQNTTAAQELYDDFKYFVNNPFIMNENGISKEPLSYDMKEIMSGGVSRASA

SEQ ID NO: 30017 - protein, 195 aa, Plantago major
VTTIFYLLCGCMGYAAFGDQAPGNLLTGFGFFDPYWLLDIANIAIVVHLVGAYQVYCQPLFAFIEKWSVRKWSRSDFVTAEYDIPIPLCGVYQLNLFRLVWRTIYVVFTTLIAMLLPFFNDVVGILGALGFWPLTVYFPVEMYIAQNKVRKWTSQWIGLQLLSIACLLVSVAAAVGSIAGVILDLRTFKPFKTVY

SEQ ID NO: 30018 - protein, 193 aa, Plantago major
VFYMLCGCMGYAAFGDLAPGNLLTGFGFYNPFWLLDIANAAIVIHLVGAYQVYCQPLFAFIEKYANAKWPDREFITNDIEIPIPGLQEPYRLNFFRLVWRTAFVILTTVISMLLPFFNDVVGILGAFGFWPLTVYFPVEMYIAQKKIPKWSTKWICLQMLSMACLVISIAAAAGSVAGVILDLKVYKPFKTSY

SEQ ID NO: 30019 - protein, 234 aa, Plantago major
SIKSYVAEFIATLLFVFAGVGSAIAYNKLTSDASLDPAGLVAIAIAHAFALFVGVSMAANISGGHLNPAVTLGLAVGGNITIITGLFYWIAQCLGSIVACFLLSFVTNGLAVPTHGVSAGQTALQGVVMEIIITFALVYTVYATAADPKKGSLGTIAPMAIGFIVGANILAAGPFSGGSMNPARSFGPAVAAGDFSQNWIYWVGPLIGGGLAGLVYGDVYIASYAALPASEDYA

SEQ ID NO: 30020 - protein, 282 aa, Plantago major
EDVNLGANKYSERQPIGTAAQTHDDKDYKEPPPAPLFEPGELSSWSFYRAGIAEFVATFLFLYITVLTVMGVSKSDSKCATVGIQGIAWAFGGMIFALVYCTAGISGGHINPAVTFGLFLARKLSLTRAVFYMIMQCLGAICGAGVVKGFGQTLYMTKGGGANVVAHGYTKGDGLGAEIIGTFVLVYTVFSATDAKRSARDSHVPILAPLPIGFAVFLVHLATIPITGTGINPARSLGAAIIYNRDHAWDDHWIFWVGPFIGAALAALYHVVVIRAIPFKNK

SEQ ID NO: 30021 - protein, 285 aa, Oryza sativa (japonica cultivar-group)
MNAFLELEPFSTPLFEIPDDADFEYTSMLAADDFLLMDGDFLADQPPVSVEVVAGGGDASGKRSFHADDGEAMGVVSRSSKRRKKAPRNSSSLSNCDGSGGEGSEPTAERPGGRRVWVRERSTEWWDRMRDPVACPEADFRRAFRMPRAVFDKLCDDLAAAVTKEDTTLRTAIPVPQRVTVCIWRLATGDPLREVSRRFGLGISTCHNIIVQVCAAITTVLLTRVVRWPDSHAASASMFEALSGIPGVVGTVYTKHFPLVEKPFVVPVGNPPLVPVVQPRLRIRD

SEQ ID NO: 30022 - protein, 256 aa, Oryza sativa (japonica cultivar-group)
MPVTLFNRGSLVPVFVATETIVELVRPTKDGFSTSVRIVVPREHAGEYYDHRLTDRNNKATYSVAMQAVVDDEGAFTDVCIGHPGSLSDAAVLAKSALYARCEAGLLLGHDKLGWQQPLWLVGGASYPLTSWMLVPYTQPNQTWAQDRLNAHVADARAAAVGAFRRLRARWQCLRRAEVKLPELANMLAVCCVLHNLCERIGEELDANLLHDELEVVDDGVVAGGGNTVRSAAAEEVRDHRIAHVRSSSRRQCFFE

SEQ ID NO: 30023 - protein, 468 aa, Oryza sativa (japonica cultivar-group)
MSSSFLGPFTDFDYSSVLAAGDFFAGHHPDQPPSPAEVVVAVGGGDASGKRSFQADDDDAMGVVSRLSKRTRKAPSSSSSPSHSDGGGGGGGEGNEPAAERGGGRRVWVRERSTEWWDRMRDPAACPEAEFRRAFRMPRAVFDKLCDDLAAAVAKEDTTLRAAIPVPQRVAVCLWRLATGDPLREVSRRFGLGISTCHSIILQVCAAITAVLTRVVRWPDSHAAAASRFQALSGIPGVVGAVHTEHIPIVAPRENAGEYYDRRLTDRNNKATYSVAMQAVVDADGAFTDVCIGHPGSLSDAAVLTKSALYARCEAGLLLGDDPQWLVGGASYPLTSWMLVPYAQPNLTWAQERLNARVADARAAAVGAFRRLRARWRCLRRRAEVKLPELPNMLGACCVLHNLCERSGGELDADLLHDELVDDGVVAGGGNTVRSAAAEQVRDRIAHGLLHAGNTASSSYQDYHYGRL

SEQ ID NO: 30024 - protein, 424 aa, Oryza sativa (japonica cultivar-group)
MSSGGGGGDDYKREESVALMVIVSLAALSLLSLVAAFAYYCYITRKVSRRLHSLDLPKHHRRSSSSSPPPMPPPLPPPPPSANAPTLGKESPSSNSASDGAAAAVVVGGERGAVQVFSYRQLHAATGGFGRAHVVGQGSFGAVYRGVLPDGRKVAVKLMDRPGKQGEEEFEMEVELLSRLRSPYLLGLIGHCSEGGHRLLVYEFMANGGLQEHLYPNGGSCGGISKLDWPTRMRIALEAAKGLEYLHERVNPPVIHRDFKSSNILLDKDFRARVSDFGLAKLGSDRAGGHVSTRVLGTQGYVAPEYALTGHLTTKSDVYSYGVVLLELLTGRVPVDMKRPPGEGVLVNWALPMLTDREKVVQILDPALEGQYSLKDAVQVAAIAAMCVQQEADYRPLMADVVQSLVPLVKNRSTPKTCNPSVQA

SEQ ID NO: 30025 - protein, 429 aa, Oryza sativa (japonica cultivar-group)
MAAALARRGGGGLARALARGRGMCSATAAERAAGAALTSEELMRMERERSAHNYHPIPVVFSKGEGSHILDPEGNKYIDFLSAYSAVNQGHCHPKVLRALKEQAERLTLSSRAFYNDKFPIFAEYLTSMFGYEMMLPMNTGAEGVETAIKLVRKWGYEKKKIPKNEALIVSCCGCFHGRTLGVISMSCDNDATRGFGPLVPGHLKVDFGDTDGLEKIFKDHGERICGFLFEPIQGEAGVIIPPDGYLKAVRDLCSRHNILMIADEIQTGIARTGKMLACDWENIRPDVVILGKALGAGVVPVSAVLADKDIMLCIKPGEHGSTFGGNPLASAVAVASLKVVTDEGLVERAAKLGQEFRDQLQKVQQRFPQIIREVRGRGLLNAVDLSNEALSPASAYDICIKLKERGVLAKPTHDTIIRLAPPLSISQS

SEQ ID NO: 30026 - protein, 387 aa, Methylobacillus flagellatus KT
MNTYARQPVTFTRGEGVWLWDTEGKRYLDALAGIAVNGLGHAHPRLVSAISEQAGRLIHVSNVYGIDEQARLAERLCEVSGMDKVFVCNSGCEANEAAIKLARLYGHGKGVESPEIIVMERAFHGRTLATLSATGNRKAQAGFEPLVSGFIRVPFDDLDAVRQVARHNKNVVAILLEPIQGEGGINLPRDSAAYLTGLREICDANGWLLMLDEVQSGMARTGTWFAFQHTDVKPDVMTLAKGLGSGVPIGACLAHGPAAEIFTYGKHGSTFGGNPLACSAALATLDIIESEGLLAHAEKLGNDIREAFTVSLQGVAGVTVIRNAGLMIGIELDRPCAELVGQALEAGLLINVTAEKVIRLLPPLIMSEQEAQQVVDILTPLIKKLLA

SEQ ID NO: 30027 - protein, 393 aa, Methylobacillus flagellatus KT
MTVINMTDLDLAGKRVFIRADLNVPVSDGKVTSDARITASIPTIRHALDAKARVMVTSHLGRPEEGVYSEENSLQPVADVLADKLGQPVRLIKDWVDGGFEVAEGEVVLLENCRFNKGEKKNAEETARKYAALCDVFVMDAFGTAHRAEASTYGVAQYAPVAAAGLLLVGELDALGKALCEPARPMVAIVGGSKVSTKLTVLESLAEKVDQLVVGGGIANTFLKAAGKPIGRSLSEDDLVPTAQCLMEKMAKRGAAVPIAVDVVCGKQFDANEPAVLKSAEDVADDDMIFDIGPESAKQLAEIILNAGTVVWNGPVGVFEFDQFGEGTKTIADAIAKTKAFTLAGGGDTIAAIQKYDIYDKVSYISTAGGAFLEFLEGKKLPAVEILEQRAKG

SEQ ID NO: 30028 - protein, 1134 aa, Methylobacillus flagellatus KT
MNKRQLQGKLKAEKDLRFNDDPLWYKDAVIYQVHVKSFFDANNDGIGDFAGLIRKLDYIVELGVNTIWLLPFYPSPRRDDGYDIAEYKGVHPDYGTLFDVKRFIVEAHKRKLRVITELIINHTSDQHPWFQRARRAKPGSAARNFYVWSDTDTAYSQTRIIFTDTEKSNWTWDPVAGAYYWHRFFSHQPDLNFDNPRVFKAIISIMRFWLDLGVDGLRLDAVPYLIEREGTSNENLPETHEILKRIRSEIDQNYPDRMLLAEANMWPEDVQEYFGDGSNECHMAFHFPLMPRMYLALAQEDRFPISDILRQTPEIPPTCQWAIFLRNHDELTLEMVTDKERAYMLNFYATESRARLNVGIRRRLAPLLQRDRRRLELLNSLLLSMPGTPVIYYGDEIGMGDNIHLGDRDGVRTPMQWSPDRNGGFSHADPARLVLPPIMDTQYGYHAINVEAQSSDPHSLLNWMRRLLAIRKQYHAFGRGSMRLLYPNNRKILSYLRTHIPGGESADEEQIILCVANISSTAQAVELDLAEFSGYDPMEMMGGSVFPRIGQQPYVLTLGAYDFYWFRLTKNRQPLNGAGEQDGSLPEYLTLVLNQQLTSLFAPQLRRTMEQDILPAYLPCQRWYAGKQKDTLAAIQLTLLGVLDAIDPAEPPFLLAQVETSTATGADQYFLPMGVVSDEQEMPALVRRLALANVRRGPRVGALTDAFALDGFVRAVLHHLRSDSTLDSEQGSIHFNSTASLHQVDFKTELEIRRTDQEQSNSSLIINDLAVMKLLRRVQPGINPELEVARHLAKVGYANTPPLLGDVTFIDADGMPHTQVIMQAFVHNQGNAWQWTLDRLNRLLHDNLSADLMKQALAVDDASPLKELTNFAAMLGQRLAELHIALTKDTDNPSFSPEIFSAAQVETWRDKLHEQADDVLALLDRGPWSGDADAQHASAICSRREQLFQAIDELVQHVVGQPRIRIHSDFHLGQVLMISGDVMIIDFEGEPARSLEQRRQKDHPFRDVAGLLRSFSYAAAHVEKSDMGKPAGEHAERRQGLLRDYEGCSKRAFMQAYFAHSHLPPTSQAPDSAPVLAEELPAGDQAILNLCLLEKVIYEIAYEAANRPAWIGIPMRGLLGLLDEMRADGNPEQP

SEQ ID NO: 30029 - protein, 151 aa, Methylobacillus flagellatus KT
MFWGKRIREHSWQFPQGGIKYGESPEQAMYRELMEEVGLRPEHVKILGRTRDWLRYDVPTNWIKREWRGSYRGQKQIWFLLRLIGRDSDVSLRASTHPEFDAWRWSDYWVAMDSVIEFKRDVYRMALKELSMHLTEHRRPRVAERVDQLVR

SEQ ID NO: 30030 - protein, 352 aa, Methylobacillus flagellatus KT
MTKAISYAAHDPKSPLAPFSFERRQVGANDVQIEILFCGVCHSDLHQARNEWGNSIFPVVPGHEIVGRVTQVGSNVKKFKVGDLAGVGCMVDSCNACPDCAEGLEQYCNHAVFTYNSPDKHMPGQVTYGGYSNLIVVDERFTLKISDKLDLAATAPLLCAGITTYSPLRHWNVGPGQKVGIVGLGGLGHMGVKFAKALGAHTVLFTTSPSKVEDAKRLGADEVIISKDPEQMQQHLQSFDFILNTVAAPHDLDQFMALLKRDGSMCLVGVPDSPHPSPSVANLIFKRRKLAGSLIGGIKETQEMLDFCAEHNITSDIELIPIQEINNAFERMLKSDVKYRFVIDIASLRQAA

SEQ ID NO: 30031 - protein, 426 aa, Methylobacillus flagellatus KT
MAWNTLVESVVEAAPSQNRYAALAQSSGLQKLADVEAADVPRHPTGIHEFDRVLGGGLVPGGVVLIGGDPGIGKSTLLLQTLCHIGGMRKAVYVSGEESAQQIAMRAKRLGLDAGPVELLAEISLEKILAILQQHKPEVAVIDSIQTLYSEALQSAPGSVAQVRECSAQLTRFAKQTGVTMILVGHVTKEGSLAGPRVLEHIVDTVLYFEGGQNSSFRLVRAFKNRFGAVNELGVFAMTEKGLREVSNPSALFLSHHAEQVAGSCITVTQEGSRPLLVEVQALVDEAHAPNPKRLCVGLEQNRLAMLLAVLHRHAGVACFDQDVFINAVGGVRISEPAVDLAVLLAIVSSLKNKPLNNKLIVFGEVGLAGEVRPVQRGQERLREAAKLGFTHAIVPKANLPKQVIDGLDVKGVERLDQALQLLRNG

SEQ ID NO: 30032 - protein, 441 aa, Methylobacillus flagellatus KT
MAAAKKFLADNHVKYVLAQFVDIHGVAKVKSVPAAHLESILKDGAGFAGGAIWGMGILPNGPDYMAVGDLSTLSLLPWQPGYARIICDGHVDQKPYEYDSRVVLKKQVERLSAQGWTLYTGLEPEFSLLRRDEKGALHPCDETDTLQKPCYDYKGMTRQAVFLERLTEALIAAGLDVYQIDHEDANGQFEINYTYADCLKSADDYILFKMAASHIANELGMTCSFMPKPFGNRPGNGMHMHMSIGDGNKSLFHDDSDSTGHGLSPLAYHFLGGILHHAPALTALAAPTVNSYKRLVVSQSLTGSTWAPAYISYGNNNRSTMVRIPYGRLELRLPDGSCNPYLTTAAVIAAGLDGVKRELHPGPGHSTNLFDLSLAEMKEQGIGILPQNLNESLDQLEANQVLRDALGNALTEEFIKLKRAEWVDYQRHVSDWEINRYIEFF

SEQ ID NO: 30033 - protein, 1383 aa, Methylobacillus flagellatus KT
MATQVKSVCPYCGVGCGIVMEVEHARIIKVMGDKQHPSNYGRLCTKGSTCAQAVTASGRLEHAYLRTERNAEPARIGMDKAIKESARRLRAILDEHGPDAVALYVSGQMSIESQYLANKLIKGYIGSNNIESNSRLCMASAGSGYKLSLGADGPPGSYQDFDNTDLFFVIGANMADCHPILFLRMMDRVKAGARLIVVDPRRNATADKAHLFMQIKPGTDMALLNGLLHLLHKNGHTDPDFIARFTEGWEAMPEFLEDYSPEAVSEITGIPEADIRQAAEWIGKASNWMSCWTMGLNQSTHGTWHTNAICNLHLATGAICRPGSGPFSLTGQPNAMGGREMGYMGPGLPGQRSVLSAQDRAFIENLWGVPAGTLHTSSAGGTIAMFEQMAAGKIKACWIICTNPVASVANRQNVIAGLERAELVITQDAYLDTETNRYADILLPGALWAEAEGVMINSERNMTLTQQAVPPPGDAMPDWQIIASIACEMGYAEAFSYASAAEVFEEIKRTSNPKTGYDIRGVSHDRLRATPVQWPCPPDDPQDRHPIRYLNDGISQQLKIREDGERPRIAFATESGKGVFFARPWLPPAEMPDHDFPFVLNTGRLQHQWHTLTKTGKIPTLNKLNPGPFVELHPEDAASLGIRDKDQVEIRSRRGRAVLPAVITARVLPGHCFAPFHWNDVFGDDLAINAITSDAVDPLSQQPEFKFSAVALARVEGTPQRMRNAAPEGHHKDEETHTDNAREIAMKDIDALAQLLGLKDTPAIKLEPAEQLYLQGYLAGLRSDASRQAGGVPILPPTAPLPPDKKTLVDGILAGLFSRTWIGAGSLPTQGHEDTATQPVVHILWASQTGNAETFASQCAAKLQAEGWQTVLSSMDEVQPAELANASRALLLASTFGDGDPPDNGSQFWAALQSDHLTLSGLQYAVLAFGDSNYDQFCGFGRKLDARLAALGATALTARTDCEPDYETAAQVWLGQVVSALASRKSPHPSTTTDRQPELILAGDMPADMTCPGTTAPSYTRHHPLHAQLVVNQRLSGNGAEKEVRQFAFDLGGSDFQYEAGDALGVWPRNDPALVGEMLTALQFSPATVVDVHEHGEMTLVEALSNHYEIARITPEMLQFIAARSGSADLADRIGKQGELKPWLWGKQPVDLLHAYPIKVEVSEWLGVLKRLQPRLYSISSSPKTVTDQVHLTVSIVRYGERGGVCSTFLADRAKGLPVPIFLQKSPHFRVPRNPETPLIMVGPGTGIAPFRAFLQERQAAGASGKNWLFFGEQHVDTDFYYRDELAAMQQAGILHRLDTAFSRDQQEKIYVQHRMLEHGAELWRWLEQGAHFCVCGDAARMSRDVDAALKQVVQTHGNMSAEAAAQYVAKMAQDKRYVRDVY

SEQ ID NO: 30034 - protein, 403 aa, Methylobacillus flagellatus KT
MQKSFWQAGHKPTLFSAFLYFDLSFMVWVLLGPLAVQMAADLALTPAQKGMMVATPVLTGALLRLVMGVLVDQIQPKKAGLIGQLIVLAALAFAWLHGVHSYQQALLLGVFLGFAGASFAVALPLASRWYPPEHQGTALGIAGAGNSGTALAALFAPGLALAFGWHNVFGLALIPLGIALVVYMVFAKDAPNPPAGKSLSQYLAVLKDKDAWWFMFFYSVTFGGFVGMASSLTIYFNDQYGLDPVHAGYFTAACVFAGSFVRPIGGNLADRIGGIRTLSAMYILAAVFLFILSVGLGQQLAGLAIVVLAMISLGMGNGAVFQLVPQRFRKEIGVMTGLIGMAGGIGGFYLASSLGYSKQVTGSYQLGLAVFASLAVVALFGLTLVKKRWRTTWGSAAVTSARV

SEQ ID NO: 30035 - protein, 341 aa, Methylobacillus flagellatus KT
MATNGLANDWHRAHYASLARGGSGLVIVEATAVAPEGRITPHCLGLWNDAQAEQLRSIAAAIKAAGAVPGIQIAHAGRKASANVPWEGDDHIPEGDARGWQPIAPSAKAFGGLLPRVPTEMTIADIQRVQQNFVDAARRALEAGFEWLELHFAHGYLAQSFTSTHSNLRTDAYGGTLENRGRFTRETLAAVRQTWPEHLPLTARFGVLEFDGQDEQTLSESIQLVNEWKQLGLDMLSVSIGFSTPEAKIPWGPAFLAPIAQRVRNEAGIPVSSAWGFGAPDLADQAIRNEQLDIAMIGRAHLENPHWTYQAAKELNKKDPAWVLPPPYAHWLARYHDPRQR

SEQ ID NO: 30036 - protein, 342 aa, Methylobacillus flagellatus KT
MQPATTRIPMRIVFFSTQVYDRESFLALPRLQNAEFIFQQPKLTLDTAVLATGAEVVCAFINDDLSAPVLERLAANGTKLIALRSAGYNHIDLEAAQRLNLAVVRVPAYSPHAIAEHTVALILALNRHLTRAYNRTREGDFSLRGLTGFDLVHKTVGIIGTGQIGAAFARIMAGFGCRILAYDPYPNPEVIALGASYLELDTLLAQSHIVSLHCPLSPATHHLINAGSLSRMQPGSMLINTSRGALVDTPAVIEALKSGHLGYLGLDVYEEEADLFFEDLSDFPLQDDVLARLLTFPNVIITAHQAFLTREALNAIASTTLDNISAWAAGHPQNLVRLETGS

SEQ ID NO: 30037 - protein, 229 aa, Methylobacillus flagellatus KT
MNRYGAEFLGTFWLVLGGCGSAVLAAAFPEVGIGLHGVSLAFGLTVLTMAFAIGHISGCHLNPAVSIGLWAGGRFAGSQLLPYIVAQVLGAIAAGGVLYLIASGQAGFDVTAGFASNGYGEHSPGGYTMTAALVAEVVLTAFFLFIIMGATDQRAPAGFAPIAIGLTLTLIHLISIPVTNTSVNPARSTGVAVYAGGWAVDQLWLFWIAPIVGGVIGAWVYRAVAGSKA

SEQ ID NO: 30038 - protein, 439 aa, Methylobacillus flagellatus KT
MGTFPITPDFVMRLGYAAGRVLTRMDHHLVPGTKPLVIIGKDTRISGYMFETALVSGLCAGGVNVRITGPLPTPAIAHVTRAQRAQAGIVISASHNPFDDNGIKFFSAQGTKLPDEVELAIEAELDQPMELVPTEQIGRVKRIDDAAGRYIEFCKSTFPNALDLRGLKIVLDCANGATYHVAPPVFHELGAEVISIGTQPNGLNINLNVGSTHPESLQQAVVEHQADLGIAFDGDGDRVVMADNQGQLLDGDQLLYIIASHRHQRGRLGGGVVGTLMTNLALEHALGKEGIPFQRAKVGDRYVLELLNANEWQLGGENSGHILCLDKHSSGDGIIAALQVLHALRASGLSLADWAKRLPLYPQVLINVKVAQRIDLDSNTALQAAVTSAEGALKGTGRVLLRASGTEPKIRVMVEGQDRPLVQRLAEEIAAVVQQEAAS

SEQ ID NO: 30039 - protein, 410 aa, Methylobacillus flagellatus KT
MTQQLSLPKDKIRFLLLEGVHQNAVEVLNAAGYRNIDYRKTALDEDALIEAIKDVHFLGIRSRTQVTAKVLDAANKLTAIGCFCIGTNQVDLDGALERGIPVFNAPYSNTRSVAELVLAQTILLLRGIPEKNALVHRGGWTKSAEGSFEARGKTLGIVGYGSIGSQLSVLAESLGMKVIYFDVIAKLPLGNARQVGTMEELLSQADVVSLHVPELPSTKNMMRAEQFAQMKKGSIFINAARGTCVDIDALARAIESKHLAGAAIDVFPVEPKSNDEEFQSPLRAFDNVILTPHIGGSTQEAQANIGIEVGEKFVRYSDAGSTITAVNFPEVSIPKQPGTHRLLHIHRNVPGVLSAVNSLFARNNINIAAQSMMTKGDIGYMIMDVEASASSAAIEALQTVEGTLRTRVLY

SEQ ID NO: 30040 - protein, 270 aa, Methylobacillus flagellatus KT
MNELHVSRENFIIPGPEGTIPVRLYRRAQAGGDVPLVLYFHGGGFNAGCLDDADFPAGFIAYHCPAVVLSVGYALAPQHPFPAAPEDAYAATRWAARNTCRLNVTAKLLVVAGDDAGGSIAAGLSMMARDRGEFSIAAQVLIAPMLDPSMTLLGDAAGLKSELTAAQCAQRYRQYLPKCTQRMHPYAAPLESLRLAGLPAAMIATAECDVLHIEAEKYANVLIQAGVPTQVSRFSGVQHAELLAHQPMLREVVEFLRRQAMHAGLPIDSG

SEQ ID NO: 30041 - protein, 358 aa, Methylobacillus flagellatus KT
MPADLFSPTKLGSIALKNRIVMAPLTRNRAGKGNVPQPINAEYYAQRASAGLIITEATPISPTAHGYPATPGIHEPEQVEGWKLVTKAVHDKGGKIVLQLWHVGRISHPSLQPGNALPVAPSAIKPAGQAFTYEGLQDFVTPRALAIEELPGIVADYAQATRNALEAGFDGVEIHAANGYLLDQFLRDSTNRRTDEYGGSIENRTRLLLEVTQAVVDVAGADRVGVRISPLNPFNDISDSNPQALFNHVADSLSPFGLAYLHVVEGGMGGGDIPPFDFSALRRHFKGGYIANLGYDKAKGNAAIASGHADAVAYGSLYIANPDLVERFQQDAPLNTPDQATFYGGDAKGYTDYPTLQG

SEQ ID NO: 30042 - protein, 440 aa, Methylobacillus flagellatus KT
MKDKGIKYCIGAYVDIHGVPKAKVVPIDHLPQMAAGSERYTGYALDGLGQAPSDDELTSIPDLDHIIQLPWEPKVAWMPADNGFQGQPYALNTRVALKNVLAQAAAMGFGMNLGIECEIYLLKQEADGKLAIPNPDDKLVKPCYDVRGFMDNFGWLDKMATAINSLGWDLYSFDHEDGNSQFEFDFNYSDVLTMCDRFTFFRYMAKHYAKEEGLLATMMPKPFADKTGTGAHFNMSLYDLDTGKNLFACDPKDDPRGLGLTPLGYHFIAGILKHGAALCAVFAPTVNSYKRLVRRGAMSYFSWAPVFNSYGSNNRTNSVRVPQGGGRCESRNADGAVNPYLAAALVLAAGLEGIREKLDPGAPNEDNLYAINDEEREKRGIHFLPQTLQEAVACFAADGLMEKTLGKELRDEFITYKSQEWDAYHLSISQWEVERYSYMF

SEQ ID NO: 30043 - protein, 295 aa, Methylobacillus flagellatus KT
MYKTLDDFVGNTPLVKLQRMAGKTSNTILLKLEGNNPAGSVKDRPALSMIKRAEARGDIKPGDTLIEATSGNTGIALAMVAAMRGYKMVLVMPDNQSVERRQSMKAYGAELVLTPRDGGMELARDVATKLQAEGEGIVLDQFANQDNPLAHYEGTGPEIWRDTAGKITHFVSSMGTTGTIMGTSRYLKEQNRDIRIVGVQPEEGAQIPGIRKWPEEYLPKIYDAKRIDELVYVNQENAEKTTRRLAQEEGIFAGISSGGALYAALQLSKRVENAVIVTIVCDRGDRYLSTGVFPS

SEQ ID NO: 30044 - protein, 427 aa, Methylobacillus flagellatus KT
MSAIVDIIAREIIDSRGNPTVEVDVLLESGVIGRAAVPSGASTGTKEAVELRDGDAARYLGKGVLQAVENVNTEITEAIIGLDVEEQSFIDQTLIDLDGTENKSRLGANAILAVSMACARAAAEESGLPLYRYLGGSGFMQLPTPMMNIINGGAHAENSVDMQEFMIIPAGLPTFREALRAGAEVFHALKKILHSEGLATTVGDEGGFAPDLPSNEAAIQYILQAITAAGYEPGRDILLGLDCASSEFYKDGLYHLESEGLQLTSAQFADYLATWVDKYPIVSIEDGMSEHDWDGWKLLTDRIGKKVQLVGDDLFVTNAKILREGIQKGVGNSVLIKVNQIGTLTETFTTIETAKRAGYTAVISHRSGETEDTTIADISVATNALQIKTGSLSRSERIAKYNQLLRIEEELGDATSYAGKEAFYNLK

SEQ ID NO: 30045 - protein, 487 aa, Methylobacillus flagellatus KT
MKPLYDLAQLREIEQRHAAEGLMEKAGLAAASMARKLLQEHEYSVLVLAGPGNNGGDALVAARHLRAAWYQVTVVFVGDSTRLPADAAAAYEAWIAAGGELLNEIPPHGRWQLVIDGLFGIGLSRELDARYCELIRQVNALGLPVLALDIPSGLCMSTGRVLGAAVKASHTLSFIGLKPGLFTLDGPDHAGEVHLETLGLAQANTIATGMLVDQPPALPLPRTRNSHKGSHGSVGVIGGAEHMTGAAILAARAALLLGAGRVYCGLLAHQPWVLDTAQAELMLHDAATVPALSSVLAVGPGMGTSSAAMAVLHEVLGQSQSLVLDADALNLVAAHHSLQQALKGRPLASTVLTPHPGEAARLLGCRNDEVQADRIASALKLARTYQAAVVLKGCGSIIALPDGRWFVNRSGNPGMASAGMGDTLCGIIAALLAQSMGMEQALLLGVYLHGAAADALVERGIGPIGLTAGEVAWAARDLLNAWVYAKT

SEQ ID NO: 30046 - protein, 476 aa, Methylobacillus flagellatus KT
MDGEYFDNISPVTGKVFCQVPRSNEKDINLALDAAHAAKEAWARTSGTGRANILLKIADVMEANLETIAIAETIDNGKPIRETMAADIPLAIDHFRYFASCIRTQEGGISEIDHETVAYHFHEPLGVVGQIIPWNFPILMAAWKLAPALAAGNCIVMKPAEQTPASILVVMELIGDLLPPGVLNVVNGHGVEAGKALATSPRIAKIAFTGSTSVGRLIMQYASQNLIPVTLELGGKSPNIFFEDVMDKDDAYFDKALEGFTLFALNQGEICTCPSRALIQESIYEQFIERAIKRVKAIKQGSPLDKSTMIGAQASSEQVEIIMSYIKLGLEEGAQLLTGGNATKLPGDLSEGYYIEPTVFKGHNKMRIFQEEIFGPVLSVTTFKDEKEALEIANDTMYGLGAGLWTRDGSRAYRVGRGIQAGRVWTNCYHLYPAHAAFGGYKQSGIGRENHRMMLDHYQQTKNLLVSYSPNALGFF

SEQ ID NO: 30047 - protein, 232 aa, Methylobacillus flagellatus KT
MAKPFRIAPSILSANFAKLGQEITDVITSGADIVHFDVMDNHYVPNLTIGPLVCEAIRPVTDAIIDVHLMVKPVDRIIPDFAKAGANIITFHPEASDHIDRSLSLIRDNGCKSGLVFNPATPLSYLDYVMDKIDMVLLMSVNPGFGGQKFIPGTLDKLREARARIDAYTEKTGREIWLEIDGGVNPSNIAEIARAGADTFVAGSAVFGAGKDTDPNRYDTVIGALRAELAKV

SEQ ID NO: 30048 - protein, 452 aa, Methylobacillus flagellatus KT
MKAGTQKTLTHSDLVEQGVRFLLASYVDLHGVPKAKAVPISHFDRMMNGSEMFTGAALDGVPQEISDEEVAAHPDMGSAIVLPWSKDIAWLPSDLYTQGEPFNACSRTILKKVRQQAAELGMAMQLGIEAEFFVLKDQEAGGFSPISTRHHLKKPAYDVARLLDNKPWLSELVEAMDSLDWGVYSFDHEDGIGQFEIDFSYFEVLRMADNFTFLRMMANEIARKHGGFASFMPKPYGDRAGSGAHFNISLTDINTGLNLFEPEQDDPRGCGLSTLGYQFIAGVLRHLPAICAVVAPTVNSYKRLVKQGSMSGFTWAPVFCCYGNNNRTNTIRIPLGGKRIEIRAVDSACNPYLGAAMILAAGLEGIRENLDPGDPHLDNMYEKTPEELASLGIRELPKTLEEAIDAFEADPLSRQVFGDQMFSAWTQYKREEWLSYITHVSDWEYDRYLKLF

SEQ ID NO: 30049 - protein, 503 aa, Methylobacillus flagellatus KT
MSTNTADIGLIGLAVMGQNLALNIADHGYTISVYNRDPEKTRKFIAHCKENEPSADNLKGFEDLATFVLSIKRPRKIVLLVKAGSATDVTINALVPFLEEGDIIIDGGNALWTDTIRREKELRAKGLEFIGSGVSGGETGARFGPSLMPSGTRKAWFHLEPIWRDIAAKVDPRTGKPIEGAAPGKPVQGGFSCAEYIGPDGAGHYVKMVHNGIEYIDMQLICEAYWLMKNLLGMRADEIGQVFEEWNKGELSSFLIEITGDILQQKDPAGDGFLVDKILDAAGQKGTGQWTAANALELGSPANAIAAAVFARALSTLKAERVEASTILKGPTVKLESDREQLIEAIRNALYCSKICAYAQGFQLMDKAQVAYNWKLNFGEIAQIWRGGCIIRARFLQKITDAYALDSRLKNLMLDPYFTEALDEGQASWREVVTLAVRNGIPAQAFCAALSYYDGYRSASLPANLLQAQRDYFGAHTYERTDQPRGEFFHTDWPEPGRPQFKV

SEQ ID NO: 30050 - protein, 266 aa, Ralstonia eutropha JMP134
MMTDAAGADSNRGASVMVAARDIVKAFGPLQVLRGVSLTLRKGDVTAVIGPSGSGKSTLLRCLNHLEVIDSGTVEIEGEALASMGVDGVAKYVPDAEVRRICRKMGMVFQSFNLFPHMTVLQNIIEAPMTVKGLSRDAVLPKAEELLRKVDLLAKRDSYPARLSGGQKQRVAIARALAMEPDIMLFDEPTSALDPELTGEVLRTMRQLADEHMTMLVVTHEMGFAREVANHVVFMDEGRILEEGPPERVFGAPVHARTREFLAHTL

SEQ ID NO: 30051 - protein, 135 aa, Ralstonia eutropha JMP134
MAKKWLNKVKWDDNGLVPVIVQEVGTNDVLMFAFMNRDALQKTAELGEAVFWSRSRKRLWHKGEESGHVQKVHEMRLDCDEDVVLLKVTQVDNIACHTGRHSCFFQKFEGDAESGDWQTVEPVLKDPSQIYTAKP

SEQ ID NO: 30052 - protein, 273 aa, Ralstonia eutropha JMP134
MTEPAHNLVELNAVDFAYSPDATPILTGLTMQFPRGKVIAVMGGSGCGKTTVLRLIGGQVRPQAGMVTFGGADIHKLDVTGLYAVRRQMGMLFQFGALFTDLSVFDNVAFPLREHTDLPESMIRDLVLMKLNAVGLRGARNLMPSQISGGMARRVALARAIALDPSLLMYDEPFAGLDPISLGLTARLIRSLNDALGATTIIVSHDVHETFQIADYVYFIANGRIAAQGEPEALRASTDPFVRQFVHAEADGPVPFHYPGPSLVEDFAGGGAQ

SEQ ID NO: 30053 - protein, 487 aa, Ralstonia eutropha JMP134
MGKATGFLEFPRQNEGYEAVVKRVKHYKEFVFALSDSEAKIQGARCMDCGIPFCNNGCPVNNIIPDFNDLVYRQDWKSAIEVLHQTNNFPEFTGRICPAPCEAACTLGINELPVGIKSIEHAIIDKAWEEGWVAPQPPKHKTGKTVAVVGSGPAGMAAAQQLARAGHDVTVFEKNDRIGGLLRYGIPDFKMEKTLIDRRIEQMQAEGVTFRAGVMVTDGALPAGIKNYARETISAKDLMDQFDAVVLAGGSEVPRDLPVPGRDLDGIHFALEFLIPQNKEVAGDGENEIRAEGKNVIVIGGGDTGSDCVGTSNRHGATSVNQFELLPQPPEEEDKPLVWPYWPIKLRTSSSHEEGCDRDWSVATKEFIGENGKVTALKACRVEWKDGKMQEVPGSEFILPADLVLLAMGFTNPVGSMLDAFGVDTDARKNAKAATEGERAYHTNVPKVFAAGDVRRGQSLVVWAIREGRQAARSVDAFLMGHTELPR

SEQ ID NO: 30054 - protein, 396 aa, Ralstonia eutropha JMP134
MAKEKFERTKPHVNVGTIGHVDHGKTTLTAAIATVLAAKFGGAAKKYDEIDAAPEEKARGITINTAHVEYETANRHYAHVDCPGHADYVKNMITGAAQMDGAILVCSAADGPMPQTREHILLARQVGVPYIIVFLNKCDMVDDAELLELVEMEVRELLSKYEFPGDDTPIIKGSAKLALEGDKGELGEVAIMNLADALDTYIPTPERAVDGTFLMPVEDVFSISGRGTVVTGRIERGVIKVGEEIEIVGIRPTVKTTCTGVEMFRKLLDQGQAGDNVGLLLRGTKREDVERGQVLCKPGSIKPHTHFTGEVYILSKDEGGRHTPFFNNYRPQFYFRTTDVTGSIELPADKEMVMPGDNVSITVKLIAPIAMEEGLRFAIREGGRTVGAGVVAKILD

SEQ ID NO: 30055 - protein, 308 aa, Ralstonia eutropha JMP134
MSRPLPRYVVFGEALTDMVLQADGNWLGLPGGSCWNVARVGARLGIDTAFAGAVSQDLFGDTLARATEEAGLDMRFLQRVERSPFLAFVASRHPPQYFFVGDDSADLHFEPSRLPQGWREAAEVIHFGSISLVRQPLAGRLCEEATQAAAAGKRIAFDPNYRSLMSAPGYGETLAHMLRLASYVKISDEDLAGLFPALPLDAALAQVRAIAPNATIMLTRGADGLTLLQSDIVVEQPAFRVEVADTVGCGDAAMGGWMASVLSEPRADLAGQARLAAAAAAVAASHAGAYAPLWRELEGLAAMPRGSA

SEQ ID NO: 30056 - protein, 433 aa, Ralstonia eutropha JMP134
MEAPQSAGAAAFAPVRIGPLTLRNRFIKAGANEGMTPEGLPTQALVKHHADLAAGGVGMTTVAYAAVADDGLTFAHQLSMRAEQVPHLRVLTDAVHREGAAACLQITHAGSFTTMRHGGSRAPGSASTGLNAFGMMHGVYFQRAMSQADMSRRAAQFAQAARLAREAGFDAVEIHMGHGYLLNQFLSPLSNRRRDMFGGSVENRTRFPAMVLRQVKDAVGAEMAVCCKLSVTDGVPGGNDAADSAITARILEAEGADLLTLSGGRNVESPWALFGSPMPTAQMKAAAPNAMARFGITMLEKRTPRDLTFRELYFLEASRVVRQAVQMPLAYIGGVKSLQNVDALLGEGFDCIALARALIHDPALVEHWRNGVAARSACDSCNGCVAKIYDPAGVCCVHGPANDPALTGIPAALKPIQVLKSVKAHTEPSLMGR

SEQ ID NO: 30057 - protein, 503 aa, Ralstonia eutropha JMP134
MEQSKAGTLIGAFAEFFPGATEIGSYVGGRLVAGTGQEIQLFDPATGEKSLSYRDAGPEIAQQACIAARDAQKTWWGLTHAARGRILYAVAAKVREHNEPLAVLESMSQGKPIRDSRREVEMVAEMFEFYAGWADKFYGHVIPVPTTHLNYTRREPYGTILHIAPWNIPILSFGWQVAPTVAVGNAVLLKPSELTPFTSLAVASLAEQAGVPVGLINVLAGYGHTTAQAAIADDVVKKVVFVGSPATGIRIAEAAAKRVIPCILELGGKSANIVFDDANLDLAAIGAQAAVFSGAGQSCTAGSRLLIQRKVYEQVVDKVAEGARKLRLGHPLEASTEIGPINNRNQYEHIKRMIARGVEEGAQLAAGTTSFGDGGYFVPPTLFAGVSNQMDIARMEVFGPVISAIPFETEEEAIAIANDNEFGLAGAVWTNDVARAHRVAAQVDAGTFWINGYRAIHVGSPFGGYKNSGYGRTSGIEALYEYTQTKSVWVQTASASVTAIGRA

SEQ ID NO: 30058 - protein, 487 aa, Ralstonia eutropha JMP134
MSPSPTLYRNYVDGRFVESAKGFPNISPVNGAVIGTVCEAGADLVDRAVRAARAALAGPWGRTTPAERARVLQAVADGIEKRFDAFVAAEVADTGRPEHQARTLDIRRGVQNFRTFAELAGQAGGECFEMRAADGDVFSYTVRKPHGVVAIISPWNLPMLLMTWKVAPALACGNAVVIKPSEETPGSATLLAEVMHEAGVPPGVFNLVHGFGGGSAGEFLSRHPDIDAITFTGESRTGSTIMKAVADGVKEVSFELGGKNAAVVFADCDFDQAVAGVTRSSFTNTGQVCLCSERVYVERPIFERFVAAMKARAEAMRIGYPDEDGVEMGSLISHGHRDKVLSYFALAREEGATVVAGGGVPQFGDARDNGAYVQPTIWTGLPDSARCVQEEVFGPVCHIAPFDSDDEVVARVNDSRYGLAASVWTRDLGRAHRVTRQFDVGIVWVNTWFLRDLRTPFGGTRLSGIGREGGRHSLDFYSSTTTICVNP

SEQ ID NO: 30059 - protein, 311 aa, Ralstonia eutropha JMP134
MALDEQARYILDMIASAGRPPLHTCTPEQARQSFDFRPLAGVPDAVAQIEEVTIPGPAGDIRVRIYTPDGEGPFPALVYCHGGGWVVGDLDTVDVPCRRLATRASCVVVSVDYRLAPEHRFPAATEDAYAAFQWLVSNARAQQVDATRIAVGGDSAGGNLAAAVALMARDRAAPQPCFQVLLYPVTDGTLDTPSYRENAEGYLLTRDSMVWFWNHYVGDADRTHPYASPLRADHHRGLPPAFVVTAEFDPLRDEGEAYARRLAEAGTPVECKRYDGTIHGFCWMPGVLDKGRQALDDTAAALAAAFQSDNR

SEQ ID NO: 30060 - protein, 405 aa, Ralstonia eutropha JMP134
MGGYGNAAAANGGTAVANLTNSFNHSKAVAVSKLNGYVTSNSIAPVGNYASNSGNAQASGGTGGNGYGGTGGNGSGAVGGAGGAGGAGGAGGTATNGSATNGSATNYGAQAGDGGNGGRAVGWAGDGGNGRATGGGALSAAGTRGGSGGDASGRGGGALSASLGAGGGGGGAFSRGGSALGASAGFGGLAGSAGGATSANGAGNDSAGAGGAGGAATASGTAGAGSGTGGAATAGGGAGGAGTSTAGAATGGAGSGTGGAGGAGGTATATATTGATTGTGGAGGTQASVGGTGGAGGSATNGSATSSASNGSSTAGNGAVGAAGGAGGAGGAGAGGTGGVGNGAVGGAGGSGGYNAVSAGSFAMSNVMTSVGQTAAGIMIATQNNGAASLVQHSVNVQANLNVGH

SEQ ID NO: 30061 - protein, 453 aa, Ralstonia eutropha JMP134
MSIPEPASTPPGGPAAGQPAPSLLERLFGLSEHQTDVRTEVLAGMTTFLTMAYIIFVNPSILGDAGMPKDAVFVATCVAAAIGTLIMGFYANYPIAMAPGMGLNAYFAYTVVKGMGFAWQAALGAVFISGCLFLLVTLFRVREMIVNGIPHSIRVAITAGIGLFLAIVALKNAGIVTASPATLVTIGDLHQPSAVLAIVGFFVIVSLDQLKVKGAILIGILLTTVLSFFFAGNTFHGVLSAPPSISPTLFKLDISAALSIGIVNVVLVFFLVELFDATGTLMGVANRAGLLKAGRMDRLNKALMADSTAIMAGSFLGTSSTTAYIESASGVQAGGRTGLTAVTVAVLFLACLFIAPLAGTVPAYATAPALLYVSCLMLRELLDIDWNDVTEVVPAVLTALGMPFTYSVANGVAFGFISYAVLKLMTGRARNVPVMVWIIAAVFVFKFYYLPGH

SEQ ID NO: 30062 - protein, 291 aa, Ralstonia eutropha JMP134
MRVAFLGLGVMGFHMAGHLAAKGHEVTVYNRTAAKAQAWVEKFGGKAADTPAQAVRQADVVCSCVGNDDDLRSVLTGPDGAFFAAPTGCIFVDHTTASANVARELYAAARERGLHFVDGPVSGGEVGAEKGILTIMCGGDADVYARVEPVIAAYARAVTRIGEAGAGQLAKMVNQISIAGLIQGLSEAIAFGERAGLDMKLVLDVISKGAAGSWQLENRGPTMIENKFDFGFAVDWMRKDLGLCLDEARRNGASLPVTATVDQFYADLQQMGCGRSDTSSLIKRLRRFSQN

SEQ ID NO: 30063 - protein, 456 aa, Ralstonia eutropha JMP134
MRQIDVYAVADGATFNRFHAGVLFWCALIIIFDGYDLAVAGIALPAIMKDMGVSATHAGFMVSSALFGMMFGAIFLGTIADRIGRRKAIAICILLFSVFTAAAGMTSDPMLFAASRFLAGLGIGGVMPNVVAQMTEYSPRRIRGTLVTLMFSGYSVGGMLAALLGKQLLEQYGWQSVFLAAGAPALLVPLILSKLPDSMPFLLRTGQNDTVRKILRAIDPANPCKDGDRLVLPDASTGGQAAVGELFREGRGFSTLMFWLAFFMCLFMVYALSSWLTKLMASAGYSLGSALTFVLVLNIGGMLGAIGGGWLADRFSIKYVLMGMYALAAVSIALLGYKVPTPVLFLLVGLAGASTIGTQIVTYAYAGQFYPVAARSTGIGWASGVGRAGAILAPIVIGVLVGMALPLEQNFLAIAVPAVVAVLAVGGIDHRRAASVGAVPSEQVAPKVYAASRAEG

SEQ ID NO: 30064 - protein, 481 aa, Ralstonia eutropha JMP134
MNVFLNHIDGEWTACQSGRTFDNVNPADTGDIVGRFQASSAVDAQAAVAAAAAAFAGWKKTPVGKRAAVLNRAADHLEANADSIAAELTREEGKALTLARDEVLRSAQTLRFYAVEGQTFTGEVFPNDDPDQLVFSQREPLGVVTVIAPWNFPVSIPARKIAPALVTGNTVVFKPSSEAPLSGYRLAEALIKAGLPKGVLNFITGSAAEIGAAITEAPVVRAISFTGSSRAGEQIHRAVPLTTRTQMELGGKNPLIVMEDADLDRAVDLTIKGGFSLSGQACTGTSRVLVAESVKAAYTERLLAKVATLKVGSGMTAGMDLGPLASQKQMETVLRYIDIGKSEATLLCGGERLTGGEFDKGYYVAPTVFTDVTQQMRIAREEIFGPVIAILGFTDYADAIAKANDTEYGLAAAIVTSNPRYIHHFANDIEAGTVKINRTTTGNLVNAPFGGLKRSSTSTFRESGRTGLEFYTQIKTVYRGA

SEQ ID NO: 30065 - protein, 426 aa, Ralstonia eutropha JMP134
MCFLTIVADGYDLIVYGATLPKLLEEPGWGLTPATAGMIGSWTLAGLMVGMGAAGPLSDRVGRRNLIMAGVLWFSVGSILCALAASPFSLGAARFFTGIGLGGVVPSAVALTVEYAPANRRQLYNALTLTGYSVGGVICALLAMTLLQEHGWRTLYALGALYALILPVMYRWLPESVSFLVERGRMEEARVLAARHSLDLEQMAREQRAQAVHAAATGTRGYRLLATDALRTSALLFGMVSFCVQLIVYGLNAWLPQLMRKAGYPLGSSLQFLLVMQFGAVAGMIGGAWLADRLGSKRVIIPFFAIGGLSLLALSQKLAFGWLMLAVFGAGIGSIGTTTLIYGYIATYFPASCRGSALGASQAFGRFGSILGPLIGGWIVGSNLALHWNFYAFVVPAVVAILLVPLIPKPAQEPDAAPSADYRTAD

SEQ ID NO: 30066 - protein, 476 aa, Ralstonia eutropha JMP134
MQQRDKLFINGKWVSPHGTGLIDVIHSTTEAVMGRIPEGSARDAEDAIQAARAAFDGWAATPPAERAGYIRKIAEGLKARTEELAQLIAGEVGMPIKLARAIQVGGPVYNWGQAAKLLEGFDFEEEVGNSLVVREPVGVVAAITPWNYPLNQITLKVAPALAAGCTVVLKPSEVAPLNAFVLAEVIAEAGLPPGVLNLVTGYGPVVGEVLASHPEVDMVSFTGSTRAGKRVSELASQSVKRVALELGGKSASVILDDADLPAAVKGTINACFLNSGQTCSAHTRMLVPRSRYDEVKAIAAKVVEGFTVGDPLQETTRLGPLISAVQKDRVMGYIRRGLEEGAELVAGGPDAPAGLEKGFFVKPTVLGNVEPRATVAQEEIFGPVLSIICYNTEEDAVRIANDSIYGLGGGVWAGDEARAVRVARRIRTGQVDINGGPFNMSAPFGGYKQSGNGREAGKYGLEEFLEYKSLQFKKPA

SEQ ID NO: 30067 - protein, 487 aa, Ralstonia eutropha JMP134
MRLVQKALTFDDVLLVPAYSAVLPRDVSLRTRLTRSIDLNIPLVSAAMDTVTEARLAIAMAQAGGIGIVHKNFKPADQAREVARVKRYESGVLRDPITISPDMKVREVIALSQQHGISGFPVLEGKTVVGIITNRDLRFEEELDAPVRAKMTPREKLVTVAEGAPLEEAKRLMNRHRLERVLVVNAAFELRGLITVKDIQKAVENPLASKDDHGQLRVGAAVGVGPDNDERVELLVKAGVDVIVVDTAHGHSQGVLDRVRWVKQNFPQVQVVGGNIATGDAARALVEHGADGVKVGIGPGSICTTRIVAGVGVPQITAVSNVAEALKGTGVPLIADGGVRYSGDVAKALAAGAHTVMMGGMFSGTEEAPGEVFLYQGRSFKSYRGMGSVGAMKDGAADRYFQEDNTANVDKLVPEGIEGRVPYKGSVMAIIHQLTGGVRASMGYCGSKSIADWHESAQFVQITAAGMRESHVHDVQITKEAPNYHID

SEQ ID NO: 30068 - protein, 470 aa, Ralstonia eutropha JMP134
MYINGEFVTPLGREWFDLHNPSTEEIIGQVRLGDEKDAQRAIAAAQAAFPAWSRTTREERIAALRRIHRAVAAREEELLEAIVTEYGAPSVRSRWMAEYPAQTVAQAIDALESFEFEERAGAARVVMTPVGVAGLITPWNSNAGFICNKLATALAAGCTAVIKPSEMSAMQTQIVAEALHEAGLPPGVFNIVNGRGDVVGEEIVRNPGIAKISFTGSSAVGKRLASAGAATMKRVTLELGGKSPTVVLDDADFADIMPLVLQAGFLNSGQACIAGTRILVPRHRLAEFEQIARGAVSHVKSGDPRKADTDIGPMVSARQWERVQNYIRIGMEEGAALLAGGAGRPDGFHKGWFVKPTLFTNASNQMRIAREEIFGPVLTIIPYTDDADAVAIANDTTYGLSAMVLGKDIERCERIARQIDAGRVLVNTLAHEPRAPFGGFKHSGLGREMGKWGISAYLEPKTLMMASTQA

SEQ ID NO: 30069 - protein, 454 aa, Ralstonia eutropha JMP134
MAKTKTVYTCTECGGTTPRWAGQCPHCQQWNTLVETVAEGSTAGKRFQPLAASATVRKLSEIDAADVPRFSSGIDEFDRVLGGGLVAGGVVLIGGDPGIGKSTLLLQALANLAGQRRVLYVSGEESGAQIALRAQRLGVESPTLGLLAEIQLEKIQATLEAEKPEVAVIDSIQTLYSEVLTSAPGSVAQVRECAAQLTRIAKSSGITIILVGHVTKEGNLAGPRVLEHIVDTVLYFEGDTHSSHRLIRAFKNRFGAVNELGVFAMTERGLRGISNPSALFLSQHEEMVPGSCVLVTQEGTRPLLVEVQALVDTANVPNPRRLAVGLEQNRLAMLLAVLHRHAGIACFDQDVFLNAVGGVKITEPAADLAVLLSIHSSMRNKPLPRGLVVFGEVGLAGEIRPSPRGQERLKEAAKLGFTQAVIPKANAPKQKIDGLEVIAVERIEQAIDRVRHLD

SEQ ID NO: 30070 - protein, 165 aa, Ralstonia eutropha JMP134
MKHVTTDLCDANEPRLADGTLRVMAPVFRAFGKQQAFAGPAATLKIFEDNSLVREALESPGQGRVLVVDGGGSLRCALVGGNLGLLAEKNGWVGIIVNGCVRDTGELDVCDIGIRALAAHPQKSQKRGAGERDVAVQMPGAVVRPGNWIYVDADGVLVSEEKLGA

SEQ ID NO: 30071 - protein, 474 aa, Ralstonia eutropha JMP134
MSKQFDVLVIGAGPGGYIAAIRAGQLGLNVACCEGNAYDDPKNEPRLGGTCLNVGCIPSKALLASSEEFENAQHHLADHGITVGDVKVDVSKMLKRKDDIVGKMTKGIEFLFRKNKVTLLKGYGKFVGKTAEGFQVEVAGEVVTAKQVIIATGSKARHLPGITVDNDLVSDNEGALKFPAVPKKLGVIGAGVIGLELGSVWRRLGAEVTVLEALPAFLGAADEGVAKEAQKQLTKQGLKFSLGVKVDEVTTGKSGVTVKYTDKDGAAQTLEVDRLIVSVGRVPNTDNLGLEAVGLAADQRGFIEVDDHCATKVPGLWAIGDVVRGPMLAHKAEDEGVAVAERIAGQKPHIDYNCIPWVIYTFPEIAWVGKTEAQLKAEGREFKAGQFPFMANGRALGMGHPEGFVKMLADAKTDEILGVHIVAANASDLIAEAVVAMEFKAASEDIGRVCHPHPSMSEVMREAALAVDKRQLNM

SEQ ID NO: 30072 - protein, 463 aa, Ralstonia eutropha JMP134
MKLVKENDVKFVDFRFTDTKGKEQHVSVPTSHFDDDKFESGHAFDGSSIAGWKGIEASDMLLMPDSNTAFIDPFYEEPTLVLTCDVVEPSDGKGYDRDPRSIAKRAEAYLKSTGLGDTAFFGPEPEFFIFDGVTWNVDMQGCFVKVHSEEAPWSSGKEFEHGNSGHRPGKKGGYFPVAPIDTFQDMRSEMCLILESLGIPVEVHHHEVAGQGQNEIGTRFSTLVQRADWTQLQKYVIQNVAHTYGKTATFMPKPIVGDNGSGMHVHQSVWKDGQNLFAGNGYAGLSEFALYYIGGIIKHARALNAITNPGTNSYKRLVPGFEAPVKLAYSARNRSASIRIPYVANPKGRRIETRFPDPLMNPYLGFSALLMAGLDGVMNKIHPGEAADKNLYDLPPEEDAKIPTVCNSLDQSLEYLDNDREFLTRGGVFSNSMLDAYIELKMEEVTRFRMTTHPVEFEMYYSL

SEQ ID NO: 30073 - protein, 503 aa, Ralstonia eutropha JMP134
MRDRTLVISVLIVASCGLGYELIAGALSSYLLGDSILQFSSIIGCYLFAMGVGSWLSRYVKDEDVLARFIDIEILVGLLGGISAALLFVVFAWLSAPFRTALYALVFLTGVLVGMEIPLVMRILNARRAAFSDLVSRVLTFDYLGALAVSLVFPLVLAPRLGLSRTGFLFGMLNAAVALYTTRLFRDELPQVPLRTMRALVVIALLGAGFAGSDRLTHWAERGLFGDEIIHSESTPYQRLVITRWKDDLRLYINGNLQFSSRDEHRYHEALVHPVMQALPWARRVLVIGGGDGLALREILRHRNIEHVTLVDLDPAMTTLFSQSAPLRALNRDSLRDARVTVFNADAAQWMEQNAEVFDAIIVDLPDPSNFGLGKLYSVPMYRLLSRHLAEKGYAVVQSTSPYYAPRSFWGIDATLHEAGLHTWPYHAYVPSFGEWGFILAGKRSDYTPPTRYDMPMKFLDADSTALMFRFPPDMAPRAGHANRLNEQSLVHDFEQDWGNVIR

SEQ ID NO: 30074 - protein, 1322 aa, Ralstonia eutropha JMP134
MATTTLGVKLDDASRDRLKRVAQSIDRTPHWLIKQAIFTYLEQIERGHLPHEAMAGGAGEADGADGAEMSHADGAPQPFLEFAQSIQPQSVLRAAITSAYRRPETDCVPVLLEQARLPQQQAEAAIKMAKKLATALREQKVGTGREGLVQGLIQEFSLSSQEGVALMCLAEALLRIPDKPTRDALIRDKISGANWQSHLGQSPSLFVNAATWGLLLTGKLVATHTESGLSKALTRIIGKGGEPLIRKGVDMAMRLMGEQFVTGETISEALANARKYEAQGFRYSYDMLGEAAMTEEDAQRYLASYEQAIHAIGQASRGRGIYEGPGISIKLSALHPRYSRAQHERVINELYERLKSLTLLARQYDIGINIDAEEADRLEISLDLLERLCFEPELAGWNGIGFVVQGYQKRCPFVIDYLIDLARRSRHRLMIRLVKGAYWDSEIKRAQVEGLEGYPVYTRKVYTDVSYVACARKLLSVPDAIYPQFATHNAHTLSAIYQIAGHSYYPGQYEFQCLHGMGEPLYDQVVGPIADGKFNRPCRIYAPVGTHETLLAYLVRRLLENGANTSFVNRIADDTISLDELVADPVAVVETMHRDEGTLGLPHPKIPSPRGLYGKSRANSAGIDLANEHRLASLSSALLAGTSERVVADPMLGTEVPRAADAITTPVLNPADHRDVVGQVTEASQADVDAALQAAANAAPIWQATPPDVRASALERAADLMEAQMQSLMGIIMREAGKTFSNAIAEVREAVDFLRYYAAEVRRSFDNETHRPLGPVVCISPWNFPLAIFTGQVAAALAAGNTVLAKPAEQTPLIAAAAVRILREAGVPAGAVQLLPGRGETVGAALVGDARVKGVMFTGSTEVARILQRNIAGRLDAAGRPIPLIAETGGQNAMIVDSSALAEQVVGDVVNSAFDSAGQRCSALRVLCLQEDVADRVLAMLKGAMNELTMANPDRLSTDVGPVIDEEARGNIVRHIDAMRAKGRRVHQADPNAPQGASCRHGTFVPPTLIELDSIDELKREVFGPVLHVVRFPRAALDTMIGQINGTNYGLTMGIHTRIDETIAQIVQHAEVGNLYVNRNIVGAVVGVQPFGGEALSGTGPKAGGPLYLHRLLSVCPQDAVVRSVRHAEASGNPPAAPERPVAAQALKDWAKTEMPEVAAACDRFAEASAAGISVTLRGPTGERNTYSLLPRHHVLCLAAQEQDLAIQLAAVLAVGSQAVMAENPVSRGLFARLPKGVQSRVRIVSDWTSPEPAFDAVIHHGDSDQLRTVCEQVAARPGPIIGVQGLAQGEPNIALERLLIERSLSVNTAAAGGNASLMTIG

SEQ ID NO: 30075 - protein, 318 aa, Ralstonia eutropha JMP134
MAIDPQLLAYYRRLAEQYGALPVPVDARARRERFAEVAASSVVPDPAGTTWEDLTLALEGRSLTARLFRPVADAPSRLIVYFHGGGWVVGSHETHHTVAALLAADTGCAVASVDYRLAPEYAFPAPCDDAVDAVRWFAVQRASLGFDTGFLAVAGDSAGGHLAALAAQQVNTEARQQVVVAQLLVYPVTAPVLSSESYRAFADGPGLTRDEMAWFWTQFIGAESLARGAQHEDLRIHLMAQAPKVQPPATAIVVAANDVLRDDGLAYADFLVRHDATVVTIEASGMTHGFARLQPDAPRAREWMQRAAQAFASLFDDV

SEQ ID NO: 30076 - protein, 340 aa, Ralstonia eutropha JMP134
MTGNANPAASVATRQLGNHGPTVSAIGLGCMGMSDFYGAHDDAESIRTIHHALDRGITLLDTADIYGPHTNEELVGRAIAGRREQVVLATKFGIVRDLSKPAARGVNGRPEYVRASCEASLKRLGVEHIDLYYQHRVDPEVPIEETVGAMAELVKAGKIRWIGLSEAGAQTLERAHKVHPVTALQSEYSLWTRDVDTDGILATCERLGIGFVPYSPLGRGFLTGAIRSPEDFDADDFRRTNPRFMGENFARNLALVDKVRALADAKGCTPAQLALAWVLARGPQIVPIPGTRRIANLDDNLGALDVRLDAKELADIDAIFPAGAAAGTRYAEHVMPMLAR

SEQ ID NO: 30077 - protein, 278 aa, Ralstonia eutropha JMP134
MNAPTTTSELAQRAEPIIEVRNLVKRYGKAVVHDGVNLDVYRGEVLSIVGGSGSGKTVLVRQIVGLERPTSGSVRIFGEDPTRLKPAQLQALRNRWGLQFQGGALFSALSVIDNIALPLRELRALPDNLICQAALLKLQMVGLSARDADKMPADLSGGMTKRVALARALSLEPELVFLDEPTAGLDPMASDDYVALIRELRRELGLTVVMITHDLDTLVALSDRVAVLADHKVLAAAPIEEVVKVDHPFIREYFLGERAQRAMQALHQARGDAQSGEA

SEQ ID NO: 30078 - protein, 290 aa, Ralstonia eutropha JMP134
MAKEKFERTKPHVNVGTIGHVDHGKTTLTAAIATVLAAKFGGAAKKYDEIDAAPEEKARGITINTAHVEYETANRHYAHVDCPGHADYVKNMITGAAQMDGAILVCSAADGPMPQTREHILLARQVGVPYIIVFLNKCDMVDDAELLELVEMEVRELLSKYEFPGDDTPIIKGSAKLALEGDKGELGEVAIMNLADALDTYIPTPERAVDGTFLMPVEDVFSISGRGTVVTGRIERGVIKVGEEIEIVGIRPTVKTTCTGVEMFRKLLDQGQAGDNVGLLLRGTKREDVE

SEQ ID NO: 30079 - protein, 408 aa, Ralstonia eutropha JMP134
MNENTHLVCAGRHPERFGGVVNTPIFRASTILAGSMAEWEEMKRARAAEEPGATTYGRYGTPTTQALEEAVAGLEGGYRSLVFPSGLAAVSTALTALLSAGDHVLVTDSAYSPTRAFLERVLARFGVEVETYDPVGGTPIEALLRANTRVVYVESPGSETFDIQDIPAIAAAAHRHGAYVVMDNTWGTPLYFKPFAHGVDVSVQAATKYIVGHSDAMLGVVTCNRETWPLIKQTTHDMGQTAGPDDIYLALRGLRTLAVRLQRHWQSGLRVAQWLELQPQVEAVLHPALPSHPGHALWKRDFTGACGLFSVVLRTNSKASLAAFIDALEHFGLGVSWGGYESLVIPFTPGMGRTGHRWPHQGQAVRLHVGLEDTEDLIDDLRRGLLALSACDSEAENEKSGSGEICHS

SEQ ID NO: 30080 - protein, 478 aa, Ralstonia eutropha JMP134
MAASASIVTTAEGAAGFADSRSTSAAGSAGGVTRGNIIARIERMPGNAMHIRARLLIGLATFFDGFDVIAIAATLPLLIAKWSLTPGQIGFLIAAPSVGQLVGALVFPALAERFGRLRSIGWSAGIIGLMSIACGFAPSFEIFAVLRIVQGLGLGGELPVAATYINEVTRAHGRGRFVLLYEVVFPIGLMVSNGVGAWLVPHYGWEVMYFLGGVPLVLFFILRRVVPESPRWLAEKGRMEEADSALRAFEARARTPLPPVGDTSAFDAMTHHPRRRVRDLVSKAYIGRTLAVWMLWATCGFIQYGLSTWLPTVYKTVYHAPLQLALNLAAGASVLGVVGSLVCAMIVDKVGRKPVINVSFLLCALSLVLAGVFHASNVYVVATLCALAMGFLASGFITAYVYTPELYPTSVRAMGCGLGGAWLKLAAIFAPSLIASTIGSGDLSGAFLSLAAVPFLAAITVHFLGIETKGQVLEELEV

SEQ ID NO: 30081 - protein, 491 aa, Ralstonia eutropha JMP134
MKTQEVLPICIAGEWRLGTGDRYATRYPATGEVVAELNAASLADVEEAVQGAQRAFETSGWARRKPHERAAVLYRVAELIRAQAEPLAQRQRLDNGKPISETRALVASAASTFQFFAAACETLEEQITPQRGECLTMSVYEPMGVVAAITPWNSPIASEAQKMAPALAAGNAVVVKPAEVTPLMALELARICDEAGVPKGLISVLPGKGSVIGDAITKHPLVRRVSFTGGTTTGKHIAHIAADKMMPVSLELGGKSPTMVFDDADLDHAVNGVLYGIFSSSGESCIAGSRLFVARSQYEPFIERLAAGAAHLRVGDPADERTQMGPLITDRHRDSIESYVAMGVQDGGQLRTGGLRPDVAGLPNGYFYTPTIIEGLDNHARIAQEEIFGPVLVAIPFDDEDDLIEQANDSVYALAAGIWTRDYKRAWRVARAVQAGNVWINTYKQFSISAPFGGWRDSGLGREKGRLGILQYMEQKSVYWGLNEQPLPWAN

SEQ ID NO: 30082 - protein, 480 aa, Ralstonia eutropha JMP134
MSTPATSNIRHEALRIAGEKVYRDRVIEVTYPYTGEVIATVPKANIEDVRRALRIAHQYRSTLTRYERYRILMRAGEIIAKRKEEIATLITLESGLSLKDTLYEVGRASDVLLFAANQALVDDGQVFSCDLTPHGKSRKVYTLKEPLLGAISAITPFNHPLNQVIHKVAPAVATNNRMVLKPSEKTPLAAFALADILYEAGLPPQMLSVVTGDPREIADELLTSQYVDLVTFTGGVSIGKYIAAKAAYKRQVLELGGNDPIIVMEDADLEEAATLAAGGSYKNSGQRCTAVKRMLVQESVADRFVELLVAKTQEVKYGDPLDPATDMGTVIDEAAAIQFESVVNAAIAGGARLLAGHTRDGALYAPTVLDHVDPEMAVVRHETFGPVSPVIRFKDIDDAIRISNGTAYGLSSSVCTNRLDYITRFIRELQVGTVNVREVPGYRLEMTPFGGIKDSGLGYKEGVLEAMKSFCNTKTYSLPW

SEQ ID NO: 30083 - protein, 453 aa, Ralstonia eutropha JMP134
MSTHYAWAALLAINLMLEYYDNAIFSYAAPTIKAHTGMSTEQIGVISSALYVGMVIGALAGGWLSDRVGRRPVLVWGTVMYSLGVIVTAFVPGYEMILTSRFVTGLGVQAATSVLLVYVAEMFPRHARGRFLSLVTMGYTASAVIAAALAMFYLPTGGPNTWRYLFLAGGIGLLIAPLVYFYLPESVRWCVSRGKLEHAAQIVASLEARALRKGPLDDPNPLAAQGGAANATLRDLLRNKGVLRNLIVLFVSYFGVYLAYYTWINWSIYALVYGLKYPQKDAYFIMFIWVVVYGVMPFIAMRLLDRWERKNTILCMSVFCALALVVLGLSTSYWAVAVIGGALAIFSGFVLNAYYTYIPETMPTQLRALGNGIVMSGARVGGVVSGVMGAALVTAGGLKYVTWTAAAIYIAFAIPVLIFGPRTTNRSLEAVADEELGLGTSCDPTKSAAHAAA

SEQ ID NO: 30084 - protein, 484 aa, Ralstonia eutropha JMP134
MKQFRNFINGEFVATNKTFENRAPVDNRVIGRVHEAGQAEVDAAVAAARAALHGDWGRMPVARRVELLHAVADEINRRFDDFLEAELADTGKPRSLAAHIDIPRGAANFKVFADIVKNAPTESFEMTTPDGGTAISYALRAPLGVVAVVCPWNLPLLLMTWKVGPALACGNTVIVKPSEETPATATLLGEVMEKVGVPKGVYNVLHGFGPGSAGEFLTRHPGVNGITFTGETRTGEAIMAAAAKGVRPVSFELGGKNAGIVFADADFDKAVAGIARSAFENCGQVCLGTERVYVQRPIFDRFVQALKEKAESLRIGPSDAPGVGLGPLISAEHKAKVMSYYDVARSEGATVVTGGGAPSMPPELAEGHWVQPTIWTGLPESARVIREEIFGPCCHIAPFDTEEEAIALANATDYGLATTVWTQDLGTAHRMARAIDVGLCWINSWFLRDLRTAFGGAKASGIGREGGVHSLEFYTELRNVMVKL

SEQ ID NO: 30085 - protein, 429 aa, Ralstonia eutropha JMP134
MALESTHQDLAAARAQHVARGVVTAHPIFVDHAQGSRVWDVNGRSYLDFVGGIGVLNVGHNHPRVVAAVKQQLERVSHAAFQVAGYDVYIELAARLNRLVGGSEAYKTVFLTTGAEAVENAVKIARAYRNAPGIIAFRGGFHGRTLLGMTLTGMSTPYKQNFGPFAGDVYHTPYPDPYRGFSGDDALRALDDLFATQIAPDRVAAIILELVQGDGGFLAAGSDFLKKLRALTTKHGIVLIADEIQTGFGRTGELFAFQEAGIQPDLVTVAKSLAGGLPLSGVVGRAEIMDAPLPGGLGGTYAGNPLACAAALAVLDLFEDEKLTERARELGTTLRGGLLALADKYQEIGTIRGVGPMLALEFVKHGDPHQPDADFAQRVVDACRDEGLLVIKCGVHRNNVRLLAPVNTELDDAHEAIAILGRAIAKVRG

SEQ ID NO: 30086 - protein, 503 aa, Ralstonia eutropha JMP134
MGQRVPAHVRHGLYTQVMSMFSLKDPGLLRQQAYVDGQWRAAESGKTLDVINPANNEPLGTIPACDAADTRAAIEAANRALPAWSALTTHQRAAVLRKWRELMVAHADDLALIMTLEQGKPLAEARGEILYGASFVEWFAEEGIRAYGETIPATHASRRIIARKVPVGVCAAITPWNFPNAMITRKLAPALAAGCAVVVKPSELTPYSALALAELGERAGIPAGVLNIVTGMPQGIGGELTANPIVRKLTFTGSTQVGKLLLRQCADTVKRVSMELGGNAPVIVFDDADLEQAVAGVMASKFRNSGQTCVCANRIYVQAGIYDRFSARLSEEVRKLKVGAGTEDGVSIGPLINDAALRKVVRHVEDAVAHGAKVIVGGASLSRGQQYFEPTVVTGATDGMLIASEETFGPVAALFPFESETEIIRRANDTPYGLAAYLFSTDVNRVFRVSEALEYGMVGANTGVISSAVAPFGGVKESGLGREGSHHGIDEFLEVQTLHLEIV

SEQ ID NO: 30087 - protein, 460 aa, Ralstonia eutropha JMP134
MKHLQRNLGARHIRFLALGSAIGTGLFYGSASAIQLAGPAVILAYILGGAAVYMVMRALGEMAVREPVSGSFGRYASEYLGPLAGFLTGWTYILEMIIVCLADVTAFGIYMGFWFPEVPQWIWVLGIVMLICGLNLCNVKVFGELEFWLALVKILAIGAMIIGGTLILFLGVKMNGEHSPGLTNLWAHGGFLPHGAGGLIASLAVVMFAYGGIEIIGITGGEAKEPEKVIPRAINAVPARILLFYVLTMVVLMAIFPWTGIGGQGSPFVQIFSGLGIKSAAAILNLIVISAAISAINSNIFGAGRMMFGMAEQGQAPRLFAITSRQGVPWVTVLAMAAALLGGVVLNYLIPEQVFVIIASIATFATVWVWLMILLSQVAMRRRLSAEEVRALKFKVPMWPVGPALAIAFMLFVICVLGYVEDTRVALYIGAGWVALLSLAWYLRAKPHEDRILTGESSAL

SEQ ID NO: 30088 - protein, 219 aa, Ralstonia eutropha JMP134
MINKLFDSVEAAVAGIHDGATILIGGFGMAGMPAELIDALIAQGARDLTIVNNNAGNGDTGLAALLKTKRVRKIICSFPRQTDSYVFDSLYHAGEIELELVPQGNLAERIRAAGAGIGGFFTRTAYGTPLAEGKETRIIDGQGYVFEKPIHADFALIKADKADRWGNLTYRKTARNFGPIMAMAAKCPIVQVSHVVELGELDPEHIVTPGLFVKRVVKV

SEQ ID NO: 30089 - protein, 331 aa, Ralstonia eutropha JMP134
MKPSILVTRAIFPDVIDHLAQYFEVDDNQQDVVLDAAALKARLAGKAGVLTNAGDRIDGGVVAALPDLRAVCNMAVGYNNLDIPALTAAGIVATNTPDVLTETTADFGWALLMATARRVTESEHYLRDGRWQRWSYDMLVGMDVYGSTLGILGMGRIGQALARRAAGFGMTVLYHNRSQLPEATERALNARYVSKAELLQQSDHLVLVLPYGPESHHAIGATELTQMKPTATLVNLARGGIVDDEALAHALKTRRIFAAGLDVFEGEPDVHPDLLTVSNVVLTPHIASASEKTRRAMAMLAADNLIAALDAGPNAGHPPSVIDPAVMGHRR

SEQ ID NO: 30090 - protein, 401 aa, Ralstonia eutropha JMP134
MNQPLNPESLGIDTLGVRAGTLRSEYMEHSEAMYLTSSFCFHSAAEAAERFANSEEGFTYSRFTNPTVSMFQSRLAALEGAESCMATASGMSAILSVVMSLMQAGDHLVSSRAIFGSTMTLFGNIFSKFGVETTFVDPGDLNAWRAAVRPTTKLFFLETPSNPLTEVADIAAVADIAHNAGAQLIVDNCFCSPALQQPIKFGADIVVHSATKHIDGQGRVLGGAVVGSHDFIMGKVFPFVRTAGPTLSAFNAWVLLKGMETLAIRMERHSANALALAEFLESHPAVARVFHPALKSHPQHEIAMRQQSGGGAIVSFELKGATPEQQRANAWRVIDNTRLCSITGNLGDTRTTITHPYTTTHARVSPEAKAAAGVGEGLIRLAVGLETVADLKADLLRGLGE

SEQ ID NO: 30091 - protein, 265 aa, Ralstonia eutropha JMP134
MSRIQKTFAALAAQNKKGLIPFITAGDPEPGLTVDLMHALVAGGADVIELGVPFSDPMADGPVIQRASERALANGVSLTQVLQWVREFRQTNADTPVVLMGYANPIERMGEAAFAKAAGAAGVDGVLVVDYPPEECESFAVLMRDNGIDPIFLLAPTSTDARIEAVGKVASGYVYYVSLKGVTGSATLDLDSVAARLPLIKKHVNLPVGVGFGIRDAQTARAIGSVADAVVIGSRLVQLLEDAPRGQAVESLRAFIAGIREALDA

SEQ ID NO: 30092 - protein, 307 aa, Ralstonia eutropha JMP134
MPTGYYTHPEFLLHEMGHFHPECPERLQAIEDHLISHGMDGLLERREAAPATREQIERVHGAAYVDSLERASPASGYYPIDPDTSMNSHTLAAAKLAAGAAVAATDAVMAGEVENAFCCVRPPGHHAEPDRAMGFCFFNNVAVAARHALAAHGLERVAVVDFDVHHGNGTEAAFRGDDRVLMCSFFQHPFYPYSGTEHIATNMANIPLPAYTNGLAVREVVDTIWLPRLNEFRPQMLFISAGFDAHREDDLGQMGLVEQDYAWITGQLVDVARAHANGRIVSCLEGGYNLSALGRSVLAHLKVLLER

SEQ ID NO: 30093 - protein, 300 aa, Ralstonia eutropha JMP134
MAYKTIEDTIGNTPLVRLQRIPGAANDARGNVILGKLEGNNPAGSVKDRPAVSMIARAEARGRIKPGDTLIEATSGNTGIALAMAAAIRGYKMVLIMPEDLSLERRQSMAAYGAEIILTPVKGGMEYARDLADSMERDGKGVILDQFGNPDNPLAHYETTGPEIWRDTEGRITHFVSAMGTTGTITGVSRYLKEQNPAIEIVGAQPAEGSRIPGIRKWPEAYLPKIYDAKYVDRTEPVSQADAEHMARRMASEEGIFSGISAAGALCVALRVAEEVENATIVFVVCDRGDRYLSTGVFPA

SEQ ID NO: 30094 - protein, 382 aa, Ralstonia eutropha JMP134
MTSEDNNTAREETQQSGASPSAAERALGAELAPLREQIDTVDRELLAMLNRRAQLALDVGEVKKKYGAPVFRPERELQVIRKVQAANPGPLLGESVASIWREVMSACRGLEKPLEIAFLGPAGTFSEQALYAHFGHEVSGVPCPSIDEVFRAVEAGTVEYGVVPVENSTEGAVSRTLDLFLQTSLKISGEIALKVHHNLMAASPDMNGVKVVRAHAQALAQCQHWLTANYPHLERQAVSSNAEAARMASEDPTVAAIAGESAANRYHLHIIRPHIQDDPHNRTRFAVIGRYETEPSGSDQTSMILSVPNKAGAVYQLLAPLAENGVSMCRFESRPARSGAWEYYFYVDVEGHQHEPAVARAIETLRRNAAYLKVLGSYPSSK

SEQ ID NO: 30095 - protein, 164 aa, Ralstonia eutropha JMP134
MSNVYQFEAKSLAGQPVPLSQFRGKVLLIVNTASECGFTPQYAGLQALHDAYAARGLEVLGFPCNQFGKQEPGDAQQIGQFCESRFSVKFPMFAKIDVKGPDAHPLYQWLTSAKRGVLGTQAIKWNFTKFLLRRDGTVYKRYGSITKPEEIRADIETLLADPAA

SEQ ID NO: 30096 - protein, 189 aa, Synechococcus elongatus PCC 7942
MLIHTRLYTDVSQYGFFYLIFSFFLVLILQDTSFYFCHRLFHQPWLFRWVHRGHHRSQCPTPWTSFAFDLPEAVMQALLIIGIVFVFPVHVGILLAALVTMTLWSVFNHLGFSLFPDSGVSQWLAQWLIGPQHHLLHHQRYSFHYGLYFTFWDRLLGTQIPASQPQTQRSVRLALLTAAKPLAVRGKER

SEQ ID NO: 30097 - protein, 411 aa, Synechococcus elongatus PCC 7942
MPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 30098 - protein, 227 aa, Synechococcus elongatus PCC 7942
MTQKSVVIAPSILSADFSRLGDDVRAVDQAGADWIHVDVMDGRFVPNITIGPLIVEALRPVTQKPLDVHLMIVEPEKYVPDFAKAGADIISVQAEACPHLHRNLAQIKDLGKQAGVVLNPSTPVETLEYVLELCDLILIMSVNPGFGGQSFIPAVLPKIRKLRAMCDERGLDPWIEVDGGLKANNTWQVLEAGANAIVAGSAVFNAPDYAEAIAAIRNSKRPELVTA

SEQ ID NO: 30099 - protein, 368 aa, Synechococcus elongatus PCC 7942
MSESLKLLTPVQVGRYELRNRIVMAPLTRNRATGPDNIPNDLNVLYYQQRASAGLIITEASQISPQGQGYPLTPGIHSPEQVEGWKPIVQAVHDRGGCIFLQLWHVGRISHPSLQPDGALPVAPSAIQPAGMAATFQGEQPFVTPRALETEEIAGIVEDYRRAAENALAAGFDGVEVHGANGYLIDQFLQDGTNQRSDRYGGSFENRSRFLREVLDAVISVWGSDRVGLRLSPWGQFNDMRDSDPVGLFSYVAQMLNPYNLAYLHWIEPRWDKAEESPEFNQMATPVFRSLYNGPVIAAGGYSRSTAEAAIASGAADLVAFGRLYISNPDLVERFALDAPLNPYDRNTFYGGDEHGYTDYPSLEAASV

SEQ ID NO: 30100 - protein, 497 aa, Synechococcus elongatus PCC 7942
MPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGRPGALPGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSPEEELQGLDIGEHGMEAYSGFAKDASNALSSISE

SEQ ID NO: 30101 - protein, 273 aa, Synechococcus elongatus PCC 7942
MAVFELGMTAISDCFAALRSQGRCALIPFLTAGDPDLETTRQALLALDREGADLIELGVPYSDPLADGPVIQAAATRALQAGTRLDDVLALLKDVRSQIKAPIVLFTYCNPILNRGFEAFLDQIAAAGANGLVVPDLPLEESQRLSEVAAERGIDLILLIAPTSSADRIAAISKQARGFIYLVSVTGVTGMRQGMQSRVADLLQEIRQGTDKPIGVGFGISGAEQARQVRDWGADGVIVGSAFVNRLQEQGVEGVATLCRELRQAIDRQPVLS

SEQ ID NO: 30102 - protein, 320 aa, Synechococcus elongatus PCC 7942
MADRLTNLFPFWLLLIGAIALRWPQIFIGLNQGNLPVLILTLVMLGMGLTLSLDDFQRVSRLPRAVLTGFCAQYLIMPFLGWAIGAALQLPTALAVGLILVGTCPGGTASNLITYIARADVALSVVMTLASTLAAVVMTPLLTQFLAGAYVPVNGWLLFAQTLQVVILPVAIGVALNRWTPRLVRQVLPIAPLLSVVGICLICAATFSANAEAIVQQGRQMLLGVFLLHSLGFALGFGFAKLFGYSQAIARTIAIEVGMQNSGLAIILARQAFPLLPLAAAIGAISGVMHSLVGSFLAVIWRSQAQRQSEAVQPHNSLTM

SEQ ID NO: 30103 - protein, 263 aa, Synechococcus elongatus PCC 7942
MSSRDAEPLVELRNVRKAFGKQMVLDGVDLSIYPGEAIGILGPSGTGKSTILRIISGLILPDSGEVWVAGQQRTAPITEQPNPFPINLVFQQAALFDSLTVGENVGFYLYQHTRLSPAEIEHYVACSLDSVGLPNIAHLMPSELSGGMRKRVSFARAIISTLLEESGGRSLILYDEPTAGLDPIASTVVEDLMRSLKQQQPQASYVVVTHQESTTRRTADRLILLYRGQVCWQGTAAALDETDNIYVRQFLSGRIDGPIQVAT

SEQ ID NO: 30104 - protein, 328 aa, Synechococcus elongatus PCC 7942
MDIRNGFIDTIGNTPLIRLNSLSEATGCNILGKAEFLNPGGSVKDRAALFIIEDAERQGKLRPGGTVVEGTAGNTGIGLAHICNAKGYRCLIVIPETQSQEKIDLLRTLGAEVRTVPAVPYRDPNNYVKVSGRLAEELDNAIWANQFDNLANRQAHYATTGPEIWQQTEGTVDAWVAATGTGGTYAGVALYLKEQSSKVRCVVADPMGSGLYSWVKTGEIHLEGSSVTEGIGNSRITANMQDVPIDDAIQIADPEALEIIYQLLHRDGLFMGGSVGINVAAAYRLAKEMGPGHTIVTVLCDGGARYQSRLFNAEWLASKGLQMPQVTT

SEQ ID NO: 30105 - protein, 228 aa, Synechococcus elongatus PCC 7942
MSVSPPAASSIAKPPQPVLDGLWAFAPNRDTLGGTAYFLKLPQGNWLIDAPAWHGETQAFVEEQGGLQGVFLTHRGAFGKAIAIQQHFDCDLVVQEQEAYLLPGANVTTFEQEQAIAPALTAIWTCGHSPGSACLYWEGHGGVLFTGRHLLPTRAGGVAPLRTAKTFHWPRQIRNTQMLCDRFSSETLAWICPGASSGFLRGRKAIASAYMQLQQLDWSALSEAQPLL

SEQ ID NO: 30106 - protein, 471 aa, Synechococcus elongatus PCC 7942
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQRDYFGAHTYERTDRSGSFHAQWF

SEQ ID NO: 30107 - protein, 338 aa, Anabaena variabilis ATCC 29413
MGIVVENVSKQFGSFRAVDQVNLEIQSGKLVALLGPSGSGKSTLLRLIAGLEKPDDGRIILTGKDATNQSVQERNIGFVFQHYALFKHLTVRQNIAFGLEIRKAPANKVKGRVEQLLELVQLSGLGDRYPSQLSGGQRQRVALARALAVEPSVLLLDEPFGALDAKVRKDLRAWLRRLHDEVHVTTVFVTHDQEEAMEVSDEVVVMNQGRVEQVGTPAEIYDNPATSFVMSFIGPVNVLPSSSRIFQSSQLEIEHPNVFLRPQDVVIEKSANGTTAPATVTRLIHLGWEIKVELTLDDGQVVNAHLTRDRYDELQLEPKQKVYVKPKDAKSFPLYYSI

SEQ ID NO: 30108 - protein, 290 aa, Anabaena variabilis ATCC 29413
MTLSVAHLGPPGTYAEQATIFYVKWLSHSSGLEASLRPYSSIAQSLQALAQGETQLAVVPVENSIEGSVTMTMDTMWQLDSLQIQSALILPIAHALISCADSLDGIKTVYSHPQALAQCQGWLRAFLPNVQLIPSNSTTEALEKLEYDLSIGAIASSRAAELYNLPILASRINDYAENCTRFWVISQAESDITHQLPLQKLTHTSIAFSVPANVPGALLKTLQVFAHLDINLSRIESRPTKRSLGEYLFFIDLEADVNTPQMKSALLELTTYTEVLKIFGSYSVLSANDQ

SEQ ID NO: 30109 - protein, 186 aa, Anabaena variabilis ATCC 29413
MCYSPPFPSPQSPVPVIKFMYVSLLPYTDMKKKNSTALIFNFQPLAKLITTIVISCLVVLISWVWTPSAMALTQIKLSDLSYQECPAELAQGTVASNSSTSANCFIVTGKAENGTYKTVYDADIYGRIYDANNDPILQNRTRLGSITEVPPGISDFELRITVPANQPLPLKLKQFKASGFSAQVRK

SEQ ID NO: 30110 - protein, 488 aa, Anabaena variabilis ATCC 29413
MQIQTPDWVKNAVFYQIFPDRFAISKQSRKRLLRDVRWEDWDAMPTLQGYKGGDLWGIMEQLDYIQDLGIDAIYFTPIFQSASNHRYHTHDYYQVDPMLGGNAAFKELLDAAHERNIKVVLDGVFNHSSRGFFFFHDVLENGPHSPWVNWFKIEGWPLAPYTGELPANYVGWADNRALPVFNHDNPDVREYIMEIAEYWLKFGIDGWRLDVPFEIKTPGFWQEFRDRVKAINPEAYIVGEVWGDSREWLDGTQFDGVMNYLFAGPTIAFTAGDRVVLEQVQSRDYQPYPPLFAAEYATKIQEVLQLYPWEIQLTQLNLLASHDTARLMTIAGGDQASIELATLLLLTFPGAPSIYYGDEVGLPGGIDPDSRRGFPLEANWDREIYQTHRQLIALRHAYPALRTGEYQVIWAQGALYVFARTLGKEELIIAVNVGTAPAQANVDVASLQTQPDKILYGEAEFSWHNTEETKQLSLNLPPRSGCILGLGD

SEQ ID NO: 30111 - protein, 474 aa, Anabaena variabilis ATCC 29413
MTTSQEVLKRIQDEKIELIDLKFIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 30112 - protein, 1643 aa, Anabaena variabilis ATCC 29413
MKTVENQEPLDGVAIVGMVGRFPGAKNVQEFWGNLCAGKESTTFFQDEELDPSIDPHLVQDPSYVKARGIIPGGETFDAAFFGINPREAEVMDPQSRVFLELVYEALENAGYDAEAYSGLIGLYAGCGQNTYFANHICGRQEIIDRVGEFQTMLANEKDFLTTRAAHKLNLKGPAVSISTACSTSLVAVIQACQSLSNYQCDMALAGGVSMTTPQNSGYIAQEGTMLSGDGHCRPFDAKSQGTMFNNGAGLVVLKRVEDAIQDGDRIYAVIRGFGINNDGADKVSFTAPSVDGQAEAIAMAQAYANFHPETISYIEAHGTATSLGDPIEIEALTQAFRIHTNSKQFCAIGSLKSNVGHLVAAAGVAGLIKTALALYHQQIPPSLNFEAPNPNIDFANSPFYVNTQLTPWPQGETPRRAGVSSFGVGGTNAHIVLEEAPAILPSNLSRPSQLLLLSAKTSTALETATVNLQEHLRNNASINLADVAHTLQRGRKAFNYRRFVVCQNTKEAITTLQSLEPKRVFTRHTQVRDPEIAFMFPGQGSQYVNMGFNLYSREIVFRQVVDQCAEILKPILGRDLREIIYPVATDIETASTALQQTCFTQPALFVVEYALAQLWQSWGVKPQAMIGHSIGEFVAACLAGVFSLEDALMLVANRGRLMWELPRGAMLSVRLSAPEVEKRLAGELAIAAINSPSLCVVSGTTEAIAAWQTQLETAEIVCRLLHTSHAFHSPMMEAIVAPFAELVGKVKLSPPQIPFVSSVTGDWITPEEATNPMYWAQHLRQTVRFADGVKTLWQQPERLLLEVGPRTTTTTLARQQAKDIKQQITIASLSDNADNEAEWTALLQAMGQLWLAGVTINWNNFYQEERRQRIPLPNYPFERQRFWIDPLPHPNRNTNHKPAHYQLEKTQTMSAQTTLISLLKEIIEETSGLEIASVDASTTFLEMGLDSLSLTQVGLALKKKFKVKVSLRHLLEVYPNLATLADFLQQNLSAEALSALVPSETTSPSATLSLQEVSTNGSNGKNGKNGSTPSPMLLVPPTSTNGNGSKNGSLPQVSLPNVASSALEGVINQQLQIMAQQLALLGNNSQPVTVPAVNGQNNGVKSEKPVTQSNQKPEPQDSTENLPKKVFGAGARIETTQTKTLTPQQRTYLDSIIQRYTQRTQKSKEYTQTNRPHLADPRSVSGFNPTMKEMVYPIVVSRSSGSKLWDIDGNEYVDLSNGFGLNLFGWSPAFVTEAIEAQLKLGMEIGPQTPLVGEVAKLMCEITNFDRAAFCNTGSEAVLGAMRLARTITGRNLIAIFSGGYHGILDEVIVRGTKKLRSIPAAPGIPQEKVDNILVIDYDAPDALDILKSRADELAGVMVESVQSRRPEYQPREFLQQLRQFTEQEDIALIFDEIVTGFRIHPGGAQAHFGIKADIATYGKIVGGGLPIGVIAGKSKYMDALDGGFWQYGDDSVPEVGVTYFAGTFVRHPLALAAAKAVLQHLLKNGPSLQQQLNAKTDQFVVELTDYFQQMQAPYTVHNFGSLFMVKSAPEFLYGDLLFYLMRDKGVHIWDHRPCFLTTAHSDADLSLAMAAFKESIAEMQSAGFFSAPTPTTKGSPESSKNLRNRPPQPGAKLGRDPEGNPSWYVPDPQRPGKYLQVSSVS

SEQ ID NO: 30113 - protein, 498 aa, Anabaena variabilis ATCC 29413
MKTPLNCQNYINGQWLNAATETTLNSHNPANKSEIVATFPRSQADDTDRAVTAARQAYGSWRKVPAPARAEYIFRVGELLLQHKEELAQLISREMGKPITEARGDVQEGVDCAFYSAGEGRRLFGQTTPSEMPNKFAMTVRMPIGVCALITPWNFPVAIPCWKAMPALVCGNTVILKPAEDTPACATKLIEIFAAAGLPPGVINLVHGVGEEAGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIVTEGQLKQGYFFQPTILDNVTPQMRVAREEIFGPVVALIEVSTFEEAIAILNDTKYGLSSSVYTRDINRAFVAMRDIEVGITYINGPTIGAEVHLPFGGVKQTGNGHREAGTTALDVFTEWKSVYVDFSGSLQRAQIDNRS

SEQ ID NO: 30114 - protein, 379 aa, Anabaena variabilis ATCC 29413
MAQTVTQNPRGVKTLLPLDVELRNVFKFFNQEPAVHGVDLDVKQGEFFSILGPSGCGKTTTLRLIAGFEQVDAGKLLIQGQPMTNIPPYRRPVNTVFQSYALFNHLNVWDNVAFGLRLKKSRKSEVESRVKEALKLVKMESLRSRFPSQLSGGQQQRVALARALVNRPAVVLLDEPLGALDLKLRKEMQVELSNLHKNLGLTFIMVTHDQEEALSLSDRIAVMNQGKIEQIGTPQEIYERPKTSFVADFIGDTNLFSGEITVLEAEYIQIVTKTGLTIVVARNEDTPAELLKSVVVSVRPEKIQLSLYPPSSLNNCFEGRLINVMYLGTHVNYLVQLINGININVLQPNTFGNLPDRETPIYAWWAESDCLAINQMTND

SEQ ID NO: 30115 - protein, 216 aa, Anabaena variabilis ATCC 29413
MSFIDSHSPQNVVPVEEIRYDERGLVPAIVQDYLDGTVLMMAWMNRESLQKTLDTGETWFWSRSRQELWHKGGTSGHTQKVQSIRYDCDSDALLVGVEQIGDIACHTGERSCFHQVEGKIVAPPGDTLSQVFQVICDRQNHPSESSYTSKLFAGGDNKILKKIGEESAEVVMACKDDDQEAIAGEVADLLYHTLVALAHHQVDIKAVYRKLQERRR

SEQ ID NO: 30116 - protein, 432 aa, Anabaena variabilis ATCC 29413
MVNTTIKTTKSQEIFAAAQNLMPGGVSSPVRAFKSVGGQPIVFDHVKGAYIWDVDGNQYIDYVGTWGPAICGHAHPDVIGALHEALEKGTSFGAPSFLENVLAEMVIAAVPSIEMVRFVNSGTEACMAVLRLMRAFTNREKVIKFEGCYHGHADMFLVKAGSGVATLGLPDSPGVPKSATSSTLTAPYNDLEAVKALFAENRDQIAGVILEPVVGNAGFITPDAGFLEGLRELTHEHGALLVFDEVMTGFRIAYGGAQEKFGVTPDLTTLGKVIGGGLPVGAYGGRRDIMSMIAPAGPVYQAGTLSGNPLAMTAGIKTLELLQKPGAYEYLERITKKLADGLLQVAQETGHAACGGHISAMFGLFFTSGPVHNYEDAKNSDTAKFGRFHRGMLERGVYLAPSQFEAGFTSLAHTDEDIDQTIAIAREVLSSI

SEQ ID NO: 30117 - protein, 1038 aa, Anabaena variabilis ATCC 29413
MNNGKVRIYELSKELNLDNKELLAICDQLNIAVKSHSSTISESEAESIRAAAEKLAATNGTSKKELNTTSHKPNSAPAGSRNRPAPPQKQQQILEIRKPKILRNTTSNAPEASVANNQIASSEANSPAPPRPFATPVSPMKPTAPSRPVPRNLSETPQKPAAPEAEPEAQSQAPAKIAVEKPEKSAQPRPGKPERQPKPQLVAPPSRPTAEKLDLSEITGAPGEKPILKRDRPRREDERDQAKPRVAKPAQGETSSAPVQKQARPAQGPVKPEQRVNRPGAPSGDGIRPQRPVRPSVDAAPVATPPRGVPGGRGEVGDTAAIAPDLLDLKRPTPPRLAKGGKKWQEEEIIDEIKEKAGKAGVKGKRVKPLVEDDFEDEDLLDEEGLEIPATVQVSLSIARPPKPKAARAATAATAAPISSPTTRGKRSSHNNRDQNRRQETEVKRERPEKVAVTGPMTVQELADLLAVADTEIVKILFMKGMAVSITQNLDIPTITLVGKELEIEVETAEPEAEARKVTEMIEVGDLEHLLRRPPVVTIMGHVDHGKTTLLDSIRKTKVAAGEAGGITQHIGAYHVDIVHDGKEQQIVFLDTPGHEAFTAMRARGARVTDIAVLVVAADDGVRPQTVEAISHAQAAGVPIVVAINKIDKEGAQPDRVKQELTQYGLTPEEWGGETIMVPVSAIKGENLDTLLEMILLVAEVGELSANPDRNARGTVIEAHLDKAKGAVATLLIQNGTLHVGDILLAGSAFGKVRAMVDDRGRRVDIAGPSFAVEVLGLSDVPAAGDEFEVFDNEKEARALASDRADKQRLSRLLQGRVTLTTLSAQAQEGELKELNLILKGDVQGSVEAIVGSLKQIPQNEVQIRMLLTAAGEITETDIDLAAASGAVIIGFNTTFASGARQAADEAGVDVREYNIIYKLIEDIQGALEGLLEPELVEEPLGQTEVRAVFPVGRGAVAGCYVQSGKLVRNCKVRVRRAGKVIYEGVLDSLKRMKDDAREVNAGYECGIGVDKFHDWAEGDIIESYQMVTKRRTLALTR

SEQ ID NO: 30118 - protein, 475 aa, Anabaena variabilis ATCC 29413
MSASSNSSKIKFGTDGWRGIIADDFTFPNVRKVTRAIASYLETAYTKDRPVLIAYDTRFLADQFAQTAAQVLADLGWNVKITDRDCPTPVIAYNARHLNSAGALMFTASHNPAPYCGIKYIPDYAGPATPEITDTIVANIESASDELPSGKPSGSISTFDPKPDYLQFIYTLLDVEKIKSAQLKVKYDALYSTSRGYLDEVLIESGTQLESFHTWRDVLFGGGMPEPKGEQLVELVEAVRRDHADLGLATDGDSDRFGIVDELGNVLTPNTVLLVLARHLIKNKGKTGAIVRTVATTHLLDNFAAKYGLTIYETAVGFKYIGEKMRETAVLIGGEESGGLSIIGHIPEKDGVLADMLIAEAIAYEGKPLSQLVKEAIAEADGPLYNNRLDLHLTEAHKVAVIDSFTKNPPSEVAGIKVKEVGRKDGIKLYLEEGSWVLLRPSGTEPLVRVYLETNSPEKLSKLEQELESTIAKLG

SEQ ID NO: 30119 - protein, 184 aa, Anabaena variabilis ATCC 29413
MTRLIFLGPPGAGKGTQAQILAEHLHIPHISTGDILRQAMKEQTPLGIKAQSYVDSGELVPDQLVQDLVEERLEQADAKSGWILDGFPRKVTQAAFLEELLQKTGQGGERVVNLDAPDDVVVTRLLSRGRKDDTEEVIRRRLEIYRNDTAPLIDYYSDRQKLLTINGDQSQEEVTHELKETLGS

SEQ ID NO: 30120 - protein, 144 aa, Anabaena variabilis ATCC 29413
MTETATAPLTGKALLAKVKELSTLPRRERAKQCGYYTVTKNNQVRVNLTDFYDALLSARGIPLSPEAPKDGRGREPTYRVSVHQNGQIVIGATYTKAMGLKPGDEFEIRLGYKHIHLIQLGESDKKLSPDLDIDESDEDLDDEE

SEQ ID NO: 30121 - protein, 476 aa, Anabaena variabilis ATCC 29413
MRRTKIICTVGPATSAPERLEALVEAGMNVARLNFSHGAYDFHAQTAQYLRQISADRQKPVAIMQDLCGPKIRLGTLPPEGLTVEAGQEVTFVLQEKGNSLDELPLPLPTLFAMVRPGEPILINDGRVKLIVTDRDADRIRAIAKIGGLLSTRKGVNLPATRLPVSSITEKDLQDLRFGIELGVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQTMHDIATTTEKSLQEGSKNCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 30122 - protein, 278 aa, Anabaena variabilis ATCC 29413
MTNQAPIPVIVNGAAGKMGREVVKAIAQAPDLNLLGAIDSSPEHQGKDAGELAGLSEPLEVPITNQLEPMLGYVAGERQGPPGVIVDFTHPDSVYDNVRSAIAYGIRPVVGTTGLSPAQIQNLADFAEKASTGCLIIPNFSIGMVLLQQAAVTASQYFDHVEIIELHHNQKADAPSGTAIQTAELLAELGKTFNSAIVEETEKIPGARGSLAGEGIRIHSVRLPGLIAHQEVIFGAPGQIYTLRHDTSDRACYMPGVLLAIRKVLQLKSLVYGLEKIL

SEQ ID NO: 30123 - protein, 459 aa, Anabaena variabilis ATCC 29413
MTTIPIWDVQPTPELNISAADYSLLTDLYQLTMAACYTGEGVEQRRASFELFVRRSPEGFGYLIAMGLTQALEYLEKLSFSSEQIAALQATGIFAHAGEGFWSLLAEARFTGDVWAVPEGTAVFANEPLLRVEAPLWQAQLVETYLLNTLNYQTLVATRAARLRDIAGEQATLLEFGTRRAFSPQASLWAARAALAGGLDATSNVLAALQLGQQPSGTMAHALVMALSAMEGSEEQAFSAFHRYFPGAPLLIDTYDTVAAAQHLAEKVNTGKMELSGVRLDSGDLVSLSKQVRSLLPKVSIFASGDLDEWEIAKLQAAGAEIDGYGLGTKLVTGSPVNGVYKLVEIDDIPVMKKSSGKATYPGRKQIFRSYGGGQVQADRLGLITDTPLITEKPLLQLVVKEGQRLQPPEKLSAIRQRTAASVASLPEQTKRLDNPVPIPIEISTALQNLTEVTLQRLN

SEQ ID NO: 30124 - protein, 298 aa, Anabaena variabilis ATCC 29413
MQANVFTNVILPLALAIIMLGMGLSLQIEDFKRVTKYPKAVSIGSITQLILLPIIGFLVAKAVPMQPEIAVGLVILSLCPGGPSSNMITYLAKGDVALSVTLTVVSSMVTIFTIPIFANLALQHFLGQTAAIALPIGSTMLQIFLITIVPIGLGMYIKRIFPATALRLEKVTNRLAIAFLALIILILVIREWNRIPGFIVQVGVGVVILNILAMLSGWYMSKFFQLNIPQQICVAIEVGIQNGTLAIAITAGLLKNQDMAIPAAIYSLFMNLTAFVAIYYGRKLSAINSVSNNLVGKV

SEQ ID NO: 30125 - protein, 298 aa, Anabaena variabilis ATCC 29413
MDLSTWVALAKTKTNCGRVVERIPRLAVADTAWFAVHICCKSGKFYSEGDTNCVFPLMSVIKPFTFLYLLEHMGMEKVLSWVGVKPSDAPFNSLEQLVADGGYPRNPMINSGAITLADKLLGEDADYSTRSFCEWLNQLAGSQIQLDESMLASVRLSRSPANQAIANYLAEKGYLGNLDVALDTYEQICCLSGTVEDLALLGKLLALESSSISPQHQQLVNSVMLSCGLYQASAEYADKIGLPMKSGIGGGLLAVVPKEGAIACYSPALDRIGNPVGAIAFVEVLSRSLGLCGRFSHL

SEQ ID NO: 30126 - protein, 478 aa, Anabaena variabilis ATCC 29413
MPVIASSIKFGTDGWRGVIGDEFTFERLALVAPVAAKVLYDTYYSTVGSRTIIVGYDRRFMAEDFARAVADAVTSVGFDVLLSEGYAPTPAFSWAAKQLNALGALVITASHNPGAYLGLKVKGYFGGSVSPEVTKDIEALLSTGVPPAATPGKLETFDPWPSYTQGLEGKVDIAKIRKAIASGELTVFADVMHGAAATGLGRLLGERVQEINSDRDPLFGGGAPEPLPKYLSLLFETIRKHRETNPSSLSVGLVFDGDCDRIAAVDGNANFLSSQILIPILIDHLTQRRNFTGEIVKTVSGSDLIPKVAALHNLAIFETAVGYKYIADRMLAAPVLLGGEESGGIGYGSHIPERDALLSALYVLEAIVESGLDLGDYYRQLQEQTGFSSAYDRIDLPLASMDVRARLLQQLQSQPLTEIAGKAVIDCNTTDGYKFRLADNSWLMIRFSGTEPVLRLYCEASTLEQVHQTLAWAKHWAE

SEQ ID NO: 30127 - protein, 1786 aa, Anabaena variabilis ATCC 29413
MNTYTIDNHNSYSLVTNQSQECQNTLANLRVIIADLLKCEPEEVDVKVPFLEMGADSIVLVDAIRQIENNFRIKITIRQLFEELTNLSVLANYIEENVKLEPSTLLGQETLELSVNPQPLPQSQQSEQKSETLVEIVLRQQFELMSQQLEILRESNLPTNLSVTPSQNQAAKSVPNAVVQTTPDLKTGELNKSTLKKADSPSSFWRVEQSQAKTLTSQQQQYLNSLIARYTKRTAKSKQRSQSYRPVLADRRASIGFRPETKEILYPIVGDRSQGSRIWDVDGNEYIDISMGFGVHLFGHNVPFITAALEDQIKQGIQIGPQSKLAGEVATLICEMTGMERVTFCNSGTEAAMTAMRIARAATGRAKIAIFKGAYHGHFDGTLAIPQTSEDGKLPAQPMVPGVLQNMVDDVLLLTYGTPESLEIIKANAHELAAVLVEPIQSRKPDLQPKEFLQQLRVVTQQLDIALIFDEVITGFRVHPRGAQAWSGVDADIVTYGKLIGGGMPIGVIAGKAAYMDKIDGGFWSYGDDSYPEVETTFFAGTFSKHPLTMAATRATLLHLKAEGASLQERLNQRTSNLAATLNSYFEQANVPLRIVHFSSLFRFTLSGNSSYLYQPLEMDLLYYSLIEKGVYIWEGRTCFLSTAHTDEDVDYVIQAVKDSVQELQAVGFFSKSPKLSTNQPQTPKTSERVNSAVSLTVQDTIKPEVKEAFKIPLSDAQKQLWFLAQMGDNGSVAYNISLNIQLQGTLDLAAIRQAVQQVVQRHEALRTTISSQGDFQEILPSLKIDVPVIDFSNVKDSQLQVNQWLQNYSRESFDLSNGPLFRVRILKLAEQLHLLVVSAHHIITDGWSISIILQEMMALYSAKCQGHVCQLEPPIQFSSYLDWHRQFCATDEMKAHESYWLQKFADPVPVLDLPTDRQRPPSKTYQGGRQQLLLDPNVSAAIKQLSKQNGCTLFMTLLSAYAVLLYRLTNQDDLTIGIASAGRSLEGSERLVGYCSHMLPIRTQIVGDATFVEHLKACKSVLLEAYEHQDYPFAKLIDKLRVNSNTGMSPLVNATFNLERPVAIPQMYGLESSLLPQSISFADYDIGLNVTEIDHELLLECDYNADLFDAATIDRILGHYQTLLLGIIASPQTLVSQLSLLTATERQQILVEWNQTQIDYDRNQCVHQIFEQQAQLTPNAVAVESGEQKLTYRELNHRANQLAHFLQSLGVKPEVLVGICVERSVEMLVAMLGVLKAGGAYLPLDPAYPQERLAHMLTDSQASVLLTSANLASQLPKSSAKLVKLDTDWQVISRQPIINPTGIVVPSNLAYVIYTSGSTGKSKGVLIPHQALVNHNYAIAKNYELKASDRILQFASFSFDVAAEEIFPTWLSGATLVLRPEEIFSIPDFVQFVKQQDLTVLNLPVAYWQEWVSQMPQISWTPNVRLLVVGSERVPLERFLTWQQLVGSNVSWRNAYGPTEATITATIYGSHLSSHQQTAASLFIGRPIANTQIYILDQHLQPVPIGVTGELHIGGNGLAQGYLHRPELTAEKFIAHPFSNQPTARLYKTGDLARYRSDGTIEFIGRIDHQVKIRGFRIELGEIETALNQHPQVRECVVIASDDQLAHQQLQAYIVFHQQLKVDSSELHRFLKQKLPEYMIPTSFFQLENIPLTPNAKIDRQALNRLGVLINNIEVNRVAPSNHIEEVLANIWTEVLNLKQVGIHNNFFELGGNSLLAMQLLNRVNEAFLIDLPLRSLFECSTIAELSELIQAYKLEHLESDALEQILAEVDELIDTEIEQMLAKF

SEQ ID NO: 30128 - protein, 461 aa, Anabaena variabilis ATCC 29413
MATYENILQAIGQTPLVRLNRVTANVQSPIYAKVEYLNPGGSTKDRIALSMIENAEKTGQIQPGGTIIEATAGNTGVGLALIAAVKKYRCIFVMPDKMSQDKINLLKAYGAEVVVTPTSVPPDSPESYNGVAERLAKEIPGAYRPNQFENPNNPLAHYLTTGPEIWADSQGKIDVFVAGMGTGGTISGVAKYLKEQNPNIIIVGADPEGSILSGDSPKSYKVEGIGEDFIPKTFNRQLVDEMIRVSDKESFNMARRLAREEGLLVGGSCGTVVAAALKYAARLSQPKYIVVLLPDTGRNYINKIYSDVWMQENGFWEGKTVKTIKVGEILQQKTDFPSLVAVSPSDTLSQATNLLQKLNISQLPVIDNHHVVGSLNEASLMKFLYDGINFSNQQVLAVMGKPLPILDENVDVSEAYRVLLSGTTGIIITRNNIPAGLITRADLIRYWISQNQEKSKVNNGI

SEQ ID NO: 30129 - protein, 476 aa, Anabaena variabilis ATCC 29413
MSYAQTKTQTKSGYKAGVQDYRLTYYTPDYTPKDTDILAAFRVTPQPGVPFEEAAAAVAAESSTGTWTTVWTDLLTDLDRYKGRCYDIEPVPGEDNQFIAYIAYPLDLFEEGSITNVLTSIVGNVFGFKALRALRLEDIRFPVAYIKTFQGPPHGIQVERDKLNKYGRPLLGCTIKPKLGLSAKNYGRAVYECLRGGLDFTKDDENINSAPFQRWRDRFLFVSDAISKAQAETGEIKGHYLNVTAPTCEEMLKRAEYAKELNQPIIMHDYLTAGFTANTTLARWCRDNGVLLHIHRAMHAVIDRQKNHGIHFRVLAKALRLSGGDHIHTGTVVGKLEGERGITMGFVDLLRENYVEQDKSRGIYFTQDWASLPGVMAVASGGIHVWHMPALVEIFGDDSVLQFGGGTLGHPWGNAPGATANRVALEACVQARNEGRNLAREGNDVIREAAKWSPELAVACELWKEIKFEFEAMDTV

SEQ ID NO: 30130 - protein, 196 aa, Anabaena variabilis ATCC 29413
MGEPQEEVRTQESPHSGTTIEKNMPRTQKNDNFVDKSFTVMADIILKILPTNKKAKEAFVYYRDGMSAQAEGEYAEALEYYEEALTLEEDTNDRGYILYNMGLIYASNGDHDKALELYHQAIELNPRLPQALNNIAVIYHYKGEKAKEDGDHDGGEALFDQAADYWIRAIRMAPNNYIEAQNWLKTTGRMQIDVFF

SEQ ID NO: 30131 - protein, 506 aa, Anabaena variabilis ATCC 29413
MARLALLSVSNKTGLIDLARRLVEEFEFDLISSGGTAQALKDAGLPVTKVADYTGSPEILGGRVKTLHPRIHGGILARRDVPSDLTDLENNQIRPIDLVVVNLYPFEETIAKPGVTLAEAVEQIDIGGPAMLRASSKNFAHLTVLCDPAQYDEYLQELRQNNGVASLEFRQKAALKGFLHTASYDSAIASYLSGTQQHTLNGTELQSLRYGENPHQPAAWYQTGTTPTGWTAAKKLQGKELSYNNLVDLEAARRIIAEFTDTPAATIIKHTNPCGTALADTIVEAYQKAFNADATSAFGGIVALNRPIDAATASELTKTFLECVVAPDCDAEAQKILAKKSNVRVLTLADLSTGPKTLVKQIAGGFLVQAADDIAADTIQWQVVTERQPTADELAELLFAWKVCKHVKSNAIVVTSDRTTLGVGAGQMNRIGSTKIALEQAGDKAKGAILASDGFFPFDDTVRTAAAAGISAIVQPGGSLRDQDSVKAANELGLLMVLTGVRHFLH

SEQ ID NO: 30132 - protein, 440 aa, Anabaena variabilis ATCC 29413
MSNQGAFEGAANVESGSRVFVYEVVGMRQNEETDQTNYPIRKSGSVFIRVPYNRMNQEMQRITRLGGKIVSIQTVSALQQLNGKTTIATVTDASSETAKSEGNGKATPVKTDSGAKGFAKPPAEEQLKKKDNKGNTMTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPETGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADELWQLIKNEKTHTYICGLRGMEEGIDAALSAAAAKEGVTWSDYQKDLKKAGRWHVETY

SEQ ID NO: 30133 - protein, 400 aa, Anabaena variabilis ATCC 29413
MSKKTVASLSAADISGKRALVRVDFNVPLDDQGNITDDTRIRAALPTIQDLTQKGAKVILASHFGRPKGVDEKLRLTPVAKRLSELLGQEVVKTDDSIGDEVAAKVAALQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIDNIPDGWMGLDIGPDSVKVFQEALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 30134 - protein, 335 aa, Anabaena variabilis ATCC 29413
MVAATDFKDYYEILGVSKNATPEDIKKAYRKLARKYHPDLNPKDKQAEARFKEINEANEVLSDPEKRQKYDQYGQYWQQAAAGTPPPRGAGTQGYDFSQYGNFNDFIDELLGGLGRSGGRTRQRTANYRTTTRPEGFREYADFGYGEDPFGRFTEVPAQDTEAAIALTFSEAFHGTQKQLQIDGETITVRIPPGVKSGSRIRVKGKGQMSPFIQQRGDLYLTIELLPHPFFKFEGDNLACEVPVSPEEAVLGAQIDVPTPDGKVTMTIPAGVDSGQALRLRGKGWRDPKGNRTALIVRLKIVTPKDLSPQERECYEKLRQVSSFNSRQGLTEVRL

SEQ ID NO: 30135 - protein, 395 aa, Anabaena variabilis ATCC 29413
MTTQNITTLSSSPAQTELKTPGYQGCQSRSLHDSEIPEVDLFTPLIIRDITLPSRVAMSPMCQYSAENGFANDWHFVHLGSRAVGGTGLIMVEATAVTPQGRITPGDLGLWDDKQIEPLTRIVRFLRQQGSVTGIQLAHAGRKASCNVPWLGGTPLTPEQGGWQPVAPSPIPFQENAPVPISLDERGIQETIFAFVAAAQRALQVGFQMIEIHAAHGYLLHSFLSPLSNRRTDRYGGSLENRMRLLLEVVRRVRDVLPNGMPLFVRISATDWVEGGWDLQQSIILSRELKTLGVDLIDVSTGGLVPHARIPVEKGYQVPFAAKIREEAGIMTGAVGLINEAEYADQIITRGCADLVLIGRELLRNPYWSIYARCSLDEEPNWPVPYGYAVKRQRR

SEQ ID NO: 30136 - protein, 337 aa, Anabaena variabilis ATCC 29413
MELGMIGLGRMGANMAHRLTQAGHTVIGYTRQPQKAEVLVQEGAIARGVTSFVELIEALTPPRTVWLMLPAATVDATLQTLIPFLDADDIIIDGGNSYYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQVDAETAPLRNPEFYQYDFNLADIAEVWRRGSVISSWLLDLIAMALVKDPDLTDFGGRVSDSGEGRWTLMAAIEEAVPTPVLSTALYTRFSSRGQSEFANKLISALRYEFGGHLEK

SEQ ID NO: 30137 - protein, 431 aa, Anabaena variabilis ATCC 29413
MLSIPINQHLPHTPHLVTSLPGPRAKAIVERDRAVTSPSYTRDYPLVVNRGEGCMVEDVDGNVFLDMTAGIAVTATGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHQQFPRMSLPRGKGLMVAVDLLDEDGNFDSKLRDRIIQEAFYHGLLLLGCGKAAIRFCPPLVINREQIQTTLDILAEILR

SEQ ID NO: 30138 - protein, 235 aa, Anabaena variabilis ATCC 29413
MTQNRSEKPIVISPSILSADFSRLGDEIRAVDAAGADWIHVDVMDGRFVPNITIGPLVVEAIRPVTKKPLDVHLMIVEPEKYVEDFAKAGADIISVHCEHNASPHLHRTLGQIKELGKQAGVVLNPGTPLELIEYVLELCDLILIMSVNPGFGGQSFIPGVVPKIRKLRQMCDERGLDPWIEVDGGLKANNTWQVLEAGANAIVAGSAVFNAKDYAEAITNIRNSKRPTPELAKV

SEQ ID NO: 30139 - protein, 230 aa, Anabaena variabilis ATCC 29413
MFKTQAESQEFLKEFLPALEETPQEREVLLCVPFTDLAILSQSLHGSLVQLGAQNVHWAENGAYTGEISGPMLTEIGVRYVIVGHSERRQFFGETDETVNLRLQAAQKYGLTPILCVGETKQQRDSGETESLIVSQLDKDLINVDQTNLVIAYEPIWAIGTGDTCETTEANRVIGLIRSQLKNPDVPIQYGGSVKPNNIDEIMAQPEIDGVLVGGASLEAASFARIVNYQ

SEQ ID NO: 30140 - protein, 256 aa, Rubrobacter xylanophilus DSM 9941
MAGERRPLMAANWKMNKTVREAQDYMAALLPRVADLAGEVDVAVFAPFTCLSEVARMAEGSGVLAGAQNFFYEDSGAYTGEVSAPMLLDVGARASIVGHSERRELFCETDESVARKARRAVEAGLLPVVCVGETEEERDAGRMWEKVSGQVRAVVEGLGDASGGRVVFAYEPIWAIGTGKTASPEDAQDAIGRIRGLLRELRGEGFAEEARLLYGGSIKPENISEIMAQKDVDGGLVGGASLEVGSFLQLVEAARG

SEQ ID NO: 30141 - protein, 375 aa, Rubrobacter xylanophilus DSM 9941
MPAGKRDYYEVLGLSRDASEQDIKRAYRRLARKYHPDANPNDPEAEERFKELNEAYEVLSNPEARRAYDTYGHQVPSGASGRPGGDPFGGFQDIFEAFFGDRFGDPFFDLGRRRQPSRGGDTEAEVEISLEEAAFGTEREVQVQTIRNCPACDGAGGTETRLCGACGGSGVVRTVRETLLGQVMHQQTCSACGGSGRVVVDRCRECRGSGRVSEVVGRRIRIPAGIEDGMRLRVPGWGHAGEPGASSGDLYVKIRVKEHPELMRDGEDLIHRASVTFVQAALGTEVEVPTLEGTETVRIEPGTQPGTTLVLRGEGMPRMRGVGRGDLKVVVDVMVPTRLTGEQRKLLERFEAASGEETYNGRSGSFFDRLRGVFR

SEQ ID NO: 30142 - protein, 491 aa, Rubrobacter xylanophilus DSM 9941
MSEGSAATKTVESAVPARMDRLPWSGWHWLVIAALGITWILDGLEVTIVGNIAAVLTQPESGLDLTEGQVGLAGGIYIAGACTGALFFSYLTDRYGRKRLFLITLAIYLLFTVATAFSWNFWSFAVFRFLAGTGIGGEYSAIYSAIDELIPARVRGQVALAISGSYWGGAAVGSLLSVALLSEVFVSQFYGWRLAFGLGAVLGLCVLLIRRYIPESPRWLATHGRNEEAERVAAGIEERVKREKGLRELPPIDEDEKITIEQRESIGFGPILRAMFLMYPRRTVLGLVLMGTQAFLYNAVLFTYGLILSGYYGVPGGNVGYYLAAFAVGNLCGPLLLGRLFDRVGRVPMISGCYIASGAVLALSAFLFHQRVLDATTLTALWTLMFFFASSAASAAYLTVSEVFPMEIRAMAIALFYAIATGLGGVTGPIIFGQLIGTGDRSNLLVGFIIAGALMLVAAVFEMFLGVRAERRSLESVAAPLTAIEEQTGSA

SEQ ID NO: 30143 - protein, 208 aa, Rubrobacter xylanophilus DSM 9941
MRIILLGPQGAGKGTQAARLSERTGARHISTGDLVRAEIKAGTELGRKVQEYNDRGELVPDEIIVEMAKPHLREAGSWILDGFPRTEAQARALDEALEELGVGLDRVVALEAPDEVLVRRLSGRRQSEATGRIYHLEHDPPPPDDPGPFVQRKDDTEEAIRRRLRLYHEQTEPLKGYYAERGLLATVDATRSIEEVTEELLRVLGVGA

SEQ ID NO: 30144 - protein, 399 aa, Rubrobacter xylanophilus DSM 9941
MPPNPHSAADFARTDRLLSREELAVRDRVRAFVEEEVIPVAAEHWDRAQFPFGLLKGLGELGLLGGTYEKRYGGSGMNNVAYGLGVAELARGSGSLSTFLHVQSGLAMAAIHELGSEEQKERWLPPMARCEKTGCFALTEPEAGSDPASMRTTASRAPGGYVLEGEKRWIGNASFADVAVVWAKGEDGRVRGFLVEKGAEGFEARVIPRKGSQRAVWQAHIRLRRCFVPEENRLPLAEGLGSTLSILTHSRYGVGWDGLGQAADCYERALEHSLRRRQFGHPIAAFQLVQHRLVRMATSLAELRLLAVHMGRLKDAGELDPPLVSMFKMSSLSKAREIAALARETLGGNGILLDHRVMEHMADIEGAYTYEGTDDINALIVGQAITGHRAFAPRPAGPA

SEQ ID NO: 30145 - protein, 487 aa, Rubrobacter xylanophilus DSM 9941
MSETQTREELVSYPAIIGGERVSPERSFEDVDPSTGRPCALVARCGRQEVDRAVEAAREAHEKAWRRSTPAERARVLHRISQLLRRDHEEIARLESLDTGKPLSQARADATVAARYFEFYANTIESFYGETIPALPDAFVYTLREPHGVTGHIIPWNYPIQISCRSVAPALATGNCCVLKPAEEAPLTALRLGELALEAGLPPGALNVVPGYGEEAGAALAAHPGIDHLSFTGSVEVGRLVSRSAADNVVPVTLELGGKSPNIVLADADLERAVPVIVNSIIQNAGQTCSAGSRLLVESRLHGELVERVASRFQEIRIGPGPEDPDLGPIISEAQRERVKGYVETGRREAELVTGGGVPQDPRLAGGFYFEPTLFDRVEPGSTIFREEIFGPVLAVSTFEEAEEAAALANATDYGLIAAVWTRDVGKAHWLARELRVGQVYINTYGAGGGVELPFGGFKKSGHGREKGYEALYEYTQVKTVALSYAR

SEQ ID NO: 30146 - protein, 432 aa, Rubrobacter xylanophilus DSM 9941
MADVTFDYRNLLEVEGGLTGRELEEISPRLRAAVGTLLEDPPGFMRLPRTREHLEASLEVAERVRSDGATDFVHVGIGGSALGPMVLHRALSHPFYNLLPDRGGPRLHFAENADPATLSGILDVIEPEGTWVNVVTKSGSTAETMANFLVIRGALAEALGDFGYQARTVVTTDPEKGFLKRIADREDLVTLQVPPEVGGRFSVLSPVGLLPAAVAGLDVEALLAGAARCVEELEEQGAEHPAVVGAAMHHLMDASRGRNIRVMMVYADALERLAAWFVQLWAESLGKDGKGSTPHGAVGTTDQHSQLQLYMEGPQDKVIEIVEVREHPRDVGIPGAYEDLEGVGYLSGHTVGELLNVECDATRRALTGAGRPNATIRLGSLSAENLGYLMQALEVQTAVAGALYGVNPYDQPGVEAGKRITYARMGRPGYRA

SEQ ID NO: 30147 - protein, 404 aa, Rubrobacter xylanophilus DSM 9941
MRVLTRAEGLMSATDYYLLDELLGEEEREVRERVRAFCEKEVLPVIGDYWNREEFPFELVGKFADLGIVGGAIRGYGCPGLSRLAEGIVAAELARADGSINTFYGVHSGLAMGTIAMLGSEEQKQRWLPSMARMEKIGAFGLTEPEHGSDVVMLETTARREGDEWVLDGRKKWIGNASFADLVIVWARDLSDGEVKGFVVEREEAGEAFSAEVIKGKTGKRAVWQAEIELRGVRVPHENKLEGANSFKDTSKVLTATRYGVAWEGVGHAVAAYEAALAYAKERRIFTRPLESYQLIQNKLANMLSEITAMQLICFRLAQLFEQGKMTGGMASLAKMHTAKKARQVCLEARDILGGNGLLLEHVVGKHLADVEVVYTYEGTDIVQSLIVGREITGTQAFAPSRAG

SEQ ID NO: 30148 - protein, 457 aa, Rubrobacter xylanophilus DSM 9941
MRFPEGFLWGAATAAYQVEGAVGEGGRGPSIWDTFSHTPGRVYRGDTGDVACDHYHRLEEDLDLMARFGLGAYRFSVAWPRIQPEGRGPANRSGLDFYRRLVEGLGERGIEPVLTLYHWDLPQALEDQGGWTSRQTSERFAEYAALVYEALGGSVRFWITLNEPWVSAWMGYGLGVHAPGRRSTADALAATHHLLLGHGLALEALRALGGGGRLGITLNLSPVRAASAEPADAEAARRVDGNANRLYLDPLFRGSYPQDMLEHYRGASDFSFVRDGDLQRISAPVDFLGVNYYMRHTVRAAPGGGVRGPSTGMRFGELGAETVLPEGVGTTAMGWPVEPDGLAEILVRVKEEYRDLPVFVTENGCAVHDYIDPEGEVNDVERVAYLDAHLRAAHAALERGVDLRGYMVWSLLDNFEWAEGYSKRFGLVYVEYGSQRRVPKRSARWYAAVIRRGGPEG

SEQ ID NO: 30149 - protein, 344 aa, Rubrobacter xylanophilus DSM 9941
MIRMDKGQLESTARALVAPGKGILAADESFGTIGKRFKAVGIESTEDTRRRYRQMLFTTPGIGEFLSGVILFDETIRQKADDGRPLPRVLEDQGVIPGIKVDKSTTALPLSPQEKFTQGLDGLRERLEEYRGMGARFTKWRAVITIGEGIPTERCIGANAHGLALFAAFSQEAGLVPIVEPEVLIDGDHTIERCYEVTEWTLNRTFDYIYEMGVELSGMLLKPNMVISGKDCPEQAGVEEVARMTVECLKRSVPAAVPGIVFLSGGQSDIQATAHLNAMNRLYDDLPWELSFSYARALQGRPMEIWKGDDANVEAAQKAFYHRAKMNSAARSGSYSEEMEKEAA

SEQ ID NO: 30150 - protein, 410 aa, Rubrobacter xylanophilus DSM 9941
MASGGEEQRRFETRAVHAGESRPGAGGDRGGDGFYPISTPIYASTTFSHADAQTTDRVLGGEEPGYSYARWGNPSVAALEEALTALEAPQGGARALAFASGMAAMHAALTAAELGEGARVLAADQLYGSTATLLLQIFGPAGTEASFFDAYDPGEAEKKVSSLRPRAVVVETISNPLLRVADIPRLAEISRSHGAALIVDNTFGTPYLQRPLELGADMVVHSATKYLSGHGDVTAGVVAAGPPYDAALEQIRKTVGSTLGPFEAWLLHRGLKTLPLRISRQCANARRIAAWLAEHPKVFRVHHPSLEGHPDREATGRLLADTGGLVAFELAAEGREAAFRFLNALRLCVRAPSLGDIYTLAIHPATSSHRELPPSRREQLGVRENLIRLSAGIEHPEDIIADLEQALERL

SEQ ID NO: 30151 - protein, 186 aa, Rubrobacter xylanophilus DSM 9941
MSSMMPDVQEVLIPSEEIQQKVKDLGEQITRDYREHRRLLLVGVLRGAVIVMGDLMRRIDLPCEIDFMEVSSYGAGTTSSGVVRILKDLEEDISGRHVLIVEDIIDTGLTLSYLRRSLLARKPASLEICALLSKPARRRVELDVKYLGFEIPDEFVVGYGLDYAGCYRNLPDICILKPEVFGGAAS

SEQ ID NO: 30152 - protein, 326 aa, Rubrobacter xylanophilus DSM 9941
MVLRAPGGPLRPEELPVPEPGSGEVLVRVRACGVCRTDLHVVDGELREPKLPLVVGHQIVGVVERVGEGVERFSPGDRVGVPWLGRTCGRCRYCRTGRENLCGEARFTGYQLDGGFAEYARADARFCLPVPEGYPDLQAAPLLCAGLIGYRALRMAGDAERLGLYGFGASAHIILQVARHQGRRVFAFTRDGDEEAQRFARRLGAEWAGGSGQRPPEELDAAIIFAPVGALVPLALRAVARGGTVVCAGIHMSDIPSFPYELLWGERQLRSVANLTRRDGEEFLALAPEVPVRTEVRPYPLEGANQALDDLRSGRLTGAAVLVVGR

SEQ ID NO: 30153 - protein, 436 aa, Rubrobacter xylanophilus DSM 9941
MRPGELHERHRAALPAWLSLYYERPIELVRGEGFRVWDSEGNEYLDFFGGIVTTISGHAVPEIVEAVKEQAERILHSSTLYLIESQVRLAEKLISLSPISGEQKVFFVGSGSEANEAALLFATQYRGSSEVIALRGSYHGGSFGTMGITGQSSWRPTPRTALDVSYAMPPHRSYSPLYGRFGDPEELARACAEDVRSLIETSTTGRVAAFIAEPIQGVGGFIELPPAYLSRVKEILEEHGVLFVSDEVQTAFGRTGSHFWGIERSGVEPDLITMAKGLGNGLAIGAVMGRAEVIDSLSPKLHISTFGGNPVSTAGALANLEYILENDLQRNAEEVGSYLKERLLGLAAEHASVGEVRGRGLMLAVELVREGAPDPQAAAAFMEACRERGVLVGKGGLKGNAIRISPPLTVTREAAEEAARVFDEALSSVEAGERVV

SEQ ID NO: 30154 - protein, 275 aa, Rubrobacter xylanophilus DSM 9941
MEREMEAGNTKTALVTGSTDGLGRGVARELARRGYAVILHGRSEARCEEAAAELPGGAAGYLVADLSSLGEVRKMAREVLAGRERLDLLVNNAGVISRERRESREGFELTFAVNYLSHFLLTLLLLPLLRRSAPARVVNVASAAQSPIDFEDPMMERSYSPMEAYARSKLAQVMFSFALAGRLSGTGVCVNALHPASLMDTKMVRESFGRPMSSVEEGVRAVVRLAASSELEGVSGRYFEGTREARAHPQAYDPAARERLWELSEGLCGALDAGR

SEQ ID NO: 30155 - protein, 369 aa, Rubrobacter xylanophilus DSM 9941
MLYGEGQEFRVEEIEVDDPKQNEVLVHLAATGLCHSDYHMVTGEYGPLHFPMIGGHEGAGVVEKVGPGVTRVSPGDHVLLTFIPACGHCRFCSMGLSFLCDRGAAILQGPQLDGTFRMHTADGQDAGQFCCISTFSEYTVVPEASIVPIDRDLDLTKVCIVGCCVPTGFGSAVNKADVQPGETVVVFGIGGVGINAVQGAAVKGASKVVAVDPVDFKLETAEELGATHTINPNERDPVQTVVDLTNGVGADKAIITIDNVLPEHVGQAFKAIRKGGRVVVTGVARYDHQHIDVPPYELTLFAKEVVGTMYGDSPVNADLARYLELYRTGKLKVDELITRTYSHDEINQGYRDMLDGKNIRGVIVYDWAR

SEQ ID NO: 30156 - protein, 437 aa, Kineococcus radiotolerans SRS30216
MTSPGRSRRSRTSSRPRSPGSGSSATARTASRSTRPSTRRSCTATPTSTRSPRASPSCSRATGSRTGCCARPASRWPTRRDDRPIEGGGTPVSMQDWAEKDFYAVLGVAHDADAAEIKKAYRKKARTLHPDANPGDAAAELRFKEVGEAYAVLSDPEQRRQYDGVRAMVGGGARFSSGGSGPAGGAGFEDLLGGLFGQGGGRAPGGVRFGTPGGAPGGGFEDLLGGLFGQAGGGAGFPGGFPGAGQQAPPQRGQDLEASARVSFRDALDGKTVSLRVPDPRGGPVRTVNARLPQGVRDGQKVRLRGKGMPGPGGTAGDLLVTVQVEPHPVFRRDGDDLRMTLPVSFDEAVLGATVEVPTLDGTTVRVKVPAGTPSGRSLRLKGRGVQRSRSGDDRGDLFVTVEVVVPQRVDGAAREAVEAFARATAGDDPRAGLADR

SEQ ID NO: 30157 - protein, 239 aa, Kineococcus radiotolerans SRS30216
MYGSRAGENLLRSGAAELLGTFVLVLAGGAVAVGAGTTDPPVYDLLAIVLAFGLALTALVAALGHVSGCHLNPAVTLGLAVTRKFPWRAVPVYVVAQLVGAVLASLATWAVHTGRGREVANLSTTLPAPGVSDGRAFFVEALITFVLVLVVISVATDDRVPAAAAPLAVGAALAVCIFIAAPVTGGAVNPARAFGPAVVSGNLDALWLYLLAPVVGGVLAAVVYDRLLAPAQAPTPEDD

SEQ ID NO: 30158 - protein, 116 aa, Kineococcus radiotolerans SRS30216
MDLRYGRPMTPDPRAALARLVATLEDHLAASANRRGETDPAVADAYQRVADAFESYEEALYDAYDEVTPFVLYDDDEDGDDDDDDTDDDDDTDDDTDEDDDEDDEDTDDEDAPTPL

SEQ ID NO: 30159 - protein, 418 aa, Kineococcus radiotolerans SRS30216
MHAGAVPEPTTGARAVPIFQTTSFVFEDAADAANLFALQKYGNIYSRISNPTVAALEERIASLEGGLGALACASGQAAEFLVFAALAGAGDQIVASNNLYGGTVTQLDVTLRRFGVDTVFVAPEPDAVRAAITEKTRFVFTELVANPSTVIADIRALADVAHEAGIPLVVDATTATPYLCRPIEHGADIVIHSATKFLGGHGTTLGGVVVDAGTFPWDNGKFPAMTEPVASYGGLSWWGNFAEYGFLTKLRSEQLRDIGATLSPHSAFLLLMGVETLPQRMREHVANAKAVAEWLEADERVSWVRYSGLPTHPHHERARRYLPEGPGAVFSFGVVGGRAAGERFIESCQLCSHLANIGDARTLVLHPASTTHQQLSPDQLTAAGVPEDLIRISVGLEDVEDVLWDLDQALTAAVGGNR

SEQ ID NO: 30160 - protein, 405 aa, Kineococcus radiotolerans SRS30216
MAACGGAGPVDGGGDGPAGGAGGGRGGDGAAGAALGALRRGCGDRLRAGAAGAAVGDRGGPGAGPGGRGGDGGPAPGAGGAGRRGGGAGGPGLARPGARRLGGGGGAQRAAGGAGGAVPGAAALGGPGPGGGGPAAAGRPVPVGGDGGGRGGRGPALLRGGGREHRGRRPGAAGGGRVAGRGLPPAAGGDRGGDVDVRGALAAAGGGDPAHGGGHHRAGPGRAGARPRRRGRGEPPGADDQRGAGPPGAGPAGAAAVRGRRQPRAAQPGGDVARGGGGVGGGGCPGAVHGPGAGGERAAGGAGLGPAGAGPRRRGARGAAVAGGGPRRGGRVRGGAAAGGRRVRRGGHHHPRAGARRRGGAGAGGAQPQRQRGPPRRLRGPPGAVGAGRGGAAAGLRRRSRHPGR

SEQ ID NO: 30161 - protein, 216 aa, Kineococcus radiotolerans SRS30216
MEQAHAEAFERLTPQQRRQVLEQLSAVVPASEQHGDDPRSLARAATRAEVRQPGTLVQIFNGPGGGYGGGGYGGGFGGGGYGRGGGFGGGFGGGGMGMGLGGSLLAGVAGAFVGTAIADALIPDDFGNEHWGDDQAYEAGEQQGYDEGYQDGEQQDGDQGGDQGVDTTDVGYDGGGYDEGLGQGFDQGGYEPSFDDGGFGGGGFDDGGFDGGDVDV

SEQ ID NO: 30162 - protein, 1000 aa, Kineococcus radiotolerans SRS30216
MCVPPDGERPRTGGCGAVRGRVSGQARGEVVVEAAEELLGGLPGLVRPDEQREVLGHLAALDGLDDDVLEGLGEAGDLGGGVQLAAVGQPAGPGVDRRDRVRRRRLALLVLAVVAGHGAVGGLGLHHGAVRGGQHRGHQPQRAEALRDGVGLDVAVVVLAGPDVAALPLQGRGDHVVDEAVLVGDPGLGEPVLELVLEDLLEDVLEPAVVGLEDRVLRGEVHRVVARQAVVERGAREVDDRGVEVVHRQRDAGAGGLEDLVLDGLGAVLGGEGHREGARAGELEVGRAVLVAVGVAADDDRLGPARHQARDVGDDDRLAEDHAAEDVADRPVGRAPHLLEAELLDARLVGRDRRALDAHPGPLDGVGRVDRHLVVGGVAVLDAQVVVLQVDVEVRVDQAVLDELPDDPGHLVTVELDDRSLDLDLGHCAVPSDCARLCLDVKLPPAPRHVRSRGRGGSPEPVRCGAVSSLETPHDLRTTAGQVAALHDRTRAAVQAADERAAAKQHPRGKKTARERIAALVDEGSFVERGGFVRSRATAFGMAAKHVDGDGVVTGYATVEGRPVCVYAQDFTAFGGSLGEEHGAKIAELQDFAATTGCPVVGINDGGGARIQEGVASLVQYARIFRRNVHASGVVPQVSLILGPSAGGAVYSPALTDITVMVEETSHMFVTGPDVIRTVTGEDVGFEELGGGRTHATRSGVAHHLAESEDEAIAYVRELLGYLPSNNLSEPPLLAPEHPRDLHVDEHDLVLDSIVPDSPNQPYDMTAVIAEVLDDQEFLQVHELFAPNVLTGFGRVEGRPVGVVANQPSQLAGTLDIDASEKAARFVRLCDAFNVPVLTFVDVPGFLPGTDQEWNGIIRRGAKLLYAYAEATVPLVTVITRKAYGGAYIVMGSKEMGADVCLAWPSAQIAVMGAQGAVNILHRSTLKAAADAGEDVEATRRGLVEDYELQLANPYVAAERGYVDAVIAPSETRVQVVRALRALAAKRATLPAKKHGNIPL

SEQ ID NO: 30163 - protein, 435 aa, Kineococcus radiotolerans SRS30216
MPGPAGGTRREAGGSCGGGGRVRDARAGSGGAGVRGRRGGGVGVGPGRDRGRAGGRAGRGGAGGRPGGAGAPGAAAGGGGGGGRAGGRRVRGMGAGAGGVLGGAGGVAGAGAGPGGAAVRDRALAARGAAGAGVVGAGRAGRGGGVAGGGAGGPAGAGVGFGAGRVRGGGAAPGAGRRAAGPDGARGRGGGDGGRRAVPARAPHRGRRPGRWRAGTRRGRWWGRRGGAAVERGVRGGRAGPVLARGPARDGAAQRAGGIAVVVALGGPGHLRRAHVVRERGDGDVVGGAGGLGGRRGGRGVAGAAGGRGAPAVLGVPGAGQRGVTGGGVPAGRRHPVEGAGDLGAADPAGSGVRGDVPADPDGGRRRRTGDGRAGSRRRRPVAAGARLGAAARAGPGPGAGRRRRGRRGGGRAGGGGAPALGGAVLAGRTRARGG

SEQ ID NO: 30164 - protein, 250 aa, Kineococcus radiotolerans SRS30216
GAHPRRGRGRARRARAQHRLPRPARRAAAPARGRVRGGPLRAAGRRRRGGGLGAGAPARGPSGPQRWAGGRRRGLRQPGAAAGERFRAGPRARARPPRPRPRAGPAGAARERRGARRGGGAAVPARGRGVLAAPAGERPPRRGGAGTRWARCGSGGGGAGGGGGGSAGGGAGGVGGGGRGGVGGAGGLGGGAGAPRTGVGGRGAGGGGRGERRGAGGAGRAGGRGRPGTGGRGRGRGAPLRGPLGAGAGG

SEQ ID NO: 30165 - protein, 327 aa, Kineococcus radiotolerans SRS30216
METVRGVSAFVGRWFALIVLAAGAVALAFPPAFAGWSPAVPWLLSVIMLGMGMTMRPADFAIIGRRPWALLLGVAAQYTIMPLLGFGVAHLLGLSAVLTAGMILVGAAPGGTASNVMVYLAKGDTPLSVAMTSVSTLIAPVLTPLLVLALVGESLPVDGWAMFRSILQIVLVPVVLGLLLRLLLPRVVERCLDVLPLLSVLGITAVVLAVVAGSASTLLEVGLVLVLAVVLHNVGGLALGYAVGRATRMPVASRRAISIEVGMQNSGLAAALATVYFAPAAALPAAIFSVWHNVSGSLLATRWSRRPVPVADVSALEAQGADGSRAR

SEQ ID NO: 30166 - protein, 121 aa, Kineococcus radiotolerans SRS30216
MPPLDPALAARLKRTDTGLVCAVVQQHDTREVLMVAWMDDEALASTLATGRATYYSRSRRSLWRKGDTSGHVQWVKRVSLDCDGDALLVEVDQVGAACHTGDRTCFDASPLPVRVGSRAEA

SEQ ID NO: 30167 - protein, 492 aa, Kineococcus radiotolerans SRS30216
MVHGAGGGRPERGPGGAAAPAAGGLRRRVPGGGGRGPAGADRPGRGRVRSGGAAAPARPHRRGPAGGAAGGGPPPRPARAGSPRRRRPRSRGPGGPAVPGPRTRGSRAPGGGPAARAGRRRGRRRRRRGRGRLLTPPGTGRGRGGGRDRRPRGDGAGLRPARQRAHVGAAGPGRGRGPGGADGVVGARGAPGGARGGPGGGRAGAGRRRRTAAAAGGGGRPGGGARARGAGAAGGGRRRGGGGRRLPRPGRAGAHRRPHHRPAGARGDRARRGGLPATGGGPGAGRRGGLRGARGPVDERARGDRGSGARGGWDGHGDLAYRGRVSPAFTLRTAGPADGASIAELVRELAEYEREPDAATATADDFARALAPGTGIGCVLAEVETDHGVEVAGMALWYTTFSTWLGRQGMWLEDLFVRPQHRRAGIGRAFFAELGRVCAERGFGRLEFWVLDWNTSAHDFYRALGARPEEDWTVWRVDGRGLDALGSPPDRM

SEQ ID NO: 30168 - protein, 375 aa, Kineococcus radiotolerans SRS30216
MAGGDAGRPRRHPDRSRQRALPVPVDGPDGRHRFHDLQRPGRAVNAPTDSAVLEGGRGAANRAVRFRRYGGPEVLEVLAVPRPVATPGTVVVEVVSAALNPGEIGIREGAFALMWPATFPEGQGNDFSGVVAEVGPGVHGVQVGDAVLGFTPRAAQAQFVLTSPDRLAPLPPGLGWDEAASIAGAGATAWAAVRAVDPRAGETVLVSAAAGGVGVVATQLALLRGARVVGTVGEANEEFLTSLGAVPVRYGPGLLERVRAAAPQGLDACVDTFGPPNAEVALALGVPAHRVNTLADGRAVQRYGVRHEAQEQADTPQVWSELAQLVAQGRLHIPIAATYPMTEVAQAYRDLGARHVRGKRVLHIASAAGRAELTR

SEQ ID NO: 30169 - protein, 313 aa, Kineococcus radiotolerans SRS30216
MENPPGAEEEHQVTWHRRTPVDLRAGLILRAGGAGDVHAELPVHVAGEAGAVEPGGGGAAVDVGHAGVVVGHLEDALTQRGGGRSGGGGRDDGRDHRGGLDHEGGRGDAGGHDRDGVGGAGRPLDGRGGDDGGHDDRRGGRGGGEGGGGREDRRRGRGGDDAGGGGAEGRGDCGGRRGEGGADGGGGGARRGARGEGDGDEEPAGGGDDGTGAGGAAGGAGDAVGQVGQGGANTSGGAVARLDASRQGGGLSDACEVSCRVRAGVSPGRFAPASPQGLDRTWWSGVARETWFPHPCHECSRGTSTWWQGSAST

SEQ ID NO: 30170 - protein, 328 aa, Kineococcus radiotolerans SRS30216
MRFHDFGGPEVLRHEDVEPPVPGVGQVRIRVAATSFNGLDVTLRAGDLRDRSPLRLPHTPGLDVAGTVDALGPGVDEISIGDRVVGLLPMTAPGAAAQHVLAPAQVLAGVPRRLPLTDLAALPLVGLTAWQALFDHGGLMAGQRVLINGVGGAVGGYAVQLAVETGAQVLVTARPSSTVRVKAAGSDEGTVHTLDHALDHALDHTLDPALVDVAHAVVEPVDLVLNLAPTGAKQLAAMVPLIRDGGRLVSTTAWIPTPCDEERGVQGVNLSVRSDADQLADLVARVSTGELLVNVAERVALADLPALHARAHAGELPPGKVVVLIPPA

SEQ ID NO: 30171 - protein, 404 aa, Exiguobacterium sp. 255-15
MGLTTTGLDVARQIEVQRGFFKTGATRSIAFRLSMLTFLKQAIETHEEAIYDALKVDLNKGRQDAFTTEIGFVYGEINRMEKQLRRLAKPRRVKTPLLHFGSKSEIRFEPYGNVLVIAPWNYPFQLALAPVVGAIAAGNTVVLKPSELTPNVSRVLREVFETAFHERFGVVIEGDAEVSTAVLEEKFDYIFFTGSTRVGKIVHQAAAKHLTPVTLELGGKSPTIIHKDADLRLAAKRIAWGKWLNAGQTCIAPDYVFVHRDVQETFLRLIEEEAFSQYGNGVGVGSYVKIVSDGHLERLTGYLEQGNIEFGGQVDPETRKMAPTVMTNVPLDSKLMQEEIFGPILPVLVYDEIEDVITFVTDRDKPLALYLFTENEFVKERVLNRISFGGGCVNDTLMHVAQHN

SEQ ID NO: 30172 - protein, 234 aa, Exiguobacterium sp. 255-15
MSNFTSELIGTMILILLGDGVVAGVVLRKTKSENGGWIVITFAWGLAVMTGAYIAASSGAHLNPALTLALAMNSDLPWADVPVYIAGQLIGAFIGAVLVWLHYMKHFEATDDQAAKLGVFATGPAIRHTPSNLISEIIGTFVLVFGILSFGLTTFGDGLKPFIVGLLVVVIGLSLGGTTGYAINPARDLGPRIAHAILPIKGKGSSDWSYSWIPIVGPIIGGGVAVLLYQLLQN

SEQ ID NO: 30173 - protein, 240 aa, Exiguobacterium sp. 255-15
MIQVTDLYKQFGKLEVLKGITTTVGRGEVVAVIGPSGSGKSTFLRCINLLEQPTSGTINVDGFELTKPKANIAKARQNIGMVFQQFNLFPHKSVLDNLIYAPINVLGLSKDAAVKRAEVLLERVGLAEKRDNFPNQLSGGQKQRVAIARALAMEPNVMLFDEPTSALDPEMVNEVLDVMKQLAESGMTMVIVTHEMGFAKEVADRVLFLDEGILMEEGSPVELFDHPKTDRAKKFLEKVL

SEQ ID NO: 30174 - protein, 449 aa, Exiguobacterium sp. 255-15
MTTVRFDYSKALQFVGQHEVDYMADTVKTLHGAIHNGTGAGSDFLGWVDLPTNYDKAEFEKIQAAAEKIKSDSDVLLVVGIGGSYLGARAAIEMLGHSFHNLLSKEERKAPQIIYAGHNISSTYLHDLFQVLEGKDVSVNIISKSGTTTEPAISFRLLKTFMEDKYGKAGAKDRIYATTDKARGALKTLADSEGYQTFVIPDDVGGRFSVLTPVGLLPIAAAGISIEELMAGARDAQVQFSNENLAENEAYQYAVVRNALYAKGKTIELLVNYEPALHYVSEWWKQLYGESEGKDFKGIFPAAVDFSTDLHSMGQYVQEGRRDLFETVIKVGQARHALTIEKDAQDLDGLNFLEGKSIQFVNDKAAEGTLLAHTDGQVPNLTVELPEMTPYHLGFLFYFFEKACAMSGYLLGVNPFDQPGVEAYKKNMFALLGKPGFEAEKAELEARLK

SEQ ID NO: 30175 - protein, 310 aa, Exiguobacterium sp. 255-15
MNKSVKLGKSNLTVNPIGLGTNAVGGHNLYPNLDEQAGRDLVRVALMNGINFLDTAYIYGPERSEELVGEVWSETVEREEVILATKGAHQLVDGKVVMNNSPEFLKQAVEDSLKRLRTDYIDLYYIHFPDEDTPKDEAVAALAELKAEGKIRAIGVSNFSLEQLKEANKDGHVDVYQGEYNLFKRDAEKEILPYIREHGISFVPYFPLAAGLLAGKYDAETKFDDLRKNDPLFQEDVFKDNLAKVDLLRPIAEAKDAEVAHIVLAWYLAQDGIDAIIPGAKRADQVTDTIRTLDVELTEDEIRQIDHIFS

SEQ ID NO: 30176 - protein, 296 aa, Exiguobacterium sp. 255-15
MNETERTVILAALKQKTVTLPDQTHVRALGQGTWRMGEDQSKRQAEIEALHVGLDSGMELIDTAEMYGEGASEQLIREVLKERRDDVFLVSKVYPHNAGGEKLRAACEQSLKNLGTDYLDLYLLHWRGSIPLQETVDGLEQLKAEGKIRRWGVSNFDVSDMKELLSLRNGDQCAVNQVLYHLGSRGIEYELMPLLKQHGIPVMAYCPLAEGGSLRDQLLDHPTVERLAEEHGVKPAQILLAWAIRSGDVIAIPKAGQAKHVEENGKAALVELTDEEYAALDEAFPAPTKKEPLDIV

SEQ ID NO: 30177 - protein, 452 aa, Exiguobacterium sp. 255-15
SLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 30178 - protein, 218 aa, Exiguobacterium sp. 255-15
MIKIAPSILSADFANLERDVKAVKAAGADYIHFDVMDGQFVPNISFGLPVLSSLRQKTDMILDVHLMIDRPENFVEAFVEAGADIVTFHVEATNHVHRVLQQIKAAGAKAGVVLNPHTPLSMIEHVLEEVDMVLLMTVNPGFGGQAFIPGVMKKLSQLAALKAEHDLSFEIEIDGGVNAETAKLCIENGANVLVAGSAIYNAPDYSEAITSIRNAAHV

SEQ ID NO: 30179 - protein, 479 aa, Exiguobacterium sp. 255-15
MIYDAQEARQIDEWAKTSGLPLEVLMERAGSEIAKRIKNRHTREERILVMCGTGNNGGDGYVIGRELVRDGYDVTMHAPFGEVKTATAHLHQHYAENFGLATEAVCGQYDVIVDGIFGTGFDGSRLTKSIHDVFDWVREQKQQGAKLYAIDIPSGIPSDQTNGFSGQAIRADVTFSLHAFKRSAFLLKTAPFFGKLEKIDLGLPAFGGWQLMSESIAPLLTRDPYGHKGTYGTALLIGGSETMPGSIQLAARAALRSGVGKLQVATVPTAQVGLIMNAPEAMVLNQTTTAIQEMLDQVNVAGIGPGLTSDSISDWIELLFAQDIPVVLDAGALIRDSYPERKAEIVVTPHIGEFARMTKRTVREIQDDLFGQASEYAVLHQVIVVLKAHVILIATPEGGGYVINGASSGLAKGGSGDTLFGILTSLLGQKEYFKHIPVEQLIALGASWYAQASKQVEQQLHPSSIVATDVIDQLGRVKN

SEQ ID NO: 30180 - protein, 159 aa, Exiguobacterium sp. 255-15
MNTSLYEIEVQDATGQTVSLNDYAGEVLVIVNTASKCGLVKQLGDLQQLHDKYADQGVKVLGFPCDQFNNQEFADQQETMQFCQRNYGVTFPMFQKIDVNGPAEHRLYTYLKQQQGGLLSSNIKWNFTKFLVDREGRVVKRFAPVDSIQTIEKTLARYV

SEQ ID NO: 30181 - protein, 293 aa, Exiguobacterium sp. 255-15
MTKTIGFIGLGVMGQGMVRNLLKAGFSVKGYNRTKEKGLPLEQDGAVIVDTIQEAVTDVDVVISIVGYPQDVEEIYLAEDGILASANPGTIVIDMTTSSPALAIRIAEQAAQTGLHALDAPVTGGDLGAKNGTLAILVGGEEAAFDTVKPLFEAMGKSIARFGGPGQGQSAKLANQIAIAGSMIGTAEMLLFVTKSGIDPTQFVATIKSGSAGSWSLENLIPRVIAENYSPGFFVKHFIKDMRLALERADEMGISTPGLALVKDLYEELAASGHAESGTQALYLLLKEKTPSR

SEQ ID NO: 30182 - protein, 248 aa, Exiguobacterium sp. 255-15
MISLQNVSKAFSGQPVIQSVALSIEQGEIHGIIGASGAGKSTLLRLMNLLERPDTGRIEFDGMDLTNLSNRQLRQTRQNIGMIFQDFNLVGNKTVEQNIAVSLELSGVKKREWTNRIEECLRFVGLESFARKYPSELSGGQKQRVAIARALANRPRVLLCDEPTSSLDPSTTSEILRVLQNINQALGVTIVLVSHEMQVIQSICNRVTIMADGQIETTIATEPAGITEITSDAGWFLTQLTERRDPHA

SEQ ID NO: 30183 - protein, 504 aa, Exiguobacterium sp. 255-15
MLLLLPLLLSIGIFPQTSEAAGWEKERMYFIMVDRFENGDKSNDLEANPDDPKAFQGGDLAGVTKRLDYIKDQGFTSIWLTPIFKNRPNGYHGYWTDDYYEIDPHFGTKEEFKTLVKEAHKRDLKVVLDLVVNHLGPNHPLVKEKPDWFHKEQTIMNWNNQAEVENNWLFDLPDFNTENKEVVKYLVDVANYWVDETGIDGYRLDTVRHVPPAFWKTFIPAVKKEHPDLFLLGEVFDGDPRKIAIYSKLGFDSVTNFPFYYGIKDQFARKNGSAEELDSVYNRDTTFNPKAMSLANFIDNHDLKRFITEAKIGGAADEERQLRLALFALYAAPGMPIVYQGTEVAMPGGEDPGNRMMMEFDKNDKMQEYVQTLNKMRKNYPAFETGKQRLVAKTDHMAVFERKVKDQSVLYAINLGEKKTTLRVKASEIGDDQRLRGLLFSDVVRQDGDAYEVTLDAGSANGYVVEHSQVNWMSLVAIGSIAPILALIILFVHRRRINRTKETH

SEQ ID NO: 30184 - protein, 494 aa, Exiguobacterium sp. 255-15
MQQHTKSSLNTDFTKIFINGQWRKGASDSNMTNTNPFTGETLFEISAANNDDLDDAYQSAKVAQKEWAKVPALKRQGLIEEFLKVMYEEKETIVNWLIKESGSTRIKAEGEFLASVLIVKEAATFPLRMHGEIRPSVVPGKENRIYRKALGVIGVISPWNFPFHLAVRSIATAIAIGNAVVVKPATDTPVSGGLIFASLFEKAGLPKGVLNVIVGRGSEIGDSIVEHPVPRLISFTGSTEVGRHIGELAGKHLKKTALELGGNNVFVVLDDADLDRAVESAVYSKFYHQGQICMSTNRILVAQSIHDEFVEKYVARVKELQFGDPSNGRTQVGPLINQSQVDRIMEEIEKTKAAGATVRVGGEADGNVIAPTVVTGVTNDMPLAKNEIFGPVAVIIPFKDDAEALELANSLPYGLSGAVHGSSIERATEFALQVETGMIHINDQSVNDEPHMPFGGEKDSGLGRFNGEWVLEEFSTVQWLSVMHERRQYKPFFE

SEQ ID NO: 30185 - protein, 274 aa, Exiguobacterium sp. 255-15
MSPVLAEFLGTALLVAFGNGVGAGVTLSKSYAKDAGWIVITLAWGFAVALSAYAVGQFSGAHLNPAVTLGLAFDGSFAWADVPGYIVAQILGGIAGASIVFVHYLPHWAETKDPAAKLGVFATSPAIPHTFANVMSELIATFLLVIGILSIGANTFSDGLNPLVVGVLIVGLGMSFGGTTGYAMNPARDLGPRIAHFILPIAGKGSSNWGYAWIPVLGPVLGGSLGGLFYRSVFSGKDTPAFVIVGLVTIVILGLCYKFGVRPNKSTSVKSKSA

SEQ ID NO: 30186 - protein, 340 aa, Exiguobacterium sp. 255-15
MKTKLFEAIQIGGLQFRNRVIMAPMCMYSAKEDGLVTNWHVTHYASRAVGGVGGVILEATAVTPDGRISAGDLGVWSDDHIDGLRRIADQVKAAGAKAGIQLAHAGRKSTTAKPPVAPSAIGFDDSYDHPHELTVEEIDVIKQQFVEAALRVEQAGYDFIELHGAHGYLINTFLSPLSNKRQDQYGGSMENRMRFLLEIIDAIQEKSDLSLWVRISAADHAPGGMTAADYIPLAEELLKRNIDLLDCSSGAVVANAVPEVYPGYQVPYAAEIKQATGIKTGAVGLITTATLAEEIIRSERADVILLARELLRQPYWVYHAAAELKDEVSLPKQYERAPIR

SEQ ID NO: 30187 - protein, 272 aa, Exiguobacterium sp. 255-15
MTVEERLELIEQCLALGITTFDHADIYGDYTNEGLFGEALALKPELRERMEIVTKTGIKMKGNHFSDQKLSFYDTTKEHIIEHATRSLKELGVDYIDTLLIHRPDPLMDPNEIAEAFVELKESGKVRTFGLSNHTPAQQSLIQSRLPFMLVTNQLELSVAELKHFEDGSVDLCHENEMPLMAWSPLAGGRLFKDEEFAPLREKLEEIGRDIGAEAIDEVAYAWLLKHPARIMPIVGSGKIDRIESAVRSTRLELSREQWFEILKASRGRDVD

SEQ ID NO: 30188 - protein, 471 aa, Exiguobacterium sp. 255-15
MIEQNVINGVWYDTEETIPVFNPATKELLGHVPSSTADDAQRAVDAASTAFVDWSERTADDRADKIDAWYRLIQEHRDELADIMTREQGKPFIEARGEIDYGNQYVRWYAEEARRIYGETIPASVPGKRLFVEKEPVGVVAAITPWNFPAAMITRKLAPALAAGCTVVLKPSEETPYTALRLVELAIEAGIPAGAINVLTGDAATISGVWQADSRVRKITFTGSTAVGKLIMRQAADTMKKLSLELGGHAPFIVTENADLDKAVQGAIRSKFRNGGQACVATNRFYVQASVLDTFTEKFVAEVKRLKVGNGLDADSTIGPLINAKAVAKVKAHIDDAVAKGATILTGGTIDDSVGYFVEPTVLGNVTEDMICMQEETFGPLAPISVFETLDEVIERANNTPYGLAAYAFSEKIDEALRLGKKLEYGIVGLNDGAPSAAQAPFGGYKESGLGREGGVYGIEDYLEVKYLSLG

SEQ ID NO: 30189 - protein, 455 aa, Exiguobacterium sp. 255-15
MEQQGLKRDLSNRHVQLIAIGGTIGTGLFLGSGKAIQLAGPSIVFAYLLVGIAIFFVMRALGELLLSKAGYQSLTDIAEDYLGPRAAFVTGWTYWFCWIMTAMADVIAVGVYVKYWFDIPQWIPAVIALLILLGFNLLTVKLFGELEFWFALIKVVTILALIGVGIVLLVIGFNTDAGPVTVKNLWQHGGMFPNGVTGFLLSFQMVVFAYVGVELVGVSAAETADPKKNIPSAINKIPLRILFFYVGALLVLLMINPWTGLNATESPFVKTFSLIGIPVAAGIINFVVLTSAASACNSGMFSTSRILYNLGNQKQAPQSFSKLNKNHVPANALFVSTLVVSGGALLSKLLPGQAFSIVTTISAICFIWVWGVILVCHLKYKKTQPELHAASTFKAPLTPFVNYLVLGLFTLILIVMLVADETRPALLLTPVWFIGLFILYQLRTKKHQKAERHSA

SEQ ID NO: 30190 - protein, 466 aa, Exiguobacterium sp. 255-15
MLHSIGVIGLGVMGRNIALNMASRQEDVAVYNYTRDLTDDLMAHNEGLPVHPYYEVADFVQSLARPRKIFVMVTAGSAIDSVIESLIPHLETGDIIMDGGNSHFHDTERRFDQLQQHGIEYIGVGVSGGEVGARTGPAIMPGGTKEAYEQVAPILTKIAAQVNGDPCCVYIGPKGAGHFVKMVHNGIEYADMQLIAEAYSFLRVRLGLDVEEIADVFASWNEGELKSYLIEITADILRKKDDETGLPLIDVILDQAGQKGTGKWTSMQSIDNGIASSIITEALFARYLSAVKEERVAAATVLGGPEARETLDKDVWIERIRQALYMGKIAAYAQGFTQYRTSSELYDWNLRLEEIALIFRGGCIIRADFLNVISEAFAKDESLANLMLAPYFADKVQDYQTALRQVVAESSLSGLAAPCLSTSLTYYDSYRTANSNANILQAQRDYFGAHTYARTDREGTFHTEWQ

SEQ ID NO: 30191 - protein, 457 aa, Streptomyces clavuligerus
MGEAARHPDGDFSDVGNLHAQDVHQALEQHMLVDGYDLVLDLDASSGVWLVDAVTQKRYLDLFSFFASAPLGINPPSIVEDPAFMRELAVAAVNKPSNPDLYSVPYARFVKTFARVLGDPRLPRLFFVDGGALAVENALKAALDWKAQKLGLAEPDTDRLQVLHLERSFHGRSGYTMSLTNTEPSKTARFPKFGWPRISSPALQHPPAEHTGANQEAERRALEAAREAFAAADGMIACFIAEPIQGEGGDNHLSAEFLQAMQRLCHENDALFVLDEVQSGCGITGTAWAYQQLGLQPDLVAFGKKTQVCGVMGGGRIDEVPENVFAVSSRISSTWGGNLADMVRATRLLETIERTQVFDTVVQRGKYFRDGLEDLAARHPSVVTNARGRGLMCAVDLPDTRTRNEVLRLMYTEHQVIALPCGGRSLRFRPALTIAEHEIDQALQALASSVTAVAESV

SEQ ID NO: 30192 - protein, 388 aa, Zea mays
MATAGKVIKCKAAVAWEAGKPLSIEEVEVAPPQAMEVRVKILFTSLCHTDVYFWEAKGQTPVFPRIFGHEAGGRLKILDFASIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 30193 - protein, 381 aa, Oryza sativa (japonica cultivar-group)
MGCFAFKSKAKNQRAAASGARSPAPTSDGQKSKASSASTPTRSIQELSDERGAQRLRVFDLDELSSATNGFSRALKIGEGGFGSVYRAFFRSAAGGGGGRVVLAVKRLNQRSLQGHKQWLAEVQFLGVLEHPNLVRLVGYCAVDSETSKHRLLVYEFMPNKSLDDHLFNRAHPPLSWRLRLQIMIGAARGLDYLHEGLQEVQVIYRDFKAANVLLDADFKPKLSDFGLAREGPTEGKTHVSTAVVGTHGYAAPDYIETGHLTTKSDVWSFGVVLYEILTGRRSLERSRPAEEQKLLGWVRRHPPESQSFRSIMDPRLGGRYPAAAARQVARLADRCLVKNPKERPAMREVVEELERVLQMEPPTTTAADKDGDRRLPPAKR

SEQ ID NO: 30194 - protein, 115 aa, Oryza sativa (japonica cultivar-group)
MPQLSLTTNVPVDAVVAADIIKDCSKALARIIGKPESYVMVSISGSVPMSFAASEEPAAYGELMSIGGIGPGVNGKLSAALAEILETKLSVSRSRFYVKFDDVKGFNLGFNGSTF

SEQ ID NO: 30195 - protein, 440 aa, Oryza sativa (japonica cultivar-group)
MRRHHLLGLLRRAAASSTSAASSRAGPHPSLHAPGPLRNGGSAPRFFSSRGGAGAASKGLGDDEVELYSLLLGVSIGDEGEASSRGPAASRGGRRGRNSKRQPPRSRFDGDGVGCSKDGKLSWGYSSFQGRRPSMEDRLSIKSTTVNGETVSLFGVFDGHGGPRAAEYLKKHLFKNLVKHPKFLKDTKLAINQTFLKTDADFLQSISSDRYRDDGSTAVAAILIGNRLYVANVGDSRAVALKAGKAVPLSEDHKPNKKDERKRIEDAGGIVVSDDIWRVDGILAVSRAFGNRLMKRYVKAEPNIQEKVVDEGLEYLVLATDGLWDVMRNENKDAVSLLKAQDGPKAAAMKLTEVARSRLTLDNVTCIVLQFHHGKSTNSKDMTMHMTKMIPMDMVVNRYRRLFGPFLYMSTPLLIASVLSPFIVHNRLLSLQTSLRESSR

SEQ ID NO: 30196 - protein, 412 aa, Oryza sativa (japonica cultivar-group)
MGFVRALFLLAMVCVAAHAKDYPKEEGAKAEGPAAASGGGGGSTHDVVKLGGKGDGKTDSTKAVNEAWTAACAGTGKQTIVVPKGDFLTGPLNFTGPCKGDIVIQLDGNLLGSTDLALFKSNWIEIMRLESLEISGKGKLDGQGAAVWSKNSCAKKYDCKILPNTLVLDFVNNGLISGISLVNPKFFHMNVFKSKNITIKDVTITAPGDSPNTDGIHMGDSSKISIIDTVIGTGDDCISIGPGTEGVNISGVTCGPGHGISVGSLGRYKDEKDVTDVTVKNCVLKKSTNGVRIKSYEDAASVLTASKFTYENIKMEDVANPIIIDMKYCPNKICTANGNSKVTIKDITFKNITGTSSTPEAVSLLCSDKLPCTGVTLNDIKVEYSGTNNKTMAVCKNAKGTATGCLKELSCF

SEQ ID NO: 30197 - protein, 487 aa, Oryza sativa (japonica cultivar-group)
MAKDVEMAVRNGDGGGGGGYYATHPHGGAGGEDVDDDGKQRRTGNVWTASAHIITAVIGSGVLSLAWATAQLGWVVGPVTLMLFALITYYTSGLLADCYRTGDPVSGKRNYTYMDAVAAYLGGWQVWSCGVFQYVNLVGTAIGYTITASISAAAVHKANCYHKNGHDADCGVYDTTYMIVFGVVQIFFSMLPNFSDLSWLSILAAVMSFSYSTIAVGLSLARTISGATGKTTLTGVEVGVDVTSAQKIWLAFQALGDIAFAYSYSMILIEIQDTVKSPPAENKTMKKATLLGVSTTTAFYMLCGCLGYAAFGNAAPGNMLTGFGFYEPYWLIDFANVCIVVHLVGAYQVFCQPIFAAVETFAARRWPGSEFITRERPVVAGRSFSVNMFRLTWRTAFVVVSTVLAIVMPFFNDILGFLGAVGFWPLTVYYPVEMYIRQRRIQRYTSRWVALQTLSLLCFLVSLASAVASIEGVSESLKHYVPFKTKS

SEQ ID NO: 30198 - protein, 173 aa, Oryza sativa (japonica cultivar-group)
MANDSLTRSHIVGDVLDQFSNSVPLTVMYDGRPVFNGKEFRSSAVSMKPRVEIGGDDFRFAYTLVMVDPDAPNPSNPTLREYLHWMVTDIPSSTDDSFGREIVTYESPSPTMGIHRIVMVLYQQLGRGTVFAPQVRQNFNLRSFARRFNLGKPVAAMYFNCQRPTGTGGRRPT

SEQ ID NO: 30199 - protein, 213 aa, Oryza sativa (japonica cultivar-group)
MAMAAPFIAMASNMQGVVSVDGNAEKRRRTSSDALQRTVSDVSYELHHHVGAKGTTMVDDAAAAEQKQQLDDIAEVEDARCECCGMSEECTPEYIRGVRARFAGRLVCGLCAEAVAEEAARRGGAGGVEAALRAHTAVCKRFNGFGRTHPVLFQAEAMREILRKRSKLGPRSRSSINPREARQAGAAGGGGIARSSSCLPFITDEFSQRVNIN

SEQ ID NO: 30200 - protein, 392 aa, Oryza sativa (japonica cultivar-group)
MRPLYLRSSGSFKKLLLSISHRGAKNGNGDAAAKERYTPAAAAAAPESPRKPAWRCFSYEEIHRATNAFHEGNLVGKGGSSEVYRGELPDGRAVAVKRLMGAWACERRERDFLAELGTVGHARHPNVCALLGCCVDRDLYLVFHFSGRGSVSANLHDEKKAPAMGWAVRRAIAVGTARGLEYLHKGCQRRIIHRDIKASNVLLTDDFQPQISDFGLAKWLPSEWTHRAIAPIEGTFGCLAPEYYTHGIVDEKTDVFAFGVFLLEIMTGRKPVDGSHKSLLSWARPFLNEGRIESLVDPRIGGDYDGEEARRLAFVASLCIRSSAKWRPSMTEVLELLEGVEIRQERWTMPEAVEDDDDEELWRFDDLDDEDDEDEEEFNTASPSSCSSSLSN

SEQ ID NO: 30201 - protein, 316 aa, Oryza sativa (japonica cultivar-group)
MGSGNLMMKKVVRPSSFDFDIQLDKSWTEDVTCPICLDYPHNAVLLRCTSYEKGCRPFVCDTDQTRSNCLERFKGAYELPANMKVSTIAVAPLDSIHIVAPNVNNRPSCPLCRGDVIGWIVIGEARLHLNQKKRCCEEDCCSFVGNFNELQKHTQQKHPDSRPSEIDPARQVDWENFQQSSDIVDVLSTIHAQVPNGIVLGDYVIEYGDDETGEEYEVFRRVRRHWWSFMFFRGFSRSSRRRRRARARERRGSGRRNSNQAHLESFNLEVPTQSVDLREIRFDEIDDEYIVTGAIPSIATPGRMASFHYRDTRYGR

SEQ ID NO: 30202 - protein, 317 aa, Oryza sativa (japonica cultivar-group)
MGSGNLMMKKVVRPSSFDFDIQLDKSWTEDVTCPICLDYPHNAVLLRCTSYEKGCRPFVCDTDQTRSNCLERFKGAYELPANMKVSTIAVAPLDSIHIVAPNVNNRPSCPLCRGDVIGWIVIGEARLHLNQKKRCCEEDCCSFVGNFNELQKHTQQKHPDSRPSEIDPARQVDWENFQQSSDIVDVLSTIHAQVPNGIVLGDYVIEYGDDETGEEYEVFRRVRRHWWSFMFFRGFSRSSRRRRRARARERRGSGRRNSNQAHLESFNLEVPTQSVDLREIRFDEIDDEYIVTGAIPSIATPGRMASFHYRSVETVYC

SEQ ID NO: 30203 - protein, 193 aa, Oryza sativa (japonica cultivar-group)
MALLLAAFAAAATANSGAAPAASDFIRKSCRATQYPAVCVQSLASYGGAGAPPPRSPRELARAALSVSVDKARSASTYVGHICGPGGGRGGAGGAGPVRDCLENMADSVGHLRDAAQELGGNMGRAGSPGFKWHLSNVQTWCSAALTDENTCLDGLSRGVDAATRSAIRGKIVEVAQVTSNALALVNRVAPAN

SEQ ID NO: 30204 - protein, 447 aa, Oryza sativa (japonica cultivar-group)
MAGARAMAFVALCALAAFPVAVTGAQVDPLYSSKQVLDWSSQANIKLQNFSLTEEDGLQLLVRPEEVTHRKLRERTRIKKKIEPVQQDDEALVKLENAGIERSKAVDSAVLGKYSIWRRENENEKADSKVRLMRDQMIMARIYSVLAKSRDKLDLHQDLLSRLKESQRSLGEATADAELPKSASERVKVMGQLLAKARDQLYDCKAITQRLRAMLQSADEQVRSLKKQSTFLSQLAAKTIPNGIHCLSMRLTIDYYLLSPEKRKFPKSENLENPDLYHYALFSDNVLAASVVVNSTIMNAKEPEKHVFHLVTDKLNFGAMNMWFLLNPPGDATIHVENVDDFKWLNSSYCPVLKQLESVAMKEYYFKADRPKTLSAGSSNLKYRNPKYLSMLNHLRFYLPQVYPKLNKILFLDDDIVVQKDLTSTSIFQIQILLRTSILMLVAGRME

SEQ ID NO: 30205 - protein, 492 aa, Oryza sativa (japonica cultivar-group)
MSSSSSSAQLKRLKPLYQHVVNNFLVVMAAPLAVAAIVNAARVGPDELLRMVRALRPVHVFLAAFVPAAAATLYLMLRPRPVYLVDYACFRTKPNCRVPFATFLEHAKLVTYVEGASIDERSVRFMTRLLERSGLGEETCLPPAHHFIPPYRNLEASRAEVEVVIFNAIDDLLAKTGISPAAIDILVVNCSLFAPIPSFTDMIINNYKMRSDIRNVHLSGMGCSAGLISVGLARNFLQVAPHGAHALVVSTETITPNYYVGKERAMLLPNCLFRMGGAAVLLSTSRAKARFRLSRVVRTLTGAQDSAYRCVFQEEDGEGHRGINLSKDLMTIAGDSLKANITAIGPLVLPASEQLLFALSFIARRVLNRRVKPYLPDFRMAFEHFCIHAGGRAVIDELQRSLGLSDEHVEASRMALHRFGNTSSSSVWYELAYIEAKGRMRPGDRVWMIGFGSGFKCNSAAWECISPARNADGPWADSICRYPVDIPEVLKH

SEQ ID NO: 30206 - protein, 491 aa, Oryza sativa (japonica cultivar-group)
MSTAASPLLERLKAAYHYHAAVGNVRAIFITLLAAAAVAALTHLAPEEVVIGRLRELRTVHLFLAIFLPVAAATMYLMLRPRPVYLVDYACFRTAPNCRVPAATFLEYAKQVPVITDRSVRFMTRLLERSGLGEETCLPPANHYIPPYKYCTLDAARGEVDLVVFSAVDELFAKTGISPDDVDILVVNCSLFCPTPSFVDMIVNRYKLRSDIRSMDLSGMGCSASPISIGLARNLLQLAPHGARALVVSTETITPNYYVGNERAMLLPICLFRIGGAAALLSTSPAKARFRLQHVVRTLTAAEDSAYHCVFQEEDEHGNTGINLSKELMTIAGNALKANITAIAPLVLPASEQLKFALAFIARKALSGRVKPYIPDFRAAFEHFCIHAGGRAVIDELQRSLCLSDEQVEASRMVLHRFGNTSSSSVWYELAYIEAKGRMRRGDRVWMIGFGSGFKCNSAAWECISPARDADGPWATSIHRYPVDIPDVLKH

SEQ ID NO: 30207 - protein, 138 aa, Oryza sativa (japonica cultivar-group)
MPIWSSVDPVATVAQIAGVDAYGLISMVTERAEKVRRNKYECRQLAEHVETVGGLLHHVERDDPRIAAPLEKLEGTLREAVVLVSSCEASSYFRRFFRGAKIAEQFQRIKEKIDFYLQAPALPRHHLHLHHQRLLPAS

SEQ ID NO: 30208 - protein, 208 aa, Podospora anserina
MAAAAVVQIPAGATFLETFKKSFVDVPIDAEKGNAISTAEFLEAAESLTTMFDVLGSIAFSPVKTDMLGNVEKIRKRMLAAPLESQNIQDLVRNELKTKSHTATEGLLWLVRGLEFTCIALSKNIGSTEELADSFRGSYRVTLKPHHSFLVKLIFSAAMSACPYRKDFYAKLGDDEQKVQEELREYLVALDKIVNILKRFLESKEAKW

SEQ ID NO: 30209 - protein, 494 aa, Oryza sativa (japonica cultivar-group)
MSMAARFLDSLKATYQYYHRAMGNVLVAVPAAAGALVTVALLAPEAESTTVAIGRLRELIRPAHLFLAVFLPAAAATVYLVMRPRAVYLVDYACFRTAPNCRVPFATFLEHARQVPTLTERSVRFMTRLLERSGLGEETCLPPAHHYIPTYKYCTLEAARAEVDLVVFSAVDELFAKTGVSPDDVDILVVNCSLFCPTPSFVDMIVNRYKLRSDIRSMHLSGMGCSASLISIGLARNLLQVAPHGARALVVSTETITPNYYVGNERAMLLPNCLFRMGGAAALLSTSPAKARFRLKHVVRTLTGAEDSAHHCVFQEEDEHGSIGINLSKDLMTIAGNALKANITAIAPLVLPASEQLKFALAFIARKALSGRVKPYIPDFRAAFEHFCIHAGGRAVIDELQRSLCLSDEQVQASRMALHRFGNTSSSSVWYELAYVEAKGRMRRGDRVWMIGFGSGFKCNSAAWECISPARDDDGPWATSIHRYPVDIPDVLKH

SEQ ID NO: 30210 - protein, 504 aa, Oryza sativa (japonica cultivar-group)
MTMSSPPPRASKHLKSAYRLAAIAVPVVAAAVVVIVVLLRAAQLGPGELLAGRLGAARHVHLFLAALVVVPSAVATLLRLVRRPHSVYLVDYACFRPQPSNRLPFATFAEHFRLSPHIDDGSFRFVTRMMERSGLGERTYVPRGNLYLPPRTGMEEARDEAEIVVFAAVGDLLARTRIRPEEIDVLVTNCSVFSPTPSFADMVVNRFKLRGDVRAVHLSGMGCSAGLIAVEVARNLLQAAAPRGAHALVVSTETTSFSHYAGTSRSMLLPTALFRMGGVAMLLSTSRSSATTTTSRFRLAHIVRTLNAAEDRAYRCAYHEEDGDGNLGVNLSKDIVPVAGEMLKANIATVGSRVLPLSEKLLYALSLLARKVAGSRRRKAIKLHVPDFRTAFEHFCIHAGGRSVIDAVQSGLGLADEDVEASRMALHRFGNTSSSSVWYELAYVEAKGRMRRGDRVWMICFGSGFKCNSAAWECISLPARDADGPWADSIHQYPVAITTTTKMC

SEQ ID NO: 30211 - protein, 396 aa, Oryza sativa (japonica cultivar-group)
MNRLWQENLQIKPGIANAALGNRTKLHYDGSTWELWSETPRSPTPTHLHLRRPNATRHNHRLETEPKVSPVCYAGSPLSFAAASAGGNPAGEKRNPNLTNPALSPPPPPPHKHQGELAPPPPGRECKAYRGLLVGFSREGITAAAERRRNPSADDAPCDSEMGIGAAAAAVREWGPHSPLTCGPRVLSFPTALLTRPRPLSCVTAMWAPLLPPLSATYTRTQPCKNPCQFSQPTPAFPSRPLTPPPPPRKMVEHLFEDIFTVTRLDPDGKKFDRVSRIEARSEQFDMYMQLDVATEVYPMRAGDRFTMVLAPTLNLDGTPDTGFYTQAGRKTLADKFDYVMHGKLYKISEDSSSGQATKVEIYASFGGLLMMLKGDPSSAASFELDQRLFLLIRKV

SEQ ID NO: 30212 - protein, 208 aa, Podospora anserina
MAAAAVVQIPVGATFLKTFKKSFVDVPIDAEKGNAISTAEFLEAAESLTTMFDVLGSIAFTPVKTDMLGNVEKIRKRMLAAPLASQNIQDLVRNELKTKSHTATEGLLWLVRGLEFTCIALSKNINSTEELAESFRGSYSETLMRHHSFLVKGIFSAAMGACPYRKDFYAKLGDDEQKVQEELREYLAALDKIVYILKGFLESKEAKW

SEQ ID NO: 30213 - protein, 222 aa, Oryza sativa (japonica cultivar-group)
MAMAAAGDEAEMVEVTLRAVGPSRPTTLRLPPFISVADLRRHIAHDRHLPQDRLRLVLRGRNLPCQDDAHVNLRHGDSLIVAVAPKPPANHLRDGDGDDDDDEEEELKFKIPETTTWWKRKFFIFLRDKLRLPDILLMVLFSLGIKAWVLIAMWFLFAPIAQMYDVGPLFILGTGFLVILCNLGRRQQGDVSAYSIFNEDFRELPGTLNAERIDRDIRAGQF

SEQ ID NO: 30214 - protein, 407 aa, Oryza sativa (japonica cultivar-group)
MNGEAVVPEPAAAASSPAQASPSPPEWRFSQVFGERSAGEEVQDVDIISAIEFNKSGQHLATGDRGGRVVLFERTDAKDNACRKEAEKVDYSVSRHPEFRYKTEFQSHEPESLEIEEKINKIKWCQTANGALFLLSTNDKTIKFWKVQEKKVKKVSEMNLSPSNASANGRPAGSNASEVITSAEFHPTHCNTLAYSSSKGSIRLVDLRQSALCDTHSQVFEQHEAPGSRSFFTEIIASISDIKFSKDGRHILSRDYMTLKLWDINMNSGPVATFQVHEYLRPKLCDLYENDSIFDKFECCQSGDGLRVATGSYSNIFRVFGCGTGSNEATTLEATRNPTRRQLQNPTRPARSLSTLTRVVRRGAESTGIEANGNSYDLSTKLLHLAWHPSENLIACAAANSLYMYYA

SEQ ID NO: 30215 - protein, 225 aa, Solanum demissum
MVKAIIAPSMLSSDFANLASEAERMLNCGADWLHMDIMDGHFVPNLTLGAPIIESLRKHTKAYLDCHLMVTNPLDYVEPLGKAGASGFTFHVEASRDNWQELVQKIKSKGMKPGVSLKPGTPIEEVYPLLDGENSVELVLVMTVEPGFGGQKFMPEMMDKVRTLRKKYPSLDIEVDGGLGPSTIEAATSAGANCIVAGSSVFGAPDPAQVITLLRGSVEEAQKRS

SEQ ID NO: 30216 - protein, 352 aa, Dendrobium hybrid cultivar
MENEKKGPVVVTGASGYVGSWLVMKLLKKGYVVRATVRDPTNLTKVKPLLDLPRSNELLSIWKADLDDVEGSFDEVIRGSIGVFHVATPMNFQSKDPENEVIKPAINGLLGILRSCKKAGSVQRVIFTSSAGTVNVEEHQAAVYDESCWSDLDFVNRVKMTGWMYFLSKTLAEKAAWEFVKDNDIHLITIIPTLVVGSFITSEMPPSMITALSLITGNDAHYSILKQVQFVHLDDVCDAHIFLFEHPKANGRYICSSYDSTIYGLAEMLKNRYPTYVIPQKFKEIDPDIKCVSFSSKKLLELGFKYKYSMEEMFDDAINTCRDKKLIPLNTDQEIVLAAEKFEEVKEQIAVK

SEQ ID NO: 30217 - protein, 449 aa, Chloroflexus aurantiacus
MTTHTETARLPTDYMPGPVPGPRAQELVARDHTVIAPLGRVYPLVIDHAQGCEVWDVDGNRFLDMNAGIAVLAAGHCHPRLIQVAQEQLQRFTHMAGTDFYNEPMVRAAEKLVSLMPGGKDWQVFFTNSGTEAVEASIKLARYATGRQNIIAFYGAFHGRSYGSLSLTASKPRQRQGFFPLLPGVSHTYYPNCYRCPINLRFPECDIACLDLIERTLFKTTTPPEEVAAIIIEPIQGEGGYVVPPPGALARLRSICDRYGILLIVDEVQSGVGRTGKMWAFEHEGIVPDIVASAKGLGGGLPLGAMIARSELARKWQPGSHGNTYGGNGLTCAVAYELLTMVEEELMDNAATVGAYLLEQLQALQQRFPQIGAVRGRGLMIGVEFVDSQGNPAGALAEAVMVESFRKGLLVLTCGASTIRFCPPLTLTKAQADEAVARFALAIEACLTA

SEQ ID NO: 30218 - protein, 267 aa, Chloroflexus aurantiacus
MLPTILRLITILVPGYAAICGVIYTFQERLIFFPDRDPPGTHYEFGIPVEEVLIPVEGAQLHALWFRRSQAKGVILYFHGNAGSLRTWGEVAPELVQYGYEMVMVDYRGYGQSTGTIQSEAELHADAAAVYEWVRQRYPEEQIVLYGRSLGSGLATRLAAVYQPALLILESPFYSVEAIARRQFPWVPPFLLKYPLRSHEWIGQVRCPVVIIHGTNDSVVPFADGERLAREVRAPLAFYPIVGGDHNNLMTFSMYHHAIQVALKELP

SEQ ID NO: 30219 - protein, 462 aa, Chloroflexus aurantiacus
MSNDIRFPSDFLWGAATAAYQIEGAWNEDGKGESIWDRFVRRPGVIANGDTGDIACDHYHRYEEDLDHMAALGLKAYRFSISWPRIFPTGSGQPNQRGLDFYRRLIDGLHRRHILPVATLYHWDLPQALEDRGGWTQRDTALRFAEYADYLFRTIGGEVALWATHNEPFIQAFYGYGNGENAPGKRVPWRVLAVVHHLLLSHGLAVSAFRAARPQAVRSDMPSPQIGIVLMIWPQYPASQRIADQKAAQRIDGIMNRLFLEPLFCRRYPADMIDHFARRLVFAPIQPGDFEIIGQPIDFLGINTYTRLLNAFTWREPFTMAKQVPGPLPKTAMGWEIYPDCIVEALQKARSYTSLPLYITENGAAFDDPAPGPSDQVVEDPQRVAYLQSHIEACRRAIAAGIDLRGYFVWTLLDNFEWAKGYSKRFGIIYTDYTTQRRVWKRSAFVYRDIIARNGLFGNESS

SEQ ID NO: 30220 - protein, 283 aa, Chloroflexus aurantiacus
MQGKTVIVTGANSGIGYVTARELAAMGARVIMVCRSQSKGEAARQRIMQEAKGAPEPELVLADFASLASVRRAAGDILERCPRIDVLVNNAGLFVSEPLASADGYEMTFAVNHLAPFLLTNLLLERIIASAPARIINVSSFAHVAGRIAIPQIASPQRPNIAQAYSDSKLCNILFTNELARRLQGSGVTANSLHPGAVATNFAADSRGLFAFFFRLARPFMLSPEHGAATSIYLASSPEVAEISGQYFVRKKPVKPSAAAQGAALAKRLWEFSEQLVREKVAA

SEQ ID NO: 30221 - protein, 489 aa, Chloroflexus aurantiacus
MIGGEFVPAQSGKTFERRNPADTRDVVGIFADSDERDVHAAVEAAKAAFPQWSKVPAPKRGEILLRAAELLQARKEQYSRDLTREMGKPLFEAGGDIVEAIGMAQYAGSEGRRMHGVTTPSELPNKFQMSIRQPIGVVGLITPWNFPMAIASWKMLPAIVCGNTVVIKPGEDASVSTYNLVQCLMEAGLPPGVVNIVTGYGPRAGQPLVEHPDVPVISFTGSTETGRLVYELGARRIKRVSLEMGGKNPLIVMPDADLDLALDGVLWAAFGTTGQRCTATSRLIVHRAVAKELVERIVARAQSLRVGNGLDPATEMGPLVNEKQLQRVLNYIDIGKQEGATLLCGGYRLTGGDYDYGYFIAPTVFTNVTSQMRIAREEIFGPVLSVIEVDSLDEAVAIANDVAYGLSSAIYTRDINAAFRAMQALQAGIVYINAPTIGAEIHLPFGGVKATGNGHREAGPTMLDVFSEWKSVYIDYSGALQRAQIDNAD

SEQ ID NO: 30222 - protein, 400 aa, Chloroflexus aurantiacus; identical to SEQ ID NO: 760

SEQ ID NO: 30223 - protein, 1720 aa, Chloroflexus aurantiacus
MHRRFRLALLFLILVSLLPFAQPASAASLVVNSLADTNDGACTTAPDGCTLREAILTANSNGVPDTITFSVSGTIYVQNSGLPPLSEGGTTIDAGDNHTIIVSGEQLRDASNNVIPAHGIVIASNDNVIRGLVIIRFSRGIGFTGGGSGIYLRNNAQNNLIVNTWIGHLNGSPEPNTGYGILIDGGASNNRIGTGNPTDRNVISGNTVADIGVSNNLNTTPLNGNQIVGNYIGTTVSGDADQDTTSDPGNLGGISIENYAYNTLISGNLIGGYTGANAAGIVLFSDSTSSGSPSIPRGTRITGNWIGVNPTGTVIANRIGILVSGGGTYGAINTEIGDPLNPIAGRNYIGGNTNGGIVIADTTFASGPTTIAGNYIGVALNASGNPFPVGNGTINQTSGGEGIFVGRNAVSTIIGPGNVIAGARTNGIRIRSGNTVVRGNYIGVDPTGTQTTTTTINSPTVGYGTGDAGVWIENGSSSVIGGANLSDRNVIAAGNFAVTGSGAAVLIEPCASGCSANGNTVQGNYLGVRADGNGILVGSTIVADSEGLRITNANNNTVRNNLIGGVDRGINVRMNASNNLISGNRIGVRASSSDTPGSGTTTRRDGIQLNSGTNNRIEFNLIAFTGQNNTSAFNAAHGIVVRSSNNQLFGNRLVRNGRLGFGHGIFVADNVTGVLISQNTTQDNAQDGIGLGSGANGDLAAPSFNAVTPGSPTVTGTTGCGAGCVVEIFTTSASVSDRNREGPVFLTSTTTGVGGAFSVNVTGCLGYITATVHNPTTGNSSPFSNALDVNATDACSTPTATLTVTGGSSRAVSIGSTSTYTLTLSHTSFVTRTYTLTLDSTRGWTSGPTLVELPPNGNTQLIISVAVPFTATAGDTDTTTVTARSDQTVSNPITLTTTAQAITIIPARPEVSPGQIVERTGNTVTFVHTITNTGQLVGTFSVIRPDGSSGLPVFSGTPPTGWNIQSATLSSSTLSPGATATLTIVANTPASTTLLAGDYPFSFRVRAISQQGSQTFTEQSDPATTDTVRVPVARSFSFTAQPPTSQQLTPAATVNFSYILTNTGNITDTFIITPPTGTTPASSLSFSATPATAFTLAAGQSRPITVTVTASASEPVGTYNFTVQAGVTGGSNPPANQTASGTVQVIGGGTPVFVGTPLVTPDPVLPGGTATITVTVRNGGNAAAPFDFTQTLPSGWNLISNSSTCPSPVPADTTTCTYVVEVAVPATADGGAATVTIQAIARNGGQIPPAPDSTASVNATVTVATIRNLRFDPTPLNASADPGAVITFSHTLTNTGNAPDAFTLNLSGLPTGWTATVVPTTTTTLARNASLTVTVQITVPTGISAGTTVTATIRATSQGNPAVSAEVLDSITVNAVNGAELSPGTTINSLPGATAIFTHTLRNSGSTTITYDLSVRSGDAGWSALSVNPATSPILSPGSSTIVTVTVTIPTGAAAGTSNTITVEARATGDSTLLASAENVVQVGALRDVEITPARTVIALPNTTTVITHTVRNLGFTADSYTITALQGDGHSAIATPNQVDLGPGESREIAVLLTLPAGLAADTVLSSIRVTATSRSDSSITDSIFDSVRVGLVTGVALSSDRLQGIPDGSNRVIFSGIVLENLGNATDTFDLTVSGLDSKFRASVVPTSVTLNGGAIDVGIVVTVDLPPIQPFALRHDVTLTATSRRDPDQRSSIRLSMIYLTRQAIFGEPVFIPIISR

SEQ ID NO: 30224 - protein, 487 aa, Chloroflexus aurantiacus
MLIPDWLARRAALHPHRPALIYAGTTYTFAELDRWAGAVASHLRQLVTPGARVALLSRNRPGFVAIVHAAPRTAITLVPLNTRLTAAELAFQIQDSDPALLIIEHDLLPVAREAAGNRPLIVLEELTAATTAPTAPAPPIDLDAMHTIIYTSGTTGRPKGAILTAGNHWWNAIGSMLNLGLHEDDRWLAVLPLFHVGGLSILLRGAIYGIPVILHERFDPALVRHDLDAQRITIVSLVAVMLQRLLAIDPSPFPPHLRCVLLGGGPAPQTLLEQCATRGIPVTQTYGMSEAASQAATLSPAESLIRLGSAGKPLLPVELSIVTPSGQPAAPGEVGEICLRGPNISPGYLGLPPRSPTDWFHTGDLGYLDQEGYLYVVDRRSDLIIAGGENIYPAEIEAILLSHPAIAEAGVVGLPDPEWGQRPVAAIVAQQPTTAEELIAYCRSRLAGYKVPRTIVFLHELPRTAAGKLRRHELRAILLAQMSGNDH

SEQ ID NO: 30225 - protein, 325 aa, Chloroflexus aurantiacus
MVFTAPGQPLEYRDLPVPTPQPEEVLIRVEACAVCRTDLHIIDGELPAPNLPLVPGHQIVGTIERLGERVTRWTVGQRVGVPWLGWTCGECRFCRDGRENLCDQAQFTGYTRPGGFAEYTVADQRFCFALPTDYDATAVAPLLCAGLIGYRALRLAGTGERLGIYGFGAAAHLMTQVARWQGREVFAFTRPGDTEGQRFARELGAVWAGSSTELPPVPLDAAIIFAPVGDLVPYALRAVEKGGVVVCGGIHMSQIPAFAYELLWGERVLRSVANLTREDGEAFLQIAPQIPVRTTVQTFPLTELNTALNALRQGKLQGAAVIQIS

SEQ ID NO: 30226 - protein, 373 aa, Chloroflexus aurantiacus
MGKCPECGAWDSLVEQIVTPARGTGGQRAATVGQNQPIRLRDVPLTDFQRLPVYAEEFARVLGGGLVPGSVVLIGGDPGVGKSTLLGQVAAHFAASVGPALYVSAEESAQQIRLRAERLGLTADDLFLLAETSLDLIIEHIRHLRPRLVIVDSIQTVYLPELTSAAGSVSQVREGALRLMQLAKETAIPIVLVGHVTKEGAIAGPRVLEHIVDVVLYLEGDRFHQFRLLRGGKNRFGSTNEVGVFEMTGDGLREVRNPSQVFLAERNTQSPGSTVTVTLEGTRPLLVEVQALTSHTGNAQPRRTTNGFDLNRLLMLTAVLSKRVGLPLFNQDLYVNIVGGLRIGEPAADLAVALAIASSYRNQRIASRSGLPW

SEQ ID NO: 30227 - protein, 400 aa, Chloroflexus aurantiacus
MNKKTIRDVDWAGKRALVRVDFNVPLDDQGQITDDTRIRAALPTIRYLLEHGASVVLMSHLGRPKGKPNPKYSLRPVVERLFELLPEAKEVKKTEAITGPAAEAAVAMLKPGQVLVLENTRFDPREEPNDPAMAAELAKLGDVFVNDAFGTAHRANASTEGVAHYLPAVAGFLMEKELTYIGGALNNPQRPFVTVIGGAKISDKIGVIENLLGKVDALLIGGGMANTFLLAKGLNVGDSLVEPDSVPVAQQLMARAEERGARLLLPVDVVIADAFSADAQRQVVDVSDIPAGWRVLDIGPKTIERYSAEIRAARTVIWNGPMGVFELEPFAVGTRAIAQAMAEAAANGAITIVGGGDSVAAVEQAGLADKMSHVSTGGGASLELLEGRVLPGVAALQDAE

SEQ ID NO: 30228 - protein, 389 aa, Chloroflexus aurantiacus
MRTLRIISVLVMLALLIVAGAAPAMAQEGQRNLFFYTRYPSQEATVGDTVTFKLTLGTETTPQIVRLGLRNVPNGWTATFRGDGRVIQSAYVEPNNNATFDLRIEPPADVKAGEYQMLAVATGVSQEVTLPIALTLKEKTTNPAGLSFNVDLPTLRGSPSTTFRYNVTLKNESTEEVPVSLLAEAPRGFQVDFKLSGQSITSVPFGPNESKNLSVEVRALTDVPAGTYEIGILARGGDLQATTRLVADITGQPQLLLTTPDGRLSGEARIGEQTEVKLVVSNNGSAPARNIELSASPPVGWTVEFEPKQIPELATDQVVEVTAKVQPSNQAIAGDYLVTFTARPADAAAATSEFRFTVLTSTLWGLVGIALIAVAVVGVGVAVMRFGRR

SEQ ID NO: 30229 - protein, 1379 aa, Chloroflexus aurantiacus
MFLRLMHLILAIGVLFGATIAPLSSVAFADHTPLPASVNLAGDLQSEATGGACGDWDPGCAAAAFSAQGNGVYLFVSQTIPAGSYEYKIAMGSWAENYGANFQQNGPNIPVTLGSAQSVRFYYDHKTHYIADSVRNTIYTVPGNFNDEIGCSGDWQPDCLRTFMSDVDGDGVFTFATDAIPPGNYEFKIATNESWANPNYGAFGNNVPFTVTGPATVIFSFNTATTYVGVEVRSALPQPDNNVEWDGVYHNSRDPLYRTPGGAVPAGTPVTIRLRTFHNDVTAVTLRVYDVNAGAQRFIPMSVVAANTDCYGDYGPRRCDFWAATLNEAQPNNLWYRFIVTDGSDTDYYADNTAALDGGSGRMTDDVVDFSYALMFYDPAFTSPNWARTAVIYQIFPDRFRNGDPHNDPQDGDIRYDDPVITLGWGELPEGYCRHYADATTNCPWRFDTTPPAWSPTIEGPRGRDYYGGDLAGVIEQLDYLQQLGITTIYFNPIFAAGSNHRYDTRDYYRIDPYLGNNGTFAHLVQEARRRGMRVILDSVFNHMSSDSPFFDRYSHYTTLGACESLASPYRTWFNFRTNNVPCTSDDYVGWFGFDSIPEINKSNPDVQSYFLTGANSVTRFWLRRGAAGWRLDVMGDASFPAGYWETFRTVVRQTKRDGLIIGELWQKDSTLLRHLRGQTADTTMNYRLRDAVIGLLLPGGTFDSKGFGDSGRVISPSEFLSRLASIREDYPDAAYYTLMNLLGSHDTERILWTLTPGQETRADKEFNAANLAEGKRRVQLASLIQFTVPGAPTVYYGDEVGVTGDDDPDDRRTYPWPDQGGTPDTNLLNHYRSLTELRNRYPVLAKGDFTPLLADDAAGVVAYGRKYRNKAALVLINRSSTTQTITVPVQGFLPNGVELCALFTVGNQLDETVQVVNGSIQITLNPLSGTVLISEPGADLTPPAAPTNLQVTEEGDRSVSLSWQRPSGGAQAYNIYRSPVSGGGWVKVNTAPVSGLSFTDTTVENGRTYYFVVRALDAVGNEGPASAEVSALPHYRIGWANLQWPPAISHTVSAINTTPDIYGQVWIDGVTSQPGATPGLRAQVGYGPQGSDPRGSNWVWVEATFNVDAGNNDEFKAQLQPETVGTFDYVFRYSTTNGRDWLYADSSGPFSGLPPQPGVLTVLSSGDTTPPAVPTGLQVISASPAGIVLSWNAVGDAYAYEVRRIDGNGNELIFARTTATTFTDTGVMQGATYTYDVRSLDISFNRSAFSAPVTATAELRTVTLVMNVTVPTPVEDAIGRSVYIAGFLDRLDGGLPQWNPGGVVMTQVSATQWTITFTGREGTQLEYKYTLGSWDYVEKGATCEELANRQLTLTYGTSGVQTVNDTVLNWRNVDPCGN

SEQ ID NO: 30230 - protein, 351 aa, Chloroflexus aurantiacus
MNIFLSADHHHHNPPFEILDGRVVPYAETPQRVAIILAALAEAGFAPPIVASPATIADLAAIHTADYLEYLANGSARWQAAGLSAPVFPSAWPLPGLRLRSDCPQAAAGRYTFDLSAPITAGTFTAACSAAGAALAGAAALLAGNTSAYALCRPPGHHAAAAMAGGYCYLNNAALAADYLARSQTSGDATWALRSPTVAVLDIDYHHGNGTQSIFYERNDVLTVSLHADPAYEYPYYLGYADERGAGAGEGYNLNFPLPAGIDDAGYLKALDQALQAIADYGPRYLVVSAGFDTFAGDPLGGFALITEAYRTIGRSITQLGLPTLIVQEGGYALEALGANVVALLQGVSTA

SEQ ID NO: 30231 - protein, 344 aa, Chloroflexus aurantiacus
MTIQHEIYAQPTVISELLEHGLVQAYQLAAKIRKHDIRYVYAAGRGTSEHASIYGQYLFGTLNRLPVALAAPSLFTIYQQPPNLRHALVIGVSQSGQSPDILAVIDEAQRQGALTLAITNDPASPLAQHAALHFDIAAGPELAVAATKTYTAQLTAFALLAIALADDQARLTELRRLPVALTEALQLEEVVATAASHFRTMSYCVVLGRGFQLATALEWSLKLKEMAYVVAERYSTAEFQHGPIALIEPGFPVLAVATRDAGSMYIANLLDRLRAAGAELLVLSDDRTLFAHGVTGLLIPAGIPDWLTPIVTIVPAQLFCYHLALARGVDPLHPRGLRKITRTH

SEQ ID NO: 30232 - protein, 426 aa, Chloroflexus aurantiacus [sequence omitted]

SEQ ID NO: 30233 - protein, 443 aa, Chloroflexus aurantiacus
MTLEEQYRRRFAGSATLAEKARVRFPGGATHDGRYADPFPLFMERASGPYKWDVDDNRMIDYWCGHGALLLGHGHPTIVNAIQQQAPIATHLGANHRLELEWADLIADLIPAAERIRFTASGSEATTLALRIARAATGKTTIIRFAGHFHGWHDALAPGADPDDPHRGVLPATLSSLLILPTDLDQVAATLATHTDIAAVILEPTGASYGSIPLPDTFLIGLRELTQQYGVLLIADEVVTGFRVAPGGACARAGVRPDLVCLAKIVAGGLPGGALVGRADLLDLLAHDENGPRGRIRQQGTFNANPLSAAAGIAMLRAVATGEPGAIAAARGTMLIQMLNELFASYRLRGWTAFGDGSIFHLFVDPATDLIPGEIPRNLPLATLKRGGDPQILRRLRMALHLNGVDLMRGRSGFVSAVHSEEDIRATVAAVAAAIELVMAEPA

SEQ ID NO: 30234 - protein, 238 aa, Chloroflexus aurantiacus
MLSAALSRRAAGQSLADVLGEPRLTCPVYATAAEALTQPCDVFFEYTRPDVAKANVLTALQHGCHVVIGTSGLSDDDYREIDAVATAQQRGVLAAGNFALTAVLLQRFASIAARYIEQWEIIDYARDSKPDAPSGTARELAARLGQIRSSHLSVPLEQTQGVPATRGARLNGMQVHSVRLPGYTIGLEIIFGMPDQRLSIRHDAGASAEPYVAGALLAIRRVGKLVGLHRGLDSVLEL

SEQ ID NO: 30235 - protein, 223 aa, Chloroflexus aurantiacus
MRLAPSILTADFARLGEQVATACAAGIDWIHLDVMDGRFVPNISFGPLVVRALRPLADQYGALLDAHLMIVEPERYLADFAAAGADLITVHAEATPHVHRAVQMIHNLGKKAGVAINPATPLSMVEELIDQVELILLMTVNPGFGGQTLIPSVLAKVQRLRTLLGDRPVEIMVDGGVNPTTIAACATAGATVAVVGSAVFGPQPIPDAISELRIALGEAVPGK

SEQ ID NO: 30236 - protein, 247 aa, Chloroflexus aurantiacus
MPYLTVGFPERTSTLELVPALEAAGASLFELGIPFSDPLADGTTIQRATQRALENGITIADCIATVAELRARRVAAPLLLMGYYNPLLRYGLERACAALAAAGGDGWIIPDLPLEEADDLRQLAAAHQLDLIMFIAPTTPPARISQITAQASGFLYIVSLTGVTGARQTLAGNLTDLIANVRQQTNLPLVVGFGISQPAHIAEVARIADGAIVGSALIDRLERLPPEDRVSGAAAYIRELLSAVARP

SEQ ID NO: 30237 - protein, 446 aa, Chloroflexus aurantiacus
MIRFPSPVAIRNLQQLRREPLTLLEELAARGDVVPFRVGPQMMVLVNHPDLIREVLVTQHRSFVKGRVLERAKRLLGEGLLTSEGELHLRQRRLMQPAFHRQRIAAYGDAMVAVAEARSARWQDGLVLDVSREFMAITLQIVGITLFSADTEADADEVFAAMHDLVAMFDLAVLPFADWLFALPLPPVRRFQAVKARLDAIIYRLIAQRRANPVDRGDLLSMLLTAVDHEGDGYRMTDTQLRDELLTIFLAGHETTANALTWALYLLAQYPSLAAHLAAELDTVLGGRKPTVADLPKLTYTSWFFAEALRLYPPAWLIGRRAIAPVTLGDVRIAPDTIVLLSPWLMHHDPRFFHEPYHCDPLRHTPEAQAQRPKFAFFPFGGGPRTCIGEPFAWMEGILVLATLAQRWQFLPVADHPVVLQTGITLRPRYGMQLQLRERRTVLGAA

SEQ ID NO: 30238 - protein, 444 aa, Chloroflexus aurantiacus
MSDDPRTALLHRVEADQVAFINLQFTDVLGIGKTVTIPVEELPDALDHGVWFDGSSIEGFARMVESDMYLVPDISTYAVVPWDQHQGVTTARLICSVYTPDGKPFAGDPRNVLRRMLDQAAAAGYRFMVAPELEFFLFKTDPNGNILEPHDKASYFDISTDLATHIRRQMARTLQAMGIAVEAVHHEVAPGQHEIDLRYADALQSADHLVTARVALKAVAQMNGLHATFMPKPIAGVNGSGMHVHQSLLDRDTGKNLFADPDDPYGLSALARHFIAGLLAHARGMCALLAPLVNSYKRLVPGFEAPVYISWGRTNRSALVRVPRITAGRYQATRIELRCPDPACNPYLAYTAMLAAGLDGIRRKLPLRDATEEDLFHVDPRARGLTTLPTSLGSALDALREDEVILEAIGPSIAERFLDARQQEWESYRAYVSQWEIERYLAIF

SEQ ID NO: 30239 - protein, 484 aa, Chloroflexus aurantiacus
MDYPFFHVSHYIDGQFVDGGSRFDILYPATNQVIGSAPEAGADEVDAAVAAASRAFRQWSRMPAAERRLILKRFAQLIRDHEAELAAIETWDVGRPITENRSGYIPRIAANIEFFADFAVTHGSESYPMDNGYINYVLRQPVGVAALIAPWNIPLLQATWKMGPALAFGNTVVLKPAELTPIGTWRLAQLAHAAGVPAGVINVIHGFGPNSAGALLTRHPDVKLISFTGETTTGKIIMATAAPTLKRVSFELGGKGANIIFADADLDRAVAISLRSSFFNQGEFCLAGPRLLVQRPIYEAFLTRFQRATSQLQVGDPFDPQTRVGALISREHYERVTGFIDLARADGAHILTGGTDPVLPEPFAQGNFLQPTIITDVKPHDQVCQDEIFGPVVTVVPFDDEEEAIAIANGVSYGLSAVVQTRDVGRAVRMGSALEAGTIWINDFFVRDLRVPFGGMKQSGIGREGGHYSLEFYTEAKTICLSNQ

SEQ ID NO: 30240 - protein, 498 aa, Chloroflexus aurantiacus
MSLSPIVATLLQHAETTPHRPCIVFDQHLITYADLARAVAGWAGRFHSLGINRGDRIALALPNTPAFIAAYFGAQLAGAAVVLINPQYRHTELSHLLSDSEPAIVVATTENEAFITAAMPESRPHLLKPLAELCGAPPADPGLFTPPAADEMALIAYTSGTTGRAKGAVHTHASLAANCAAISTAWRWTEHDRLLLMLPLFHVHGLGVGVHGTIRNGASLELHSRFDADVALQRMHDPAITLFFGVPTMYIRLIEAARHQGVPEHRLRLFVSGSAPLSPQTFADFASLFGQPILERYGMTETGMNLTNPYAGERRPGSVGMPFPGQEARIVDRTTGQPLPTGQIGEIQVRGPHLFRGYWRNPAATAAAFTADGWFYTGDLGFVDDDGYFHITGRSRDLIISGGYNIYPREVEEVLAQHPAVAECAVYGEADPDLGEVPVAAVVTNGQAVTAADLIEFCRMHLAAYKRPRRIHFVTSLPRNALGKVQRHLLADAVSNHR

SEQ ID NO: 30241 - protein, 209 aa, Chloroflexus aurantiacus
MIGPPGAGKTTIAGQLAQVTGMAVIATGQQLRAEIRAQSALGRYIEPLLEQGQLAPDSVMAELMRNWLQRIPIDQDCLLDGYPRSVAQAHMLETILADLGRRVDAVIVLTLDEATIVHRLSGRRICRRDDGQDITVHIDDTAKIAQCLARGGTLVQREDDHPDVIRTRLRLYEQETAPVLNYYTGRVPVHYVNADQSPAAVVALIRDII

SEQ ID NO: 30242 - protein, 445 aa, Chloroflexus aurantiacus
MKQIVVIGGGAAGVEAAVAAAQGNTKVTLVSEGPIGGRTGWDSLLPSKVWLHAAEVAGIATAAAGEGVAVNGVQVDPTAVLQRIKHVATRWSDHEQQRLQAAGVTVMQGVAAFSSPHELTIQTQAGQQTITADVIIIATGSVPRFPPTMKPDGQRIIAPRFASHLHTLPDDIIVIGGGPTGSEFASLFSRLGVKVTWLVGSPGVLPMFATNARSTLAAAMQAHGVEIHQVDVERAERTEEGVSVLAADGTTYTAAMAFLAIGRTPDLSRLNLSAAGLTVEANGQLTVDNYGRTPVNHIFAVGDAAGGPMLANRALAQAWIAGRTAADLPAPGYCPHTIVHAVYTVPEVAQVGLVMDTELSRIRAEYGSSLKSYLGAETSGWIELTFDPITRQVRGGVAVGDHAADLLAPVALAIQTGATLADLAAVFAAYPTLSETVFAAARAAG

SEQ ID NO: 30243 - protein, 284 aa, Chloroflexus aurantiacus
MQTIAYLGPPGTFSEEAALAYAAGREARLLPLASIPAVVTAIETEAATVGVLPIENLLEGSVSYTLDLLIHETNLQIAGEIVVPIRQYLLARPGLQLSDIKVLYAHPQSLAQCRRFVERCLPGVATVASLSNSAAPAEAMADERPAAAIGTLRAAELVGATILAREIADSPHNVTRFIVLAREDAPPTGDDKTSFCFGFTREDRPGSLVSALQELAVENINMTKLESRPTRAILGQYIFLVDINGHRREPHVARALERIRLHTGMLKIFGSYPRWRGANGNHAS

SEQ ID NO: 30244 - protein, 354 aa, Chloroflexus aurantiacus
MQPHLFTPLTIGAVTLRNRIGMSPMCQYSAHDGFPGDWHLMHLGARAAGGVGLVILEATAVSPEGRISPFDLGIWSDDHVEALARLVRLIESLGAVPGIQLAHAGRKASMGRPWEGSKLVPPEAGGWSVVGPTAEPFAPGYPQPTPLDAQGIAKVVADFAAATRRALAAGFRWVEIHAAHGYLLHNFLSPLGNDRTDAYGGDLRGRARLLLEVTDAVRAAWPAQLPLAVRLSCSDWTPEGLTIADTVEVARMLRERGVDLIDCSSGGIAPGISIPVGEGYQVPFAAQIRREAQIATAAVGMITRPEHADAIVRNGDADLVLLGRELLRDPHWPLRAARALGHDLAPPPQYLRAW

SEQ ID NO: 30245 - protein, 471 aa, Chloroflexus aurantiacus
MDAKGVIELIKAKGIQIVDTRFTDLFGGWQHYSLPASRLTEDMIREGLGFDGSSIKGFQAINESDMLMVPDPSTAFIDPTLSVPTLVLICDIIDPITRQPYSRDPRTVAKKAEAYLKTTGIADTAYFGPEAEFFLFSDVRFGQGANHGFYYIDSPEAVWNTGAEIPGGNKGYRIRHKEGYFPVPPTDTLQDIRSEMILKMMEIGIEIELHHHEVATAGQCEIDMRFDSLVNMADKVQKYKYIVRNVARAHGYSATFMPKPIFGDNGSGMHTHQSLWKDGEPLFFDETQYALLSKTAQYYIGGILKHAPALLAICAPTTNSYRRLVPGFEAPINLVYSMRNRSAAIRIPTYSSSPKARRIEFRAPDAMCNPYLAFAAMMLAGLDGIQNKIEPPPPLDVDIYELSPEEKGDIRSTPGSLTEALDALEQDYHFLLKGNVFTTDLLETYIETKRKEAVGLSLRPHPYEFMMYYDA

SEQ ID NO: 30246 - protein, 196 aa, Chloroflexus aurantiacus
MMPYANRLRDVADWFAQLWAESLGKAVDRQGKPARVGQTPVKALGATDQHSQVQLYMEGPYDKLINFIAVEQYAETAPIPTAYADLEGVSYLGGHTMAELIQAEQQATAIALSEAGQPNITHIFPEINAFTLGQFFMLMEMQTAIAGELYDINAFDQPGVEAGKINTYALLGRRGFEERRAAIAARAQALDSRWVV

SEQ ID NO: 30247 - protein, 242 aa, Chloroflexus aurantiacus
MKSDYGVDAPPVIRNLLIAGIASMIAGIVLQYVFASIQSLIAGILLAWGLLAGTSMVVTAFLMIWSSKVGKLQLREKLIDSLALRGTETIVDVGCGRGLLLVAAARRLTTGKAIGIDLWQHEDLSGNTPEATLANAKAEGVADFVEVKTGDMRKLPFEDNTIDVVVSSLAIHNIPTKEGREQAIREIARVLKPNGQVALLDFQCTDEYVQTLKELGWHAVNRSGLNFHMFPPVRVVTGRKPL

SEQ ID NO: 30248 - protein, 384 aa, Chloroflexus aurantiacus
MARKHPYEPLPWNDLPSVSWNFVWREPIGVCAQIIPWNYAFCMAAWKLGPALATGNTVVFKPSSLAPLSTLAIFQTIHDLNLLPKGVINLVLGPGGDVGEYLVTHPAVDKVAFTGSTEVGRKIMALAAPHIKRVTLELGGKNAMLILPDADLDLVVDGVLWGAFYHSGQLCEAGSRLLVPHALHDTLVERLVERVRGMRIGDPMDLETDIGPLISERQREKVEYYIAVGREEGATVVIGGGRPIGEAFANGHYVEPTIFTGVRPEMRIAREEIFGPVLSVIAYDEIGEAIRIANDSIYGLAASVWSRDLQHALSVVRRIRAGTVWINEHHVLNPRAPFGGYRQSGFGREMGRYGLDEYTEVKHIHVDLMQRRQGRLWWDTLLPE

SEQ ID NO: 30249 - protein, 1120 aa, Chloroflexus aurantiacus
MNRVRPAKTPTLLADDPLWYKDAVIYELHVRAFCDSNGDGIGDFPGLTSKLDYLQDLGVTAIWLLPFYPSPLRDDGYDIADYTNIHPNYGTLADFKVFIREAHRRGLRVITELVCNHTSDQHPWFQRARRAKPGTSARNFYVWSDTPDRYKDARIIFKDFETSNWTWDPVAQAYYWHRFYSHQPDLNFENPAVQRAVFKAMEFWLDLGVDGMRLDAIPYLYEAEGTNCENLPETHAFLKRLRKHMDEKYQGRMFLAEANQWPEDAVAYFGDGDECHMAFHFPVMPRLFMSVHLENRYPIIDIMRQTPPIPDNCQWAIFLRNHDELTLEMVTDEERDYMYRVYARDPQARINLGIRRRLAPLLGNHRRKIELMNGLLFSLPGTPVIYYGDEIGMGDNIYLGDRNGVRTPMQWSGDRNAGFSRANPQQLYLPVITDPEYHYETVNVETQSANQHSLLWWTKRLIALRKRYAAFGRGTLEFLYPENRKVLCFLRKTEDQILLAVFNLSRFVQGVELDLSPYRGLMPVELFGQVEFPPIGDQPYFLTLGPHSFYWFTLTPQRIEGVRLPTPQPETELVEIPVDAIEWDAIFYDGRQARLERVLPDYLRYRRWFGAKTRKIKQVQVSEFARLDYAGGPAYLTLLQVTYVEGAPETYLLPMAYAEGERADQILADQRHMVIARLRVGRRPEAGILYDPLGERRFASALLELIIGRRRLRGEAGGELVGGTTRALRKLLGGSDGLEPSLMRGEQSNSSINFGGRLIMKLFRKIELGRNPDLELGRFLTEEVGFPHTPPVAGYIEYLRGKDEPLTLAIVQGYVQNEGDAFDYALDVVRRYYDTVLTRTDVVPPVVKASVAGMLAAAHQPPPALVEELIGGYLESARLLGQRTAEMHQALAKGSGPAMAPEPFSTLYQRSIYQSIRSLIGQTLQDLRKLLPSLPATVRPAAERVTQSEEALLARLQRITGDKIETVRIRIHGDYHLEQVLFTGKDYMIIDFEGEPLRPISERRIKRSPLRDVAGMLRSYQYVAYAALYAHNGASRSAEEIERLQRWADMWSFWVCAAFLNGYLTTAGHEAFVPQDQADLEALLETFVVEKAVYELGYEMNNRPDWLPIPINGILRQIEE

SEQ ID NO: 30250 - protein, 493 aa, Chloroflexus aurantiacus
MGIAWEEKFTREGLTFDDVLLIPAESDVLPATVDVSTWLTRNIRLNIPIVSAAMDTVTEHRLAIALAREGGIGIIHKNMPIASQAEMVRKVKRSESGMITDPITLPPDRTVGDALDLMAEYKISGVPVTTADGDLVGIITNRDLRFETDRNRPIRDLMTSRNLVTVPEGTTLEEAKEVLHRHRIEKVLVVDERGKLSGMITVKDIMKRIEYPHACKDDMGRLRVGAAVGVSGDYIERATELVRAGVDVLVIDTAHGHSRGVLNAVVKLRELFPRVQIIGGNVSTAAATIALIERGVDGVKVGQGPGSICTTRVVTGAGMPQITAIFDCARAAEPYGIPIIADGGIKYSGDIPKAIAAGAHSVMIGSIFAGTEESPGELILYEGRSYKSYRGMGSIGAMQRGGGDRYFQTNVTEARKLVAEGIEGMVPFKGPLSDTVYQLVGGLRAGMGYVGAANIEALRRDARFIRITTAGQIESHPHDVVITKQAPNYGGRQ

SEQ ID NO: 30251 - protein, 474 aa, Chloroflexus aurantiacus
MTELRDFLEIPYEQLEELNLSVKRQRLARVSPDVMREERMRYLTDERRIKAVTVCFTDLEGRLHMLDYDKKFLLSSADNLTFDGSSVRGFSVQAESDLRLAIDWSAFYWLPADIFGPGKVLVFGFVLNQDGSPYEADMRGRLHRYVNELYQRDGLTCNVAAEIEGFLFKGRNAEQRFRETGEFTMVSTGGYYHSLPGDPLRQFIDMAAEAQRAMGFENEKDHPEVAPSQFEMNYSYTEATIAADQILLYKLICRQVASKLDMTACFLPKPVTGVNGNGMHTNISLSRHGENLFYDANGPERLSELAWSFIDRILNSGQELCLILNSSVNAYRRLDPHFEAPNQIKASPTDRGSMIRIPIGNARSARIEVRSIAPDANPYMAIYALLRTGLEGPLPTTDVRNGTATLPDNIYDAITNFRQSTFLASILGEGVHSRFADLKTTVADRCPRKLGTLIKRAEVQFHHEVTNQYLWSRF

SEQ ID NO: 30252 - protein, 250 aa, Chloroflexus aurantiacus
MRIPLIAGNWKMYKTVGEATTLVRDLLAGLGELSDREAIVCPPFTALAAVAALVADSPLGLGAQNLYPEAQGAFTGEVSPPMLVDIGCRYVIIGHSERRQYFGESDAFVNRKLRAALAHGLRPIVCVGESKPQRDAGQAEPIVTAQVRAALLEVPPDQMANVVIAYEPIWAIGTGDTATPADAQAMHAAIRATLAELYGSEIAATVRIQYGGSVKPDNIDELMAQPDIDGALVGGASLQAASFLRIIHYQ

SEQ ID NO: 30253 - protein, 312 aa, Chloroflexus aurantiacus
MTMTGGYSVSPNRQEMIALLRKAVELGVTFFDTAEVYGPFINEELVGEALEPFKGQVVIATKFGFKHDHNNRPTPAAGLDSRPEQIKRVAEASLKRLRVEAIDLFYQHRVDPNVPIEEVAGAVKDLIQAGKVRYFGMSEAGAHTLRRAHAVCTVTAVQYEYSLWWRRPEQDILPLCEELGIGFVPYSPLGKGFLTGKIDATTHFDSTDLRSRIPRFTSEARKANQALVDLLDEIARQHHATPAQIALAWLLAQKPWIVPIPGTTKLHRLEENIGAVKVELTSSDLQRINDAVALIPIQGARYPEELERMTYL

SEQ ID NO: 30254 - protein, 166 aa, Chloroflexus aurantiacus
MTIYQFSAQRIDGSTQSLADFRGQVLLIVNVASMCGLAPQYAGLEQLYRRYRDQGFTVLGFPSNQFMQEPRNNEAIAEFCERTYQVTFPLFAKIDVNGPNEHPLFTYLKTQLPGLFGSTAIKWNFTKFLVDRNGKPYRRYAPTDLPSQIEDDIVLLLRQQPKSLSA

SEQ ID NO: 30255 - protein, 159 aa, Chloroflexus aurantiacus
MSTWSLASHAIIIGFNARPDPAARRHAEQHGIDIRFYNIIYQLQDDLKKAMAGMLAPTVKEVVEGYAEVRNTFRLPTREVVAGVYVSDGKITRTGQNVRVLRRGVVIHDGKISSLKRFKDDVREVTAGYECGLIVEGFNDIEVGDALEFYRQETVAASL

SEQ ID NO: 30256 - protein, 353 aa, Chloroflexus aurantiacus
MVHLDHGKTKLLDAIRSTRVAEGEAGGITQHIGAYQIEVNHRKITFLDTPGHEAFTAMRARGAQVTDIVVLVVAADDGVKPQTEEAIAHVKAAGVPMIVAINKIDLPTANPDRIKQQLANVGVIVEEYGGNVPCVHVSARQKINIDGLLEMILLVADLEDLRANPNAPAVGTIIEAKLDKSRGPVATVLIQNGTLHLEDNVLVGCVAGKIKSMFSDSGKRLRHAEPSTPVEIVGLEGVPQAGDILQVMDDLVVAREIALQRQRQQRAEVMAAAARGTSLEELFGKVKQGQVKELNLILKADVQGSLDAIAHLIEQLNQSQQAVQTRIIHRGVGAITEGDVNLVPGQSRDHHRL

SEQ ID NO: 30257 - protein, 308 aa, Chloroflexus aurantiacus
MTTLLDLVGQTPLLPLHHVLDLPAGVELYGKAEWYNPGGSVKDRPALWMIRDGERRGLLRPGVRIADATSGNTGIAYATIGAALGYGVTLAMPANASIERRRILRALGAELILTDPAEGMDAAITTIRQLVAEHPDRYFYPDQYSNPANPQAHYETTGPEIWQQTDGRVTHFVAALGTSGTFMGTSRRLREYNPAIRLIAVQPDSPYHALEGVKHMASTRIVPAIYRPEQADAIVEVRSEDAFAMARHLARRAGLLVGISAAANVVAAARVAREVGQGVVVTILCDSANRYLSERFWEEPGFAEGAGI

SEQ ID NO: 30258 - protein, 470 aa, Chloroflexus aurantiacus
MSEQVYDLVVLGSGPGGYVAAIRAAQLGMKTAIVEVNALGGVCLNIGCIPTKALLHSADLLEEVKEAKRFGITVENVAFELAGAMKHKDTVVKQSTDGVAFLMKKNKIEVVAGRGRLIGRGQVHVQLNEGGERVLAAKHIIVATGGRPRPFPGIPFDGERVLSSTDMLTLKTVPSSLLAIGAGAIGVEFASMFRSFGSDVTIVEALPRIVPNEDEEVSAELTKAFQRRGIKTLAGAKVEGVDVGGEKVVVTVVDSSGKPQQIAVEKLLVSIGIAPNTENIGLEEVGVKVNNRGFIETDGFLRTSAEGVYAIGDCTANTPWLAHKASAEGILAAEHIAGHHVTPIDYGKIAACTYCNPEIASVGLTEAKARERGYQVKVGKFPFSANGKARVLGQTRFGFIKLVADAQYDEILGVHMIGPRVTEMIAEGGIALSHEATGESMMQTIHAHPTLYEAIGEAAHALVHGAPIHL

SEQ ID NO: 30259 - protein, 1840 aa, Chloroflexus aurantiacus
MSSSLGGTFVYVSNPVNNSSLSQVEFKFFKDTEQWYGKDAPNTITFGTIFTGLSTGGYDERNLRFAHTNNSVYVFKWDGNTRGVVFQLDAAPATISGVSRSPTAPTAGQAVTVTATTSGTSPVQQSFWLRYAVNGNWSASTVVQMTGSGSSFSATIPAQAAGTTVSYYVFSSANTSSIAGADADLMTINADTNGGSNYSYTVSSGTSAIAPAQSRALWLDLATIAWNGGAASSFRLLYDPDGGMTTAAETTLCTLPTPATPCYLPLTASGTVSGYSKNPNATGLTRLLTGLTTDAAWHLLRGQLVVAAYDGSGNRIDATRVQIQGVLDDLYAANATTQTLGVSYSGAVPTVRLWAPTAKTVTLRRFASSTTTTYTDHPMTLDPTSGVWSVTGDASWDRQFYLFAVEVYVPALDAVVTNLVTDPYAVSLSQDGAAANDVRSQFVNLDDADLKPTGWDTLSKPALTNPEDIVIYEVHIRDFSANDSTVAAADRGTYRAFTYDGAGPHPNTTLSDGMNHLLQLRQAGLTHIHLLPTFDIASVIENPAERSEPTISFNPATDRASSNPQAAVGATRQTDSFNWGYDPYHYGVPEGAYSSDPDGVTRIREFRELVQTLNQNGLRVVMDVVYNHTAASGQDDKSVLDKIVPGYYYRYDTNGTLYQSSCCADTATEYAMMEKLMIDTVVRFATAYKIDGFRFDLMNLHTRQNMLNVRSAVQALNLSTHGVDGSTIYLYGEGWDFGSARDKGLTVCPHCYAHKHNMTGSGIGVFNDVIRDAAHGGYSTDPVGIRRQGFINGLSYDWNGYNYPNRFQSDLHATMDTLRSALRGSGTDWNGQGNPFTDDPQEAINYVEKHDNETLFDQNVFKLPNGDGSGNPGWIGSSIPTTTMSDRVRSQNMGVSLIGLAQGIPFFHMGQDILRSKSLDRNSYDSGDWFNRVYWDRSANNFGRGLPPAWDNSSRWGIMTPLLNNTALDPTTADMNAAAAHLRETLRLRMSSPLFRLTSEADVNARVSHYNTDNSRDALLVMRLSDQVAPDLDPNWENILVFFNANKVAQSITIPNANGFVLHPLHTNGIDDDPVIATATFNDATDTFTIPARTTVVFVSTQPMEPPSSIDWVGLMYPRGGVAHAINENNFAPAGFDVFVQVYEAGVTPGPGQGAGIECYLHWGRYGQSWTDLPMTYNTDVGNNDEYRATIPKATLEALAPGTYGFTTYCKKPGEAPKWKANSYNINGNPADDDQRDGLITIIPSADSAIEPNGGVFVHLFEWRWSDVAKECTFLGQKGYTGVQVSPPNEHIVPTADLGGNPANDFPWWARYQPVTHDTTRFTSRSGTWAEFQQMVNTCNAAGVAVIVDAVINHMADIQVGTPPTGTAGTTYQSQPAGSRFYGTQYLPDDFHADCLISDYSDRYQVQYCQLAGLPDLDTGKSTVQTKLRAYLQALLNAGVKGFRIDAAKHMAAHEVGAILDGLTLPGGGRPYIFSEVIDMDPNERIRDWEYTPYGDVTEFAYSISVIGNTFNCGGSLSNLQNFTTNLLPSHFAQIFVDNHDNQRGHGPGGGCVVDHRDGRAHVLANIFTLAYPYGHPSIMSSYYWTTNPNSNAGDSLGPPSSNDGGTTWGPGLGADTRPVYGAGQSAGDYPANCAGTYPNPVTGGDLGKWVCEHRYPAIANMVQFRQTTHGEPVTNWQNIGGTPTNHIAFGRGNKGFVAINNGSVAAPTTYQTGLPAGFYCDVTKYDFQGGKCVLPGTNTPAPASALIEVNASGQIVNYTLAAQDAFAIHIDARPQYQITVQADPTGSGAVIGGGTYLHGATVTVNATPASGYTFVNWTEGATVVATTASYSFVATGDRV

SEQ ID NO: 30260 - protein, 486 aa, Chloroflexus aurantiacus
MTATAEDVLSTLPLRLLINGEWRDANNGATFAVINPANGTVLGYVPNAGVEETRTAIAAAVAAQPGWAATPAGERAALLRRVAQMMLDRQQELATIMTLEQGKPLAEARGEIAYAASFLSWFAGEAERIYGMTIPASTNAKRILVLRQPVGVVAMITPWNFPSAMITRKLGPALAAGCTVICKPAEQTPLSALALGQLFSEAGAPPGVINILTCQDPRPFADTIFADTRVRKISFTGSTEVGKELMRRSADTLKRVSLELGGNAPFIVFADADLDAAVRGAVASKFRNAGQTCVCANRIFVQRPIYAAFAERFAAEVNRLTVGDGLQPGVNIGPLIDDQARQKVERHVHDAIAAGARVLVGGGPAPLGGNFWLPTVLLDARSDMLVAREETFGPVAPLIPFDDEAEVIRMANDTPYGLAAYAFTRDVGRVWRLAEGLEYGIIGINDPIPSTAQAPFGGVKQSGIGREGGPTGIDEYLDIKYVSIGI

SEQ ID NO: 30261 - protein, 447 aa, Chloroflexus aurantiacus
MTAPAVRHIRLVTEIPGPRSRALLARRDAAVVAGLGRATPIAIASGQGALVTDVDGNTLIDFVSGIGTLAVGHCPPEVVQAIQAQAEQLIHLSALVGTYEPYVALCERLNALAPISEPCKTLLSNSGAEGVENAIKFARAATGRPAIIVFDGAYHGRTLLTLSLTSRTYFKKKFGPFAPEIYRAPFPYAYRMGMSEAEAVEQCWAAFERMQIAGVDPETVAAVLIEPVQGEGGFIPVPVEFMRRLREFCTRNGSLLIVDEVQSGFGRTGTLFAIEQFGVEPDIIVAAKSIAAGMPLAATIGRARIMDCAHYGGVGGTYGGNPLACVAALATIDLIERERLLERAKVIGQQIRARFEPLLTDDSLDPLVGDVRGLGAMIGIELVKDRRKRTPAAAEEVLAILGRALERGVLAMRAGLYVNCIRLLVPLVITDDQLDEGLEVLIGAMRH

SEQ ID NO: 30262 - protein, 132 aa, Chloroflexus aurantiacus
MRQDIDYILIGEDQIKQRVAELAAEISADYRDLGDLLLVGVLKGCAMFMVDLARAIDLPLAIDFIAVASYGASTESSGVVRLIKDLDTDISQRHVLIVEDIIDSGLIPGVPAVAIAAAQSGQSAHLHVAQQT

SEQ ID NO: 30263 - protein, 333 aa, Chloroflexus aurantiacus
MIVKGNGTIFLGGPPLVKAATGEEVTAEELGGADVHTRISGVADYFANDDREALAIVRDIVAHLGPRQRANWELRDPEPPRYDPREIYGILPRDFRQSYDVREVIARIVDGSRLHEFKTRYGTTLVCGFAHIEGFPVGILANNGILFSESALKGAHFIELCCARNIPLVFLQNITGFMVGKQYENGGIAKDGAKLVTAVSCANVPKFTVIIGGSFGAGNYGMCGRAYQPRQLWMWPNARISVMGGTQAANVLLTIRRDNLRARGQDMTPEEQERFMAPILAKYEQEGHPYYASARLWDDGVIDPVETRRVLALGLAAAAEAPVQPTRFGVFRM

SEQ ID NO: 30264 - protein, 443 aa, Chloroflexus aurantiacus
MSVVTERYSRSQADYAAAREVIPGGVNSPVRAFRGVGGIPIFFERGQGAYVWDVDGNRYIDYVLSWGPLLLGHAHPAVVEAITLQAQRGTSFGAPTELETELARLVIELVPSIEQIRFVNSGTEATMSALRLARAATGRRLIVKFNGCYHGHADMLLVQAGSGVATLGLPDSPGVPPSVAAETITIEYNDLDAAAALFANRGAEIAAVIVEPIAANMGFVLPKPGFLSGLRELTQTHGAIFILDEVMTGFRVAAGGAQALWGLDPDLTCLGKVIGGGLPVGAYAGKRQLMQLVAPAGPMYQAGTLSGNPLAMTAGLTTLRTAFGGDAGAFQQAVTRTARLADGLRMLGERYRIPVQVGNVGTMFGCYFLRQEGSQITSYAEAKAYADSQRYARFFWAMADQGIYLAPSQFEAGFLSTAHSDADIDETLAAAEVAFAGLVSSAE

SEQ ID NO: 30265 - protein, 237 aa, Chloroflexus aurantiacus
MTTASGLQYVEIQAGDGEQPQPGAIVAVHYRGMLADGSVFDSSYERGEPIRFPLGVGMVIPGWDEGIGLMRVGGKARLIIPPHLGYGAMGYPPVIPPNATLTFDVELVEVLPGPPEAPQDLPADRYTTSASGLQYADLTVGDGATAMAGRTVTVHYTGWLTDGSMFDSSLSRGEPFVFPLGAGRVIRGWDEGVAGMRVGGRRQLIIPAALAYGNRGAGGVIPPGATLIFEVELLEVR

SEQ ID NO: 30266 - protein, 321 aa, Chloroflexus aurantiacus
MARTNLNLGQLNEIEACEEHIMEVGLIGLGRMGANMAIRLRRGGHRVIVYNRTVAKARELAAEHDLIAAEELSDLVAMLTPPRVVWLMLPAGSATDEHLAALTPLLTPGDIVIDGANNNYKASIAHAEQLTAQGLRFLDIGVSGGIWGLQIGYCLMVGGDEETFHYVEPLLQTLAPPEGYLLCGPHGAGHFVKMIHNGIEYGMMQAYAEGFEILRQSRYDFDLAKISHLWNQGSVVRSWLLELAERAFTADADLSSIRGYVEDSGEGRWTVQESIDLDVPAPIITLSLQMRFRSRQEDSFSMKVLAALRQQFGGHAVKKVE

SEQ ID NO: 30267 - protein, 484 aa, Chloroflexus aurantiacus
MRRRIRTVLSPAEVFWKMSDVEERLSATISRPHRTLRAFLLPAIWLICFEEVVMSDAPRFTGFETLALHAGQTPDPTTGSRAVPIYATTSYQFKDTDHAARLFNLQEFGNIYTRIMNPTTDVFEQRMAALEGGVGALALASGQAAETLAILNLAGSGDNIVASSDLYGGTYNLFRHTLPKLGITTRFVDARDYDGFAAAIDGRTKAFFLELVGNPRLDVLDLERIAAIAHAQGVPVIVDATTVTPYLWQPIQHGADIVIHSATKYIGGHGTAIGGIIVDSGKFDWAASGRFPEFTNPDPSYHGLIYTQAFGNLAYIIKARVQGLRDIGAALSPFNSFLFLQGLETLPLRMERHSKNALAVARYLSEHPKVAWVNYPGLPSHPSYALAQKYLPRGQSGIVGFGLKGGRAAGRTFIERLRLFSHLANIGDAKSLAIHPATTTHSQLTPEEQLLTGVTDDYVRLSIGLETIDDILADLDHALAGTPS

SEQ ID NO: 30268 - protein, 210 aa, Chloroflexus aurantiacus
KRLVGLADIWSRRAPPDYRATKIEGKIAKRSVINADITLENVFVPEENRLPLARSFRDTANILKNTRYGVAWEAVGHAQAAYELALEYTLQREQFGRPIAGFQLVQQKLVHMLGDLTAIQLMAWRLSKLRDEDESQITEGMASLAKQYCAAKARQIVALGREVLGGNGILLDRHIARHFADIEAVYTYEGTNEINTLVVGREITGIAAFV

SEQ ID NO: 30269 - protein, 474 aa, Chloroflexus aurantiacus
MRRTKIVATLGPATSTPERIAGLIRAGMNVARLNFSHGTHAEHAARIAMVRRAAAEAGRHVAILQDLQGPKIRTGPLENGQPVELVAGQRFVITTEPIVGDAHRVSTTYRALPLDVRPRDRILLSDGLIELVVTGHTDTEVETEVVHGGRLREHQGINLPGVRVSAPAATEKDLADLAFGLEQGVDYVALSFVRRASDVREVKEFIRRAGKQTPVIAKIERPEALDVLPEILAEADGIMVARGDLGVEMPPERVPIVQKQIIAAANQALLPVITATQMLESMIHNPRPTRAEASDVANAIIDGTDAVMLSGETAAGAYPIEAVQMMALIADAVEASYTGGQHSTTPRWSIAPAQSTPRAIAAAACTIANSLPVRFIVVLTQSGASARLVSHYRPEVPILAFCPSEETARRTSLYWGVTPIVIEARDRLDELEQQIVRMMRETGMVRKGDLIVLSGGHPVYRYGPTNFLKVITIE

SEQ ID NO: 30270 - protein, 308 aa, Chloroflexus aurantiacus
MEFKDYYAILGLSPDADEQAIKQAYRKLARQYHPDVNPGDKKAEERFKEINEAYQALSDPERRRKYDELRSYYQRWQRSGGRGDFNWSQWQAAPGQQVYTYNVSPEDLEDLFGADSPFSDFFSSIFGQPQFRRASRAARGRDLEAPVTVSLEEAFSGTTRSLQVGDRRIEARIPRGVRTGTRVRLSGQGAPGIGGGPDGDLYLVVEVAPHPQFERDGDDLTTTIAVDAFTAAVGGEVRVPTIDGSVTLKIPPRTQADRVFRLRGKGMPRLENPAERGDLFARVKLVLPEPLSDAELATLRELVRKRQR

SEQ ID NO: 30271 - protein, 309 aa, Chloroflexus aurantiacus
MARIYNSITELIGNTPLVRLNRVNDTQATVVAKLEFFNPASSVKDRIGLAMIDAAEREGLIRPGETVIIEPTSGNTGIGLALVAAARGYRLILTMPETMSIERRKLLRGFGAELVLTPGSEGMRGAIARAEELLAEIPNSFMPQQFKNPANPAIHRATTAEEIWRDTDGQVDIVVGGVGTGGTLTGIGEVLKPRRPSLRIVAVEPEASPVLSGGKPGPHKIQGIGAGFIPDVLNTSILDEIQQVSNEDAFAMARRLAREEGLMVGISSGAAATAALRVARRPENAGKLIVFIVPSNGERYLSTPLFAEE

SEQ ID NO: 30272 - protein, 157 aa, Chloroflexus aurantiacus
MNIYQFTVRTIDGEQQSLAVYRNKVLLIVNVASHCGLTPQYGDLESLYRRYKDRGFVVLGFPSNQFNQEPDDEATIKSFCARTYAVTFPLFAKVEVNGPNTHPLFAYLKAQQPGLSPDGEIKWNFTKFLVNRNGTVVRRYAPTDTVGAIERELVELL

SEQ ID NO: 30273 - protein, 326 aa, Chloroflexus aurantiacus
MERTAKPRVFVTRRLPEPAMAILHEHCAVSLWDNVETPIPRDELLRGVAMVEGLLCLITDRIDSEVVAAAPHLRAVSIMAVGYDNIDRAALAARGITLTNTPDVLTETTADLAWALLLAAARRVVEGQKMIERGEWGPWYPLQMVGQDIYGRVLGVVGAGRIGQAVLRRGRGFAMQLRYHNRRRNPTLEAEIGAEYRTLDDLLSESDVVVVTAPLTAETRGMFGAAQFARMKPTSIFVNVARGPLVREDDLVAALRAGRPWAAGLDVFEREPIGPDHPLLTVPNVVLTPHVGSATVTTRLRMATLAAENLVAVLYGRPTPHIVRHE

SEQ ID NO: 30274 - protein, 463 aa, Chloroflexus aurantiacus
MVTWRPDPTFYPSPRMAVKAPAEKLAYVVRLNPMANGKPDAMCVVDVDSQSSTFGQVVGVTDMPYTGGELHHFGWNACSSMLCPNAPHPHVERRYLVVPDIRSSHITILDTKPDPTQPKVVKVIDPNELAERTGYARPHTVHCGPDGIYISALGSPEGEGPGGIFILDHDNLEVLGRWEIDRGDQYLHYDFWWHLGYDTLLTSEWGTPRMVESGVLGDELLAGKYGHRLHVWDLYRRRHLQTLDLGAEYQMALELRPAHDPTKAYGFMNCVVSLKDLSASIWLWYRDNGSWHLKKVIDIPAEPASEDQLPPILKPFKAVPPLVTDINLSVDDRFLYVSCWGTGELHQYDVSDPFNPRLTGKVQIGGIVRRAGHPATSAELNGGPQMVEISRDGRRVYFTNSLYRAWDEQFYPDGIKGWMVKVDVNPDGGMQFDPNFFVDFGEQRVHQIRLQGGDASSDSYCFP

SEQ ID NO: 30275 - protein, 253 aa, Chloroflexus aurantiacus
  misc_feature (233)..(233): Xaa can be any naturally occurring amino acid
MRLSAHEWLGLLDVGSFREMDANLLPTDPLGFVTDEESYAAKLAKTQQRTGMADAVIAGIGAISNMQICVAVADFSFMGASMGSVYGEKMARSAERAAELGVPLLTINTSGGARQQEGVIGLMQMAKVTMALTRLADAGQPHIALLVDPCYGGVTASYPSVADIIIAEPGANIGFAGKRLIEQIMRQKLPAGFQTAEFMLEHGMIDMVVPRSEMRDTLARILRLYRQRSTSPXLKLSLPVDEQRYRNRLCNCV

SEQ ID NO: 30276 - protein, 471 aa, Chloroflexus aurantiacus
MKLAWRTKIGLGLGFGLGLWLVGTGRAFAQEGPTTAELAVAMNTFFLIVAAALVFFMQAGFAMLTAGLTRSKNTTNILFKNLMDFVMCSIAFWAVGWGIAYGTSAGGFIGTDQFFLSPVTAEGEVPVMASWFFQVVFAGTAATIVAGAMAERTKFAAYLIYSFIISLFIYPVVVHWVWSGAGWLNTYSGSTEGNWGFTDFAGSTVVHSVGGWASLVGAMILGPRLGRFGPDGKPRVIPGHNMSLAALGTFILWLGWFGFNPGSQLAIASQANADAVALVAVTTNLAAAAGALGALFTAWLRYGKPDLGQTLNGVLGGLVAITAGCAYVDPLSSIIIGFIAGPIVVFSAELLEKLKIDDPVGAVPVHLVNGIWGTLAVGLFASVPGNTGTTGLFYGGGLTLLISQFVGVVAIGLWTVATAALMFFAIKATIGLRVSKAEEEAGLDIGEHGMVAYPDLSGAPAGGEVSGALAR

SEQ ID NO: 30277 - protein, 252 aa, Chloroflexus aurantiacus
MSKEKLPFVVTAGQMRSAEEAAVVRGTTWAALMEQAGAGVADAVLRYAAPLANRQVLVLVGPGNNGGDALVAARHLADAGALVTLYVWRRSGVDANLQACRERAIPELSAATDGDGSLLAQALRKAVLVLDGLLGTGARPPTADLATIIQAVNAERTQRSDLRVVAIDLPSGVGADDGQVPTVAIRADLTVATGLIKRGLLLWPGRGYAGEIVVAPIGLSSLDGVLTMNELLIANRHVIVAAPSGEVIKVVR

SEQ ID NO: 30278 - protein, 299 aa, Chloroflexus aurantiacus
MSERIGFIGLGIMGRGMAANILRAGFPLTVWNRTPGRADELVAAGAQLATSPADLAARSDIVISCVSDTPDVEAVLFGPQGVIEGARAGMLVIDMSTISPQGAQQFAARLHDHGIGFLDAPVSGGSEGAARGTLSIMVGGPAPLVERAMPVFQAMGKTITHVGDHGAGQTVKLVNQILVVGTMLAISEALVFAQASGVDLEKTLAAVSGGAAGSWMLSNRGPQVIRRDWRPGFTIDLQQKDLRLVLAAADAVGAPMLTTSTVFHLYRTLQQAGLGHEGNHALIKAIERLAGIEVGQRSE

SEQ ID NO: 30279 - protein, 398 aa, Chloroflexus aurantiacus
MAIDQFTGPSTAAVHAGEPRQRAFDAITPPVVHSATYTFRDSAELIAFQSGDLEREEYGRYGNPTVRAVEARLAALESPTAPAAALLCASGMNALTTVMLALLPSGSHVILTDDGYRRTRQFVRTMLARLGVTHSVVAAADPAAIAAAIEPGRTRLIVTEAPTNPYLRVIDLAAVASIAREHRIKTLIDATFATPYNMRPLEYGIDLVVHSCSKYLAGHNDLLAGVIIGRPPIISALRETQGILGGICDPHTAYLLGRGLKTFALRMERHNHNGQAVAEFLARHPRVSRVHYPGLPEHPDHAVARAQMRGFGGVVSFEVVGDLQSAMAVVDRLRLPYIAPSFGGVESLVEQPALMSYYELSSEERLAVGIRDNLIRLSCGIEDVSDLIADLQQALADE

SEQ ID NO: 30280 - protein, 144 aa, Chloroflexus aurantiacus
MTTAIVTDQRFDLHTWHGHVEQAERLHAIRRAIEVDGLWPRLLQLPIRPATEAELLAVHSSSMLHRVRQLASYGGGQIDSDTYVTAESWDVALLAAGATICMAEALVSGRCHNAFALVRPPGHHATDIRSMGFCLFNNIGSRCT

SEQ ID NO: 30281 - protein, 289 aa, Chloroflexus aurantiacus
MKDYYQVLGVSRTASDEEIKQAYRRLARKYHPDVNPGDPKAEARFKEINEAYQVLSDKEQRAKYDRFGSDFRRYEQTGFGGFDYGSQDFADLFETLFGQRRTTGGGFNVRLDGQDVEQPVELTLEEAYNGTQRTVQFSNPNGTPRTITVKIPAGIDTGKRVRVPGEGAPGLNGGRRGDLYLVVTVKPHERFERKGNDLHTTIPVSMYTLLLGGQTQIPLLSGKTLTLNIPPQTQNGRVFRIAGQGMPLMHSHQHGDLYVTVSAVLPTNLSPQARKLVEELQQLTEGDRR

SEQ ID NO: 30282 - protein, 444 aa, Chloroflexus aurantiacus
RARHGPAMAITFLSAATAATAAPLNPKYRRDEFAFYYEDTQARALIVAPGEGDEARAALRSDMLLIEAAFDSNHQLTFSTSGTAGSPRRDGLATPDDIAMILHTSGTTSRPKRVPIRHRNLAASTSNIITTYQLSAADRSLCVMPLFHIHGIVASLLSQLAAGGAVICPPGFDGLKFWSWVEQERPTWYSAVPTMHQVLLARAGRNTAIIKANPFRFIRSSSAPLPPVVMEQMEEVFAAPVIESYGMTEASHQMTSNPLPPGRRKPGSVGIGFGVEVGIMDEHGQLLPAGVKGEVVVRGPNVVDGYENNPEANATAFVNGWFRTGDQGYLDEDGYLCLTGRIKELINRGGEKISPLEIDDVLLRHPAVAEALAFAVPHPTLGEEVHAAVVLREGMSADERELREHCARLLADFKVPRAIHILSALPRGATGKLQRITMAKTLGL

SEQ ID NO: 30283 - protein, 344 aa, Chloroflexus aurantiacus
  misc_feature (320)..(320): Xaa can be any naturally occurring amino acid
MLTPFQNEPFGNFDSGDRRATMQRAIRHVAGQLGATYPLVIGGEHIVTERKLPSINPAEPKKVVGYASSASQEQAHQALLAADAAFRTWSRTPVSARAQVLLRAAAIMRRRKEELAAWMMHEVSKNWVEADADVAEAIDFCEWYARQALALQGERQPLVPYPGEDNELRYIPLGPGLAIPPWNFPLAITTTLTVAPIVVGNTVVLKPSPRAPIIAGILVQILEEAGLPPGVVNLVTGEDAVLGDFLVDHPLVRFIGFTGSKNVGLRIHQRSAVRQPGQNWLKRAILEMGGKDAIIVDETADLEAAATGIVRQRVWAFQGXQNVAVPWVPPGPFGGCIQVLTDPG

SEQ ID NO: 30284 - protein, 231 aa, Chloroflexus aurantiacus
TRCNCGVEGPTDDPDIRALRLRQMMNFIATLFLSQGTPMLLAGDERGRTQQGNNNAYCQDNPISWVDWEPDSEAEVLLAFTQRLIGFRREHPVLRRRRFFVGHLGNAEYDVEWLSPDGQEVSPELWQHPELRCIGVLLNGAVIDDRNERGESMRDDVLLVLINAGDEPVPFILPDWPDDASWHVVIDTARPDLTTPLPVTDQMYQIQPRALAVLIEKVSVAPPVQIEPAAK

SEQ ID NO: 30285 - protein, 230 aa, Chloroflexus aurantiacus
MHRIIVTLLTISVLVACGAPAAGPTAPAASPTVAGTPTNSRPPTPTRDPRLPTLPPRITPGPTATPFPLEAGWWDGAVCYEIFVRSFYDSDGDGNGDLNGIIAKLDYLNDGDPNTTTDLGINCIWLMPVAEAASYHGYDTIDYYTVERDYGTNEDFKRLVAEAERRGIQIIIDLVLNHTSTQHPWFQEALREPKSPYRDWYLWSGIEPGYVGISAHVGWANNLGREITGI

SEQ ID NO: 30286 - protein, 216 aa, Chloroflexus aurantiacus
MGIYGGTLAGVTSNLDYIASLGTTTIWLSPLFPSPSHHGYDATDYYSVEPRLGTMADLQTLIAAAHDRGMRVIFDYTANHFSNRHPIFQRAISDPHSPERDWFIFTRYPDLYVSFFGVAELPQLDLDYPPARQFMIDAARYWLEQGVDGYRLDYTIGPSHDFWTLFRAAMRAVRPDCVLIGEAVDTAEVLRSYVGRLDGCLDFAAAASHPPLFRLR

SEQ ID NO: 30287 - protein, 209 aa, Chloroflexus aurantiacus
MVYNHTGEGNHLGPTLSFRGIDNVAYYRLVPDQPRYYLDDTGTGNSLDLNHPRTLQLVLDSLRYWVTEMHVDGFRFDLARTLARGPAGSDLPSPFFTAVRQDPVLSRVKLIAEPWDVGFDGYWVGRFPAPWAEWNGRYRDTVRCFWKGDPGQAADFASRFMGSMDLYHHNGRRPYHSINFVTAHDGFTLRDLVSYNEKHNEANGEGGSS

SEQ ID NO: 30288 - protein, 174 aa, Chloroflexus aurantiacus
MIDPYARALCGELTWDKANYGYRVDSPYGDLTIGKRDSAPYIPRSVVIDPTFDWGDDRHPNIPLADSVIYELHVKGFTRLHPEVPENLRGTYAGLASPAVIDYLKQLGVTAVELLPVHAFITDQFLADRGLTNYWGYQPINYFSPEPRYASQSDPQAQVNEFKAMVKALHARRD

SEQ ID NO: 30289 - protein, 309 aa, Chloroflexus aurantiacus
MAELAAHNLQPIDLVVVNLYPFAATIARPDVTMAEAQEQIDIGGVALLRAAAKNFPAVLVLVDPADYAGVLDGLRAGDVPLSERQRLAAKAFAHTAEYDATIAAYLRTEPLPDVLPLAWRKYQPLRYGENPHQAAALYGDFGAFFHQLHGKELSYNNILDTAAAQELIEEFPATEAAAVAIIKHTNPCGVAIAADLHRAWEAAFATDREAPFGGIIAVNRPVDIAFAEAVDEIFSEIIIAPDFAPDALALLRRKKNRRLLQSVRPITGADRWQLRSVPGGVLVQEPDHAPLVAEEWRVVTKRAPTDAEA

SEQ ID NO: 30290 - protein, 279 aa, Xylella fastidiosa Dixon
MKLMSKTTTHPIAAEHKEANLAIRVRGLINRFGTQTVHDGLDIDVHRGEILGVVGGSGTGKSVLMRTILGLHSPNAGSIEVLGVNPHSQSSEDLRIIARNTGVLFQDGALFSSMTVGENVQVPMKEHHGEFPKRLYYELALLKIKLAGLPANALDKLPSQLSGGMRKRAGLARALALDPPLLFLDEPTAGLDPIGAASFDQLIKTLQKALGLTVFLITHDLDTLYTICNRVAVLAERKVIANAPLAEIETIDHPWIREYFHGPRGRAARTAQHTSTGSS

SEQ ID NO: 30291 - protein, 144 aa, Xylella fastidiosa Dixon
  misc_feature (98)..(98): Xaa can be any naturally occurring amino acid
  misc_feature (140)..(140): Xaa can be any naturally occurring amino acid
MESASPMNDILPVILSGGSGTRLWPLSREAYPKQFLPLVGHHSMLQATWLRAAPVTTHSPIVVANEEHRFIAAEQLQHLGVYPSAILLEPTGRNTAPXNRRGRTGKQHGPATIHCSSSYPPTTSSVTKQRSKLPSMWPPXAARP

SEQ ID NO: 30292 - protein, 391 aa, Xylella fastidiosa Dixon
MSIVRMTDLALSGKRVLIRQDLNVPIDQGLITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 30293 - protein, 488 aa, Xylella fastidiosa Dixon
MSERQRRTRILATLGPATDPPGVLDALFKAGVNVVRLNFSHGDVSDQARRAAEVRAAAAHVGVEIGILADLPGPKIRIGRFIGGKVRLVAGARFDLLADSNASLGDATQVGVSYLGLPQDVVAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 30294 - protein, 319 aa, Xylella fastidiosa Dixon
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPATERGSGMVRKAKELAEQHGWFLASQFSNPANPAYHRNTTAAEILRDFAGRRLDHFVSGWGTGGTLTGVGEVLKIARPDIKITASEPANAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 30295 - protein, 508 aa, Xylella fastidiosa Dixon
MVSAWNEEVTESLFMSRKHAFQFLDLPRQMPQRIPVELRTSGDWRELYGKFDKGEAQYQAGRCLDCGNPYCSWKCPVHNAIPQWLQLVQENRIDEAAALCHATNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIVSGNDPYGRPIAGWEDQVQLPDVTGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 30296 - protein, 271 aa, Xylella fastidiosa Dixon
MFGELISEAIAMFIIIALGESAAAMYILYDPSPYQNAYWGLCICWGLAVTIAIYVTASVSGTHANPAVTLALALYRGFPWKKVLPYWAAQVIGAFIGAMIVYQLYSPVIDYYNHIHQLTRDAGGAAGVFFTSTGMAITPIHALGDEIILTAFLIFGIFAITERFNEAAPTANSGALVIGLLVATIGACMGYLEGWAINPARDLGPRLFAFLAGWGESAFPGKDHYWWIPIIGPLIGGVMGATAFQCLIYPFLPARVQAKQQAAILLHRKHP

SEQ ID NO: 30297 - protein, 368 aa, Xylella fastidiosa Dixon
MSQREWVASSICKIEADFNRSVDTHLIPLQLPGFPDIDFYLKDESIHPTGSLKHRLARSLFLYALVNGWLSPGRPVIEASSGSTAVSEAYFARLLGLPFIAVIPTSTSPEKVAAIEFHGGRCHAVERACDLHDAAHQLARETGGHFMDQFTYAERATDWRANNNIAESIFKQMADEPHPIPAWIVCSPGTGGTAATLGRYVRYRRHVTRILCADPEISVFFDHYRAACKGSDHRNNVTDTGGSRVEGIGRPRLEPSFIHNCIDAMIKVPDALSLAAMRYISARLGRRVGGSTGTNMVGVLQTAARMRAEGMKGSIVTILCDGGERYAHSYYSPAWYAAHGIDVSDSDAVIAAVVAGDTLPLLPCAALE

SEQ ID NO: 30298 - protein, 314 aa, Xylella fastidiosa Dixon
MRHAVVSLLVAAMSASLPAMSKQSVSVVNNQEKTVLSTEKEKVSYAIGLDIARSHVFELIAQDIDVAALQRAIENVFKGGPPLISEEVAQTTDTALRAMLAARSGQQEASGTAPPAVSKENIGLMLGSYMVGPSLLAIKDDIDLPVLLQALRTRFAKRTPLMDEQEMTTRMQAFVASKNAVVAGKNRDEGSAFLSKNKNEKGVVTTASGLQYMVLRQGSGSRPTPSNNVRVNYEGKLLSGQVFDSSYQRGQPAEFGLGQVIKGWSEGLSLMPVGSKYRFWIPADLAYGQQGTPGGPIGPDATLTFDVELLSILP

SEQ ID NO: 30299 - protein, 349 aa, Xylella fastidiosa Dixon
MFINAYGAHAGDKPLESMQIARRAPGVHDVQIDIHYCGVCHSDIHLVRSEWAGTLFPCVPGHEIVGRVSAIGTHVQGFKAGDLVAVGCMVDSCKDCQECDAGLENYCDGMIGTYNFPTQDAPGHTLGGYSQKIVVHERFVLRIRHPEAQLAAVAPLLCAGITTYSPLRHWNAGPGKKVGIVGIGGLGHMGIKLAHAMGAYVVAFTTSESKRQDAKALGADEVVVSRDEERMAAHVKSFDLILNTVAASHSLDPFLTLLKRDGTLTLVGAPATPHPSPEVFNLIFKRRSIAGSLIGGIAETQQMLDFCAKHGIVADIELIRADGINEAYERMMKGDVKYRFVIDNATLAA

SEQ ID NO: 30300 - protein, 206 aa, Xylella fastidiosa Dixon
MCNEPVTSDVALPDLDWAKGDGLLPVIVQDADTLRVLMLGYMNSHALEVTQRSRLVTFYSRSKQRLWTKGERSGHVLHLVAIDADCDADTLLVQARPRGPTCHLGRTSCFPAAPGQFLGALDALVAERERERPQDSYTTALFEQGVRRIAQKVGEEGVETALAGVVQADDALLDESADLLYHLIVLLRARGLSLADAVTVLEARHR

SEQ ID NO: 30301 - protein, 348 aa, Xylella fastidiosa Dixon
MGIRIQELRKQFEDFTALAGIDLDIRQGELLALLGPSGSGKTTLLRIIAGLEHADAGRVLFGDEDATTMSVQARRVGFVFQHYALFKHMSVYENVAFGLRVRRGKARWPESQISARVFELLSLVQLDGLEQRYPMQLSGGQRQRVALARALAIEPRVLLLDEPFGALDAQVRRDLRRWLREIHDRTGLTTVFVTHDQEEALELADRVAILNQGGIEQVASPAEVYNRPSSPFVYSFVGAVNRLPGCVSADGLEVAGIVLSCPPQLSGGGAVDLYVRPEDLVLDAQEGWSAIVLWSQRSGPRMRVRARLEHSAHEVEIELSSATDEYVEGQKLRLIPRHYGVFFSESGS

SEQ ID NO: 30302 - protein, 485 aa, Xylella fastidiosa Dixon
MHHNVHQSEILADPCDLQRAERWRQRDLRVLWHPCTQMREHPDTLPLVPIVRGEGAWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACPAISTDTDDKELGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 30303 - protein, 430 aa, Xylella fastidiosa Dixon
MTAIVKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 30304 - protein, 469 aa, Xylella fastidiosa Dixon
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMHSYVRDPRGIAKRAEIYLNSLGIADQAFFGPEPEFFIFDSVRFANDMGHSFFQIASEEAAWNTGAEFERCNSGYRPAVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFINGYIALKMQEVTQFRAATHPLEYQMYYAN

SEQ ID NO: 30305 - protein, 349 aa, Xylella fastidiosa Dixon
MGFAALSATGPLERFAFGRRAPRPDDVVIDILYCGVCHTDLHLARNHGGFTTYPIVPGHEIIGCVREIGKTVTRFKRGDLVGVGCMVDSCQHCQPCLKGWEQDCIEGSIFTYNSTDRRDGSITYGGYSDVIVVRDKFVLSLPDGLDPAGAAPLLCAGITTWSPLRRWNVGKDSKVAVVGLGGLGHMALKLAKALGADVTLFTRSSGKEGDAFRLGADRVVLSSDLEQMKAVYSRFDIIIDTVPYDHDVNPYMPTLVLEGVLVLVGYLGPLSMPVNAGGVVRGRRAISGSFIGGVPETQQMLDFCGQHGIVSDVEIIPIQKINEAYERMLKSDVKYRFVIDMTSLTSSGA

SEQ ID NO: 30306 - protein, 154 aa, Helicosporidium sp. ex Simulium jonesii
NGKTPMVRLRKLPLGCTANIVAELESMEPCKSVKDRTALNMVRRAEEHGLITPGQTILVELTSGNTGVGLAFVGAARGYRVMLTMPDTMSLERRILLKAFGVELQLTRNSGGMSDAIVRAERIVERVPGSYMLQQFDNMANPEVHYQTTGPEIW

SEQ ID NO: 30307 - protein, 161 aa, Helicosporidium sp. ex Simulium jonesii
ANPEVHYQTTGPEIWRDTEGRVDIFVAGVGTGGTITGTGRYLKEQNPDVQVVAVEPLESPVISGGEPAPHMIQGIGAGFIPKNLDMSIVDSVLTVGSAEAMVAARRLASEEGLLVGVSSGAALVAVDRLARRPENEGKLIVTVLPSMGERYLSSALFQDLR

SEQ ID NO: 30308 - protein, 357 aa, Helicosporidium sp. ex Simulium jonesii
IGAGVGGHGAALHAVENGLKVAIVEGGDIGGTCVNRGCVPSKALLAAAGNLRKLKDDHLNKMLGLQIPGAVSYDRTALAAHATNLASTIRGHLTRSLESLGVTTLKGNARFEEAHRLRYGLPGRVDVGGEVTFKHAIIATGSTPFVPPGVELDGQTVFTSDHALRLEWVPDWLAIVGSGYIGLEFSDVYTALGSEVTFVETLPELAPGFDADIARLARRLLISPRRVEGHTGVLAARVKPGVRGVRPVIIELVDAASKEPREVLEVDACLIATGRVPFTKGLNLSALGVEVDRRGFVPVDTHMRVLAAAGGGGGGGNGAPDTTKNGAHHACHHRALPHVFCIGDANGKYMLAHAASA

SEQ ID NO: 30309 - protein, 169 aa, Helicosporidium sp. ex Simulium jonesii
ARGGAQELFGIQPDLTTMGKIIGGGLPVGAYGGRSDIMSLVAPAGPMYQAGTLSGNPLAMAAGLKTLQQLTPAVYVHLDMISRRLVDGLAKVAKSTGHDLYTSSVPGMFGFFFCRGPVHNFEEAKRADTVKFAKFFNGMLDQGIYLAPSQFEAGFTSFSHSIEDIDRTS

SEQ ID NO: 30310 - protein, 107 aa, Helicosporidium sp. ex Simulium jonesii
RGEGEEGSGGVPQLSAILASASPEQQKQLLGEQLFPKVAQHQPELAAKITGMLLEMDNSELVLLIETPEALADKVAEAVEVLRAHNAIPKGISVSGDGAAAEAEEAD

SEQ ID NO: 30311 - protein, 121 aa, Helicosporidium sp. ex Simulium jonesii
FTPQYAELEQLQQEFGAQGFDVLGFPCNQFMNQEPGDSCSIRDAARAKHGATFPMFAKIKVNGSEADPLYKWLKEQKGGILTSAIKWNFAKFLVDRQGKVVGRYAPTTSPKDIANDIKKFL

SEQ ID NO: 30312 - protein, 252 aa, Helicosporidium sp. ex Simulium jonesii
MARKFFVGGNWKCNGTKESVSALVKALSAAKLPSADKVDVVVAPTFLHLSQALSSLPSRVEVSAQNCWIKGGGAFTGEISAEQIVDLGAKWVILGHSERRHIMGESDATVADKVAYALSKGLGVIFCIGEQLSEREANHTMDVCTRQMAALASKISDWSRIVVAYEPVWAIGTGKVATPDQAQEVHGLCRRWVAQHVSPAVAETTRIIYGGSVTAGNCRDLAAQPDIDGFLVGGASLKPEFVDIVASAELKS

SEQ ID NO: 30313 - protein, 226 aa, Helicosporidium sp. ex Simulium jonesii
QAHVLGKAKHTFTSAEEAVKALRAGPNGDVISDQWLEPFVIVDSDTQHPVGPIQDGDAVVIFNFRADRVIEISKAFEYAEFSSFDRERWPCTRFAGLMQYDGDLKLPANYLVAPPAITGTSGEIPSDKVPFNQLPLMKAREIAEAGKEALRSGKFDVVRINFANPDMVGHTGDLAATIKAVEVVDVCVKELLDVVDELGGRFLLTSDHGNADDMVQRAKKTLKPLF

SEQ ID NO: 30314 - protein, 459 aa, Methylococcus capsulatus str. Bath
MKRFIVSGPSMHFALRALVSGLALALAAPAGVRADETCASPYMKKITGQEDYVYVWTLGAEGVGDEQDKLVTVDANPKSPQYGKVVNTLSVGGRNEAHHSDFTDDRRYLWAGGLDTSKIFVFDVHSDPARPVLSKTITDFVEKSGGVVGPHTLYALPGRMLITGLSNNKDHGGRTALVEYTNAGEYVATHWIPTDGDLRGAIKTGKYADGYDYDVRALPRKNLLVTSSFTGWNNYMMDFGKMLADPEAMKHFGNTVVTWDLHTKQPKKVFDVPGAPLEIRCAWGEAHNYCFTSTALTSQLWLIYEDGEGEWQAKAVADIGEPAKVPLPVDISISNDDSRLWVNTFMDGKTRLFDISDPHHPRQVYEKTIGAQVNMVSSSWDGQRLYYTSSLLANWDKKGKDDEQFLKLYYWDGKELKEQFAIDFYAEKLGRPHQMRFGARALYAGPAGDGNRLVQARVE

SEQ ID NO: 30315 - protein, 487 aa, Methylococcus capsulatus str. Bath
MRIEQEALTFDDVLLVPAYSNVLPRDVSLTTRLTRAIPLNIPLLSAAMDTVTEARLAITIAQEGGIGIIHKNMTTERQAAEVRSVKKYESGVIKEPITVPPTATIREVMELTRARNISGVPVVDGGELVGIVTSRDLRFETRYEEPVTRAMTPKERLVTVQEGSSKEEAIRLLHQHRIEKVLIVNEAFQLRGMITVKDIQKSKDYPQACKDEFERLRVGAAVGTGAGTEERVEALVEAGVDVIVVDTAHGHSQGVLDRVRWVKTHFPQVQVIGGNIATGAAARALAEAGADAVKVGIGPGSICTTRIIAGVGVPQITAVANVAQALAGTGIPVIADGGIRYSGDVAKAIAAGAHCVMIGGLFAGTEESPGEVELYQGRSYKAYRGMGSMGAMAQQQGSSDRYFQDSTEAEKLVPEGIEGRVPHKGSLVAILHQLVGGVRASMGYTGCRTIEEMREHARFVRVTTAGMRESHVHDVTITKEAPNYRLD

SEQ ID NO: 30316 - protein, 465 aa, Methylococcus capsulatus str. Bath
MRIFRTKAVSTDDCSGGSLKRCLGALDLTLLGIGAIIGTGIFVLTGIAAATQAGPAVVLSFVFAGLACAFAALAYAELAACVGGCGSAYGYSYAAFGELIAWIIGWDLILEYAISVAAVANGWSGYFANALTAVGLELPDYLTKAPEKGGIINLPASAIIILLMALLIAGVKESARLNTVMVSVKVLAIAVFVAVASAHVDPAHWDPFLPFGWFGHDAEGRPTGVLAGASIVFFAYVGFDAVSTAAEEARNPMRDVPIGIIGSLVFCTLIYIVVAGLLTGVVPYTELNVSSPVAHALQLLGIRWASGLVATGVIAGLTTVMLVLYYALTRIIFAMSRDGLLSPWFSAVNTRTQTPVRVIVLCGLFISLVAGFVPLGELAELVNIGTLFAFVLVCLGVIVLRVTRPELHRPFKTPVVPWFPILGALSCGALMAFLPALTWLRFVVWLLLGIGIYFAYSYRHSRLAD

SEQ ID NO: 30317 - protein, 256 aa, Methylococcus capsulatus str. Bath
MTDGEVIRMAHVWTRFGENLVHRDISLSLGRGQILGVVGASGCGKTVLMREMIGLQTPTQGQVWLLGESLAEADARRKQQLRNRCGVLFQGGALFSALSVFDNIAFPLRELKTLDEELIARLVCMKLAMVGLGETDALLMPAELSGGMVKRAALARALIMEPEVLFLDEPTSGLDPVLGEEFVGLLGQLHRELGFTVVMVTHDLDTLSDLCTCVAVLAGQQLVSYGTLDDAIACAHPFARDFFHGKRAQRILGRSD

SEQ ID NO: 30318 - protein, 177 aa, Methylococcus capsulatus str. Bath
MSEMAPRNYFEFFQLPEMFRLDQSVLDSHYLELQARVHPDKAAHLSDVEKRLSLQWATFANEAYQTLKRPLERARYLLRIHGVDTREEDNTAMPAEFLLEQIEWREEMQDAIAGRSEAALDRLGFRLKKEMDHLIESLGAMLDVQQSHPDAAVLVRQLAFLEKLKRDLDQAHALLED

SEQ ID NO: 30319 - protein, 451 aa, Methylococcus capsulatus str. Bath
MGSAGRQWMERDLAVLWHPCSQMKDHESLPLIPIRRGEGVWLEDFDGRRYLDAISSWWVNLFGHCHPAINAALADQLGRLEHVIFAGFSHEPGIRLAERLVDITPPGLERCFYADNGSAAVEVALKMSFHYWRNRGRPGKTRFVTLENSYHGETLGALAVGDVPLYKETYRPLLMEAVAAPSPDAYGREPGETEAGYAERRFRDMLAILERGADEICAVIVEPLVQCAGGMRMYDPLYLRLLRAACDRLGIHLIADEIAVGFGRTGTLFACEQAGISPDFLCLSKGLTGGYLPLAAVLTRPEIYAAFYDDYGTLKAFLHSHSYTGNPLACRAALATLELFDATDVLGRNRELARCMADATERFQEHPHVAEVRQRGMILAIEMVKDKTTREPYPWQERRGLRVYRRALERGVLLRPLGNVIYFMPPYLITPEQIRLMAEVAWEGLLVAAED

SEQ ID NO: 30320 - protein, 426 aa, Methylococcus capsulatus str. Bath
MLDSTTLFADACRFIPGGVNSPVRAFRGVGGTPVFVDRAEGPYVYGVDGKAYIDYVGSWGPMILGHAHPEVLTAVHAAVDRGLSYGAPTVAETAMAKTVCALMPSLDRVRMVSSGTEATMSAIRLARGYTGRDKIVKFEGCYHGHSDSLLVKAGSGALTLGAPSSPGVPANLAEHTLVLPYNDAAAVRDVFARHGAEIACIIVEPVAGNMNCVPPVPGFLETLRDVCDASGAVLIFDEVMTGFRVALGGAQAHYGICPDLTTLGKVIGGGMPVGAFGGRLDIMEQLAPVGQVYQAGTLSGNPVAMAAGLKTLELISQPKFFDELAEKTRHLAEGLRVRAEQAGIPLCVNWVGGMFGLFFTEQQGVSRFDQVMACDQERFRRFFHGMLEEGVYLAPSAFEAGFVSAAHDYQILDRTLTAAERVFAGL

SEQ ID NO: 30321 - protein, 473 aa, Methylococcus capsulatus str. Bath
MAEPKTIHADVLVLGGGPGGYTAAFRAADLGRQVVLVERYPTLGGVCLNVGCIPSKALLHVAQIIHEAREAGEFGLRFGAPEIDLDQIRGFKDKVVKTLTGGLETLARQRKVTVVQGTGRFTGEHGMQVETTDGPVTVGFDHAIIAAGSRAVKIPDFPHDDPRLMDSTDALALQEVPKRLLIVGGGIIGLEMATVYHALGAGITVVELMDQLIPGCDADLVRPLHQHIKKQYENIYLKTRVSRIEPEAAGLKVFFEGEGAPESDLFDRVLVAVGRAPNGALIGAENAGVHVDAKGFIPVDEHQRTNVPHIYAIGDIVGNPMLAHKATHEAKVAAEVIAGKPSAFQALTIPSVAYTDPEVAWMGVTEAQAKAQGIEYEKAVFPWAASGRALGIGRKEGATKLLCDKTTKRVIGAGIVGPHAGELIAEAVLAMEMGADAEDIGLTVHAHPTLSETFAFAAEMIEGTITDLYIRKR

SEQ ID NO: 30322 - protein, 128 aa, Methylococcus capsulatus str. Bath
MSAWLDEIRWTADGLVPVVAQEAGTGQVLMVAWMNREALALTAAEGYAVYWSRSRGRLWRKGEESGHRQKVLEIRIDCDEDVVLLKVEQAGGIACHTGRHHCFYRVLQDGRWVTVEPVLKPPDSIYGA

SEQ ID NO: 30323 - protein, 114 aa, Methylococcus capsulatus str. Bath
MPYLKIHMNREIEPGKSKALLAAASQRMASELGKPERYVMVELTSNPAMLFAGTDEPAAFVELKSIGLPAGKTKALSQTLCSLLQDSAGIAPARVYIEFTDVAGGFWGWNGSTF

SEQ ID NO: 30324 - protein, 332 aa, Methylococcus capsulatus str. Bath
MKAIVMTRPGEAAEVLELRDLPEPALTAPTQIKVRLRAAGVNPIDTKVRRRGLFYDDALPAVLGCDGAGEVVEAGAEVDRFRIGDRVWFCNGGLGAEQGNYAEYTVLDQRWAAPMPASSAFASAAAGPLVLITAWGALYDRGRLQPGQTVLVHAAAGGVGHVAVQLAKLRGARVIATVGSEDKAALARGWGADETIDYRTQDFVAEVNALTGGRGADLVLDTVGPEVFRRSVECTAHFGDLVTLLDTGATSLAEARMRNLRIGFELMLVPMLRKLDAARDHHVEILRACGEWIDDGKLELYVSGVHPLEEAARVHDIIEAGHTTGKRVLCID

SEQ ID NO: 30325 - protein, 380 aa, Methylococcus capsulatus str. Bath
MTADAAIRGIREIDAQGSIGLIGSEPHLPYKRPLLSKGLWLGKSFDQIWYGTETCGISAFLGRTVTRLDLAEKSVTDDEGTIYRFEKLLLATGGRPRRFPFGGDDILYFRTVDDYFRLRTLTETRRKFAIIGGGFIGSEIAAALASIGKDVVMIFPEACIGARVFPGNLCRFLDGYYRDQGVELLSGRTVTGLVREGDGLRLALGETGEEVLVVDGVVAGIGIEPETRLAEAAGLPVEGGIVVNDFLQAGHPDVYAAGDAASFFSPVLGRRMHVEHEDNARTMGRLAGRNMAGEASPYRHLPYFYSDLFDLGYEAVGELDSRLETVEDWSEPYHKGVVYYLDQGRVRGVLLWNVWDRVEAARALIGEPGPWGAGDLAGRL

SEQ ID NO: 30326 - protein, 449 aa, Methylococcus capsulatus str. Bath
MSLPIDSVLLTDLYQLTMLQGYHAQRMNGTAVFEFFVRKLPGGDEPKRNFLVAAGLEQALDFLEGMRFRPDEIEWLRASGRFTPDFVDALAALRFSGDVDAMPEGTVFFPGEPILRVTAPLPEAQLAETRLINLLHFQTLIASKAARMTLAAPGKLLVDFGLRRAHGAEAGLLAARAACLAGFAGTSDVLAGRLWDFPLYGTMAHSFIQAHDDELAAFEHFALAQPDNLVLLIDTYDTEAAAEKLIPLAERLAAKGIRIQGVRLDSGDLAEHARRVRRILDRGGLGQVSIFASGSLDEYLLAAHTAEAVPIDGYGIGTRMDTSSDAPYLDCAYKLQEYAGIPRRKRSEGKATWPGRKQVYRYYDAEGKLQRDSLTLVDDAQPGEPLLRPVMRNGRRLAASPPLQTLRSHAMEQLGRLPEALRRLSPAPAHPVEIAGRLKSLVKAMDGHS

SEQ ID NO: 30327 - protein, 488 aa, Methylococcus capsulatus str. Bath
MTRGIRRTKIIATLGPASESPEMLERILKAGADVVRLNFSHGTAEEHRIRAERVREISRRMQRYVAILADLQGPKIRIARFKGDRQVVLEEGQPFDLDTAFPPDQGDETQVGCAYEALPTDVEAGDTLLLNDGLIELKVKSVEGTRVRCVVTVGGVLSNHKGINKLGGGLSAPALTEKDKADLKTAVEIGADYLAISFPRSKEDMLEARELLHRAGSHMGLVAKVERAEAIKDGVIEGIIDASDAIMVARGDLGVEIGDARLPHEQKRLIRLARSRNKVVITATQMMESMIENPLPTRAEVSDVANAVIDGTDAVMLSAETATGKFPDRTVAAMVRVCKEAEKYPRTRQSSHRMDEKFHRIDEAIAMSAMYIANHLPVRAIGALTESGSTPLWMSRISSGIPIFALTPHEAVCRRVTLFRGVYPIFFNERAISDHHVLNRAIAEEFLKRNLVKMDDLVIMTKGDLTGRTGGTNALKISRISDVIAAAP

SEQ ID NO: 30328 - protein, 230 aa, Methylococcus capsulatus str. Bath
MNEFWIAPSILSADFARLGEEVDDVLKSGADIVHFDVMDNHYVPNLTIGPLVCEALRKHGVTAPIDVHLMVKPVDRIIPDFAKAGASYITFHPEASEHIDRSLQLVKDSGCKTGLVFNPATPLNYLDHVMDKLDMILLMSVNPGFGGQSFIPYVLDKVRECRRRIDASGRNIRLEIDGGVNARNIREIAAAGCDTFVAGSAVFGAGKAEDPNRYDSIIRALRDELAQTRA

SEQ ID NO: 30329 - protein, 427 aa, Methylococcus capsulatus str. Bath
MSKIVDILAREILDSRGNPTVQAEVILDSGAEGSAMVPSGASTGAREAIELRDGDASRYGGKGVLKAVENVRGPIKAALTGMDAADQAAIDRRLIELDGSDNKGVLGANAILAVSLATAHAAAADAKKPLYAYLNRSGEFLLPVPMMNIINGGAHADNSIDMQEFMILPVGAPSFREALRYGAEVFHALKKVLSDRGLATGVGDEGGFAPNLPSNEAAIGIILEAIEKAGYRPGEDICLGLDVASSEFYSDGIYTLASEGRRFTSEEFSDHLAAWVDKYPIVSIEDGMAENDWHGWGIHTDRLGRRIQLVGDDLFVTNPAILKQGIEARIANSILIKVNQIGTLTETLEAIHIARKAGYTSVVSHRSGETEGTTIADIAVATCTGQIKTGSLSRSDRIAKYNRLLKIEEELGDKARYGGRGAVKNLA

SEQ ID NO: 30330 - protein, 267 aa, Methylococcus capsulatus str. Bath
MSRLTSTFQVLRHANRKALIPFITAGDPEPGFTVPVMHAMVEAGADVIELGVPFSDPMADGPVIQKASERALVHHMSLGKTLDLVAEFRRADRTTPIVLMGYLNPVECMGYQRFVDRAKDAGVDGVLTVDMPPEEAGEFVPMLHRAGLDPIFLLAPNSSDARVQRMAALGRGYLYYVSLKGVTGASHLDLAEVESRIAHIRSLTDLPIGVGFGVKNAETAAAIGRFADAVVVGSALVEKIAAAQDRPEQARKDIVDLLAVMRRALDA

SEQ ID NO: 30331 - protein, 383 aa, Methylococcus capsulatus str. Bath
METRAVRAGQRRTMEQEHAEPIFATSSYVFASAAEAAERFAGKAAGNIYSRFTNPTVRTFEERLAALEGGERCVAVGSGMAAIASTAFGLLKAGDHVVCSRSVFGNTTLLFQNYLAKFGVPTTFVGLTDYDGWAAAIRPETRFLFIETPSNPLTEIADIPRLAEIAHSRGCLLVVDNCFCTPALQRPLALGADIVIHSATKYLDGQGRCVGGAIVGGRELLDAEIYPFLRTGGPSMSPFNAWVFLKGLETLNLRMKAHCENALGLARWLEAQPWVERVHYPGLASHPQHELAARQQSGFGGIVSFEVKGGQEAAWRLIDSTRLLSITGNLGDAKTTITHPATTTHGRLSPEARAAAGIADGLIRIAVGLENLADIQADLARFA

SEQ ID NO: 30332 - protein, 289 aa, Methylococcus capsulatus str. Bath
MKTGFVGLGAMGLGMARNLRRAGLLAGVWNRTPEKARAFAAETGTPAWATLTEMAPACDVIVTCVSADADVLEVIAALTPGLRPGAVIVDCSTVGVATARRAAEVVRQAGGDFLDAPVSGGVEGARDGTLALMIGGRAETVEKVRPVLAAMGSRLMHMGDTGAGQATKAVNQVMCAGINQAVTEALAFGQALDLDLDKVIDVVSGGAAGNWFLDKRGKTMIRGSFQPGFKLSLHHKDLNICLEMAERLGIPLPLSTRSRDDYAELMARGYGDDDISGLFRLKSAARPKG

SEQ ID NO: 30333 - protein, 285 aa, Methylococcus capsulatus str. Bath
MCDAQDWFTESYPDNGSALSLKIRAKLHEEQTPFQRIEIYDTESFGKLMVIDGCTMVSDRDNFLYHEMMTHPVLYTHPAPKTVWIIGGGDCGSLREVLKHSEVEKAVQIDIDERVTRLAERYFPELCEANGDPRAELLFIDGIQWVKEAPDGCVDVIIVDSTDPVGPAEGLFNEAFFRQCHRCLRTDGILVQQSESPLFHLPLIASMHRIMRQAGFAQTRTLFFPQFIYPSGWWSATMAGKGDLNRFRADAAEAKLFPTRYYNADIHRAAFAVPEFFGDALRELV

SEQ ID NO: 30334 - protein, 479 aa, Methylococcus capsulatus str. Bath
MGKPTGFMEIARQDRRYTLVADRIQHYREFVVPLSDEEVSRQGARCMDCGIPYCHQGCPINNIIPDWNDLVYQGDWEEALEVLHSTNNFPEFTGRICPAPCEAACTLNLNDEPVTIKTIECAIADKAWEENRIRPQIPSRRTDKRVAVVGSGPAGLACAQQLARAGHGVVVYEKADRIGGLLRYGIPDFKMEKHLIDRRIAQMQAEGVIFRPNSHIGANIPLSRLMAEFDAIVLAGGSEKPRDLPVPGRELAGIHFAMEFLKQQNRRVAGDTIDEAEGILATDKHVIVIGGGDTGSDCIGTSVRQGAASVVQLEILPQPPAKEDKSLTWPNWPNRLRTSSSQEEGCERHWSIATKRFSGENGKVTAIHCIKVNWKQEGGRWVMEEIPGTEFTLQADLVLLAMGFVHPVQEGLLQETGVRLDERGNVQADTRNYRTSVDKIFAAGDMRRGQSLVVWAIREGRQAARAVDEFLMGRSDLPR

SEQ ID NO: 30335 - protein, 485 aa, Methylococcus capsulatus str. Bath
MSSVTVKPLILSGGVGSRLWPHSREAYPKQFLPLLGERTLFQETTGRIGGMAESRFDIRSPLIVCNEQHRFLVAEQLRQMGYDDADILLEPSGRNTAPALTIAALHVSERLGGDCILAVMPADHHIADVEGFRAGLARALGVAGRGLIGTFGIVPDRPETGYGYIRKGRSLEDGTVFELEAFVEKPDAETAAQYLSSGDYLWNSGLFVLRANVWLERIGSHRPDILESCSAAYEKATADGNFIRVDRTDFLRCPSDSIDYAVMEKLNGTGQAVVIPLDVGWCDLGSWASLSEVKPRDEHGNVVEGDVYARDTRNSLLYADSRFLAAIGVDDLLVVDTADAVLVAHKSKAQDIKQIAEHLEAANRTEHKVHRRVHRPWGTYESIDTGQRYQVKRITVTPGAALSLQMHHHRAEHWIVVRGTARVVRGEESFLLTENQSTYIPIGVHHRLENPGTIPLEIIEVQSGSYLGEDDIVRFQDHYHRTKEG

SEQ ID NO: 30336 - protein, 391 aa, Methylococcus capsulatus str. Bath
MAFKRMTDIDLAGKRVLIREDFNVPVKDGRVTSDARIRAALPTIRHALDAGAAVMLMSHLGRPTEGEYAEEFSMKPVADRLSELLGQPVTLVKDYLGGADPAVGSVVLFENVRFNKGEKKDDEVLARQLAALCDVYVMDAFGTAHRAEASTHGVGKYAPTACAGLLLATELDALGRALHDPARPLVAIVGGSKVSTKLTVLDSLSQVVDQLIVGGGIANTFIKAAGFNVGKSLYEEDLVAEARRLMEAAKAKGGEIPVPVDVVVGKRFDAAEPAMVKSVADIAEDDMILDIGPETSRRYAEFIGRAGTVVWNGPVGVFEFDQFGEGTRRLGLAIAESHAFSIAGGGDTLAAIDKYGIADRISYISTGGGAFLEFLEGKQLPAVAMLESRAD

SEQ ID NO: 30337 - protein, 187 aa, Methylococcus capsulatus str. Bath
MNRLEEIRQVETAAERLYSEAEVENAIVRLAAEITEAIADRNPIVMTILTGGIVFAGKLLTHLRFPLELDAIGATRYRGRTAGGVTHWRLEPGLSLQGRTVLLVDDILDEGVTLAEVREHCLDRGAERVLIAVLVDKDLGREKPCRADFVGLVTENRYLFGYGLDYKGYLRNAAGIYACPQIESQGT

SEQ ID NO: 30338 - protein, 295 aa, Methylococcus capsulatus str. Bath
MFPTIESFVGNTPLVRLQRLPGDTANFILAKLEGNNPAGSVKDRPALSMIRCAEARGDIQPGDRLIEATSGNTGIALAMAAAIKGYRMTLIMPDNMSAERRATMKAFGAEIILTPAAGGMEAAIDLARAMEARGEGKILDQFSNSDNPRAHYEGTGPEIWRDSQGRVTHFVSSMGTTGTIMGTARYLKERNPAIQIIGVQPKDEARIPGIRRWPQEYLPKIYDPSLVDRILDVTQEEAESTTRELAAQEGIFAGISSGGAVAAALRLSREVENAVIAVIICDRGDRYLSTGVFPE

SEQ ID NO: 30339 - protein, 334 aa, Methylococcus capsulatus str. Bath
MLRICNSLANLFPVWVLLCSGLALYFPPWFTWFTGPMIVWGLSIIMLGMGITLTFDDFHRVAKMPRIIIAGTVAHFGIMPFLGWSIAHGLALEPELAVGLILVACCPCGTASNVVSYIARADVALSVLLTMVSTFTAVVMTPLLVKLLAGAYTPVDGWGIFLNTLQVIVMPVTAGLLLNRYAPRLVRTVSPVTPLVSVIFIAFICASIIGANADVIKSAALKLFGAVALLHVGGFGLGYVFARVLGYRDAVVRTIAIEVGMQNSGLATVLAKANFAGMALAPIPSAISASFHSIIGSLLAGWWRLRTHRPLPSMGHAFDTPMPVPADCPDRCEP

SEQ ID NO: 30340 - protein, 377 aa, Methylococcus capsulatus str. Bath
MAKEDYYETLGVPRNASDSDIKKAFRRLAMKYHPDRNKDNPEAEERFKSVKEAYDVLSDPKKRSAYDQFGHAGIDPSMGGGGGFGFTGDSFSDIFGDVFGDIFGGGGRRRGRGQRGSDLRYNLELTLEEAVAGTEAKIKVPTWVTCTECGGSGAKKGSAPVTCPTCHGQGAVRMQQGFFSVQQTCPTCRGTGQHISDPCRVCYGQGRVQETKTLSVKIPPGVDTGDRIRLSGEGEAGEGGGPPGDLYVHIGVKQHPIFTRDGADLYCEVPIGFPTACLGGELEVPTLDGKVVLKIPAETQTGRLFRVRGKGVKPVRGGVAGDLLCRVRVETPVHLNKEQIDLIRQLDESLRGGGSHHSPQAHGWLDGVKQFFDRLGL

SEQ ID NO: 30341 - protein, 191 aa, Methylococcus capsulatus str. Bath
MIDAEGYRLNVGIILSNDEGRVFWARRAGMRSWQFPQGGIKVDEDPDAAMFRELYEEVGLERQYVEIIARTKGWLRYQLPERFIRRRSYPLCIGQKQIWYILRLTGTDANIRLDCSERPEFDRWCWVDYWHPLSDVVYFKREVYRQALSELQRALQAGRPAGAQAVSDAGGTATRQIPVATEPSGPSSSQR

SEQ ID NO: 30342 - protein, 391 aa, Methylococcus capsulatus str. Bath
MTSNIMPTYARQPVTFTHGEGAWLFDTEGKRYLDAVSGVAVCSLGHAHPAVAKALCDQAGRLVHCSNLYRIGLQEDLAKQLCDLSGMDNAFFCNSGAEANEAALKIARRYGHHRGIDTPKIVVMEGSFHGRTLATLSATGNPKVQEGFAPLVGGFVRLPYGDAEAVAAVDDPDVVAVLVEPVQGEGGVRIPPDDYLARLKSLCERRGWLLMLDEVQTGMGRTGRMFGHQHTGVTPDVMALAKALGNGVPIGACLARGVAAEMLTAGKHGSTFGGNPLACAAALAVIDTLTRQSLAQRAEILGQRLLDGFRTRLSGRPGVIEIRGLGLMIGLELERPCTRLVGMALEQGLLINVTAERTVRLLPPLILTDAQADDLVERLCSLVEAHLDAAG

SEQ ID NO: 30343 - protein, 214 aa, Methylococcus capsulatus str. Bath
MRIMLLGSPGSGKGTQAKYLTERFGIPQISTGDMLRAAVREGTPLGMEAKKIMDAGQLVSDSIILGLIKERIAAPDCANGFLLDGFPRTIVQADALAELGVTLDHVVEIAVDDEEIVRRLSGRRVHPASGRTYHVVFNPPKVEGRDDETGEPLVQREDDKEETIRRRLEIYHVQTKPLVDYYRSKAAQGGVKFHTVPGVGSVEAIRDAVLASLA

SEQ ID NO: 30344 - protein, 308 aa, Methylococcus capsulatus str. Bath
MEFKDYYKILEVERSATEDEIKKAYRKLARKYHPDISKEKGAEARMKEINEAYEVLRDPEKRAAYDRLGAGYRSGQEFRPPPDWDAGFEFARGPFGHGADFSDFFNTLFGGFGRSSGAFRARGEDHHAKVFIDLDDAFRGVSRTLSLRMPQLDEQGRLVMRERTLQVQIPKGIREGQLIRLAGQGAPGLGGGPQGDLYLEVHFKPHPFYRVDGRDLYLTLPVAPWEAAMGATVKAPTPAGAVEVRIPARSQNGRKLRLKGRGIPADPPGDLYLVLDIVLPPADTEQARDLYRHMARQMAFDPRRSLGV

SEQ ID NO: 30345 - protein, 275 aa, Methylococcus capsulatus str. Bath
MTFQPSDTPALVSIRGLSFSRNGRKIFDNIDLDIPRGKITAIMGPSGTGKTTLLRLVGGQLRPDSGTVRVAGINVHRLGLDELYALRKRMGMLFQSGALLTDLSVYENVAFPLREHTRLPESMIRTLVLMKLEAVGLRGARDLMPAQLSGGMARRVALARAIVLDPMMIMYDEPFTGQDPISMGVLVQLIHDLNHGLGLTSIVVSHDVQETASIADYVYLISGGKVVGRGTPAELARSDSPWIRQFMDGLPDGPVHFHYPSKDYASDLLGFVASR

SEQ ID NO: 30346 - protein, 505 aa, Methylococcus capsulatus str. Bath
MKNGNADVGLIGLAVMGQNLALNVADHGYTIAVYNRNYQRTQEFMAHCERAEPSRVRIRPCAELAEFVQAIARPRRIILLVKAGAGTDAVIGQLLPLLDPGDLVVDGGNAHWLDTIRRERELDAAGIRFIGSGVSGGEIGARFGPSLMPGGSAESWRLLEPVWQAIAAKVDPATGKPLEGAAPGRPVTGGEPCTALIGPNGAGHYVKMVHNGIEYIDMQLISEGYWLLKHLGGLESGAIASIFRDWNEGELSSYLIEITSDILQQQDPSGDGFLVDKVLDAAGQKGTGQWTAASALEQGVPANAIAEAVFARALSALKEERVAASVILQGPEVRLEADTVHLVEAVRDALYCAKICAYAQGFQLMAQAQKTYGWQLDFATIARIWRGGCIIRARFLQKITDAYGRDAALSNLMLDPYFRDALHRGQGHWREIVALAVRNGLPVPAFGSALAYFDGYRSASLPANLLQAQRDYFGAHTYERTDRPRGRFFHLDWPAPDRPEAEAGG

SEQ ID NO: 30347 - protein, 421 aa, Methylococcus capsulatus str. Bath
MKARIESVQAMPIYDSRGVPTVRVRLTLTDGTAATASIPSGASTGENEAVELRDGDPKAHGGKGVLKAVSNVNDVIAPAVMGLEPWRQAEIDRLMIELDGTANKERLGANAILGVSEAVAAAAAKSAGLPLYAYLGGAGQARLPIPMINILNGGKHADSSLDFQEFMIMPVGAPSFAEAMRYATETFQALKSILKAKGHATSVGDEGGFAPQLQSNDEACDLIVEAITKAGYEPGEDIAIALDPAASSFHENGVYRLTRSGQGDKTSSEMTDLYRRWIDKYPIVSIEDGLAENDWDGFREHTAVLGEKIQIVGDDLLVTNTRFIQRAIEEKSCNAVLIKLNQIGTVTETVEAIHLCRKAGWGFVISHRSGETEDTFMADFAVAMGGGQIKTGSVCRSERMAKYNRLLEIESDLGKAARFGR

SEQ ID NO: 30348 - protein, 469 aa, Methylococcus capsulatus str. Bath
MTPKDVLQIIKEKEVRYVDLRFADTRGKEQHVTVPASTIDEAAFEEGKMFDGSSIAGWKGINESDMILMPDASTAVMDPFFDDPTLILRCDIVEPATMQGYERDPRSIAKRAEAYMKSTGIADTALFGPENEFFIFDDVRWGANMSGSFYKVDSEEAGWNSEKVYEDGNIGHRPGVKGGYFPVPPVDSFQDLRSAMCNTLEDMGMVVEVHHHEVATAGQCEIGVRCNTLVKKADEVLLLKYAVQNVAHAYGKTATFMPKPLVGDNGNGMHVHQSLAKDGKNLFSGDLYGGLSETALHYIGGIIKHAKALNAFCNASTNSYKRLVPGFEAPVMLAYSARNRSASIRIPYVMNPKARRIEVRFPDSTANPYLAFAAMLMAGLDGIQNKIHPGDAMDKDLYDLPPEEEKAIPQVCYSFDQALEALDKDREFLTRGGVFTDDMIDAYLDLKGQEVTRLRMSTHPVEFDMYYSL

SEQ ID NO: 30349 - protein, 433 aa, Methylococcus capsulatus str. Bath
MPLIFGVCCLVVAAAHMVPAARAAAGEFFNGLLGKRMTKSADVLFVLLGAIMVLAMHAGFAFLEVGTVRRKNQVNALVKILSDFAMSTIAYFFIGYELAYGVDFFDSALALTVDNGYGLVKFFFLLTFAAAIPAIVSGGIAERSKFNPQLAATFLLVGFVYPLFEGIAWNSNLGFQGWLQTRFGAQFHDFAGSVVVHAVGGWIGLAAVLLLGPRRGRYHRDGMIAAHPPSSIPFLALGAWILTVGWFGFNVMSAQNLNGISGLVAVNSLMAMVGGTLAALLAGRNDPGFVHNGPLAGLVAVCAGSDLMHPIGALAVGAVAGFLFVYLFTLTQNRWKIDDVLGVWPLHGLCGAWGGIAAGIFGQSALGGIGGISFMAQVLGTGLGVAIALAGGLAVYGAAKTLIGLRLTPEEEFDGADLTLHRISSSPEKEAGW

SEQ ID NO: 30350 - protein, 450 aa, Methylococcus capsulatus str. Bath
MSRYEFPERFLWGAATSAYQVEGSPLADGAGPSNWHRFCRQPGRILNGDTGDTACDHYRRFREDVALMKALGLSAYRFSIAWSRIFPEGKGRINWRGIAHYQALVETLLEHGIRPMATLHHWDLPAALEDLGGWANRDSAGWFADYAHTVIRALGNEIDLWATLNEPWVIMDAGYVSGVHPPGHRSLKDAPWVTHNLLRAHALAVQAFRADGRGQIGLVVNLEPKYALTDSRDDRAAAERAHAYMNRQYLDPVLHGAYPDELAEISALHWPSFESEDLRVIQEPIDYLGINYYTRAVVRHDPSGGPLEVTAVPQRGVEHTEMGWEVYPQGLKDVLAWVKARYGDIPLYITENGAAFADPEGENGRIDDTRRIAYYRSHLRALHEAIAQGVDVRGYFAWSLLDNFEWTYGYARRFGLVQVDPLTQRRIPKASAGFYAEVAQTNGAVLDRDY

SEQ ID NO: 30351 - protein, 161 aa, Methylococcus capsulatus str. Bath
MEFTTAGLCDQFHGTHPLQIVEPLFRPFGAVSRFHGRITTLKVFEDSVLIRETLAQEVDGRVLVIDGGASHRCALLGGNLARLAADNGWQGIIVYGCVRDSVELGTVPIGIRALHTHPLDSHKRGGGDRDCLITFASVNFRTDHYLYADEDGIVVSEEKLI

SEQ ID NO: 30352 - protein, 355 aa, Methylococcus capsulatus str. Bath
MPTAKAYAAFSADSALAPFVLQRRDPLPQDIRIGILYCGVCHSDLHQARNEWNATTYPCVPGHEIVGKVLEVGRSVTKFKPGDTVAVGCMVDSCRTCPNCVDALEQHCEHGPVFTYNSPDPHGGGMTFGGYAESIVVDEAFVLRIPDGLDLAAAAPLLCAGITTYSPLRHWKVGAGQRVGVVGLGGLGHMALKFAHTFGAETVLFTTTPDKAEDARRLGADEVVVSRDPEAMARQAGRFDFILDTVSAPHDIDAYLNLLRRDGTLTLVGVPPQGVQVMPFSLIGGRRRLAGSLIGGIRETQEMLDFCGEHGIVCDIELIPIQGINDAFERMLKSDVKYRFVIDMATLNGESSGGR

SEQ ID NO: 30353 - protein, 510 aa, Methylococcus capsulatus str. Bath
MQASLPAALRLAADRFSSLPAILTDERRVDFAEFDRASDAIAAGLAVRGVAKGERIGLYCINSVEFTLAYAGIVKAGAVVVPINLLLSAEEVHYNLADAGVSGLIYHGQVSANAAAVADRLSGLKVRAGIGLDDQDGDVWRALLEESAEPPSIEFDAVEDLAAILYTSGTTGHPKGAMLTHGNLLANTTSVREALDWRPGEDRVLVVLPMFHAFAATVGMLTPLLHGCALIPLAKFEPDRVADTIGRHRATLFLGVPSMYALLCRLGEERIARFGTVRLCVSGGAALPPSVMEQFQARFGLPIHEGDGPTECSPVTCVNPVAGPVKRGTVGLPVPGVEMKILGEDGVELPRGELGEIAVRGANVFKGYWNQPEATRECFRDGWFLTGDLGQVDDDGYFSIVDRKKDLIIVNGMNVYPRVIEEVLCRHPAVREVAVVGDPDPLHGERVVAYVVLDAPASEAEIRAWCKPYLGRHEIPRQVKALQQLPRNAAGKIVKRQLRRQGEVERGVDA

SEQ ID NO: 30354 - protein, 491 aa, Methylococcus capsulatus str. Bath
MSHELRLDQPGLLRTRCLIDGQWVDADHSKTFSVTDPATGRALADVPAMGAAETMRAIAAAEHAWTGWRGKTAKERAAVLRRWYELILSHTEDLARILTAEQGKPLTEARNEIGYAAGFVEWFAEEAGRAYGETIPSPVPDKRLLVIRQPIGVCAAITPWNFPAAMITRKIAPALAAGCTVVVKPAEQTPLTALALADLAVQAGFPPGVINVVTGDPEAIGGELTSNPLIRKLSFTGSTEVGRLLMAQCAATVKKISLELGGNAPFIVFEDADLDAAVEGALLSKYRNTGQTCVCTNRFLIQDSIYDAFAERLAAKVRRLEVGNGLDEGVVQGPLIDEQALAKVERHIADALDRGARVLAGGGRHPLGGRFFQPTVLVDVTPEMLCTREETFGPVAPLLRFGSEEEALAIANATEYGLAAYFYTRDLARAFRVGEALEYGMVGINTGMLSYDVAPFGGVKQSGIGREGSHHGMDEYLELKYLCLGGMAPSA

SEQ ID NO: 30355 - protein, 362 aa, Methylococcus capsulatus str. Bath
MANDPSLAELRKRIDELDDRVLELLNQRARCAQRVADIKVAAGETDCFYRPEREAEILQRLTAHNPGPLGREAVVRFFREVMSECLALEKPLSVAFLGPEGTFTQQAAYRHFGHAIQAVPMPAIDEIFRAVESGACHYGVVPVENSTEGVITHTLDSFVRFSLIIAGEVQLRIHHNLLCRTPTALTELTEVFSHPQSLAQCRGWLDRFLPGVRRTPLGSNAEAARRAAETAGTAAIAGEVAAGLYGLEILNRNIEDEPDNTTRFLVIGGQPVGPTGHDKTSLLLSTRNDPGALFRLIEPFARLGISMTKIESRPSRRGMWDYFFFIDVEGHQADPTLAQALAEVREHCCMMRILGSYPRALS

SEQ ID NO: 30356 - protein, 323 aa, Methylococcus capsulatus str. Bath
MSKPKVLVTRRWPESCESRLRESFHVVFNADDHPMSRDELKAALRDYDAVLPTVTDAIDADVLSVEPLRCKILGNFGVGFNHIDLDTARQRGIAVTNTPDVLTDCTADIAMLLMLAVARRGGEGEREVRSGRWTGWRPTHMLGTKVTGKILGLVGFGRIARAMAKKAHFGFDMPVIFYDPFPPPQDLIDALGAEQCGTLEEVLERADFVALHCPGSKENRHLINADRLARMKPQSYLVNTARGDVVDNEALIQALRNRRIRGAGLDVYEGEPRLNPGFLELDNVVLFPHLGSATEETRIAMGMRVIDNITAFFEGRPPRDKVT

SEQ ID NO: 30357 - protein, 447 aa, Methylococcus capsulatus str. Bath
MVYRCTGCGQSQPKWSGQCGGCGQWNTLVEEIEAPAVGRRRAGYAGAAEGSMPVSLAEVSREDLSRVTSGLGELDRVLGGGVVPGSAILLGGDPGIGKSTLLLQTLAYLGKSARTLYVTGEESLSQVSLRAHRLGLDGHGIQALAETSLERILDTAERHKPEVLVVDSIQTVYSEALQSAPGSVGQVRECSAQLVRYAKQSSTTVFLVGHVTKEGALAGPRVLEHMVDTVLYFEGDASSRYRVVRSFKNRFGAVNELGVFAMTETGLKEVRNPSAIFLSRGDEDMPGSIVTVTREGSRPLLVEVQALVDESHLQSPRRLVVGMEMNRLAMLLAVLHRHGGVPVAAQDVFVNLVGGVRLTETAGDLAIACAVVSSFRDRPVPGEWVIFGELGLNGEIRPVPNGEERLREAAKHGFKYALVPAKNAPKQGVPGVSIIAARNLREAINAL

SEQ ID NO: 30358 - protein, 1066 aa, Methylococcus capsulatus str. Bath
MQVTRRQFFRLSAATLGGSSLAVMGFSPREALAEVRQFKLARTTETRNTCPYCSVACGLIMYSLGDKAKNAKAEIIHIEGDPDHPVSRGSLCPKGAGLLDFVRSPSRLKYPEYRAPGSDAWKRVSWDWALERIARLLKEDRDRNFIARNEQGQTVNRWTSLGFLAASAGSNETGYLTNKIARALGIVMLDSQARICHAPSVSALASSFGRGAMTNTWMDIKNADVILVMGGNPAEAHPVGFKWAIEAKARNKARLIVVDPRFNRTAAVADFYAPIRAGTDIAFLNGVIRYLLEKDAINHEYVRAYTNASFIVREDFRFEDGLFSGYDAGKTEQHYDRSTWTYELDEHGYARIDPTLRHPRCVFQLLKTHVERYTPDKVTELTGTPTDAFLKICDLIASTAVPDRTLTSLYALGWTHHSVGVQNIRVMAMIQLLLGNIGVSGGGVNALRGHSNIQGLSDLGLLTDMLPGYITLPKDGETSRAVYLEKRTLKPLRPGQLSYWSNLPKFHTSLMKAWYGKAATRDNDYCYDWLPKLDKPYDSLRMFDLMAQGKVNGFICQGFNPLASYPDKGKIATALARLKFLVVMDPLATDTSVFWQNHGEYNPVNPADIQTEVFRLPTTCFAEEDGSLVNSSRWLQWHWKGAEPPGEARNDIEIMSALYLRLREMYEKESGAFPDPILNLHWPYQKPEEPTPEELAREYSGYAVADVADPKDPSKVLVKAGQQLAGFAQLQDDGSTACGNWIFSGAFTEAGNQMARRDTSDPTGLGIAPGWAWAWPANRRILYNRASCDPDGKPWNEKRPIIHWDGSRWTGLDVPDYKADVPPGSDMSPFIMNPEGVGRLFGADRLTDGPFPEHYEPYETPLDTNPLHPKVVSNPAARVFPGDKAMLGGKDDFPYVATTYRLTELFNTWTDHVRINASLQPEQFVEIGQELARELGIANGEIVTVRSRRGFIKAVAMVTKRIKPLTVAGQTVHQIGIPVHWGLQGQTRKGFFANNLTPYLGDANTQTPEYKAFLVKVEKDLSEPGPHTQKRGEAQEGRRRSGGNGTAGATEKSSWLTRVLKGRLEV

SEQ ID NO: 30359 - protein, 396 aa, Methylococcus capsulatus str. Bath
MSKEKFTRTKPHVNVGTIGHVDHGKTTLTAALTKCMAAKFGGEFKAYDQIDAAPEERARGITIATAHVEYESAARHYAHVDCPGHADYVKNMITGAAQMDGAILVVSAADGPMPQTREHILLARQVGVPYIVVFLNKADMVDDPELLELVEMEVRELLSKYDFPGDDIPIIKGSALKALEGDGSEIGVPAVEALVQALDDYIPEPERAIDRPFLMPIEDVFSISGRGTVVTGRVERGIIKVGEEIEIVGIRPTAKTTCTGVEMFRKLLDQGQAGDNIGVLLRGTKREDVERGQVLAKPGSITPHTHFEAEIYVLSKEEGGRHTPFFNGYRPQFYFRTTDVTGAVTLPEGVEMVMPGDNVKIEVKLIAPIAMDEGLRFAVREGGRTVGAGVVSKIIE

SEQ ID NO: 30360 - protein, 436 aa, Methylococcus capsulatus str. Bath
MSVVCGPGNNGGDGYVIARLALAAGFDVRAYPVGPVERLRGDGAAAFAEYRNADGPLLNFIPPGFEGAEILVDALLGTGLDRDVTDEYAAVIDAVNDFPGKVVAVDIPSGLNADTGAVMGNAVRADLTVSFIGLKQGLFTGAGPAHCGEIVFDDLDTPPEIRLAQTPSSRLLRSNDFTLPPRRRDAHKGHYGHVLVIGGECGYSGAARMAAEAAARTGAGLVSIATRTSHAPLLNVGRPELMVHGAESGGELGPLLQRASVLALGPGLGQGEWAKALFDAALDCGKPAVIDADALNLLAKLPRRCDHWILTPHPGEAARLLGVAVADVQRDRFAAVSALQRRYGGVAVLKGAGTLIAGPDGVPHVARWGNPGMASGGMGDVLTGVIAGLRAQHVPPFESACLGVRIHGQAGDLAASAGERGLLAGDLIDALRACIN

SEQ ID NO: 30361 - protein, 348 aa, Methylococcus capsulatus str. Bath
MSIEIRNITKSFGSFQALKGIDLTIGSGELVALLGPSGCGKTTLLRIIAGLEAADSGQILLHGEDTTHRHVRERRVGFVFQHYALFRHMSVFENIAFGLRVRPRGQRPPEAEIRRRVQELLELVQLDWLADRHPGQLSGGQRQRIALARALAVEPKVLLLDEPFGALDAKVRKDLRRWLRRLHDGLHITSVFVTHDQEEALEVADRVVVLNAGQIEQVGSADEVYDHPATPFVCQFIGDVNLFHGRVHGGRALIGETVIELPDIAESDTEKALFFARPHEIEIGRGTGIGAVVRAIRRRGNAVRVELERKDGRGAVEAELSREAFGRHAIKHGDEVVIQPSKIRMFQP

SEQ ID NO: 30362 - protein, 462 aa, Methylococcus capsulatus str. Bath
MSSRIADLLKNRRGENFDLHEKHLNTQMVRVLKTIGYDRVYVRAQGPYLYDDQDREYLDLLSGFGVFALGRNHPQVVGALKDVLDAQLPDLVQMDVSLLSGLLSEKILQRCPGDLSRMFYCNSGAEAVEAAIKFARYTTKREKIVYCEHGFHGLTLGALSLNGEQVFRDGFGPLLPACKAVPFNDLGALEAALRHNDVAAFIVEPIQGKGVNLPDEGYLAEAARLCRKHGALFVADEIQTGIGRTGKFWAIEHWGVEPDMILMAKALSGGFIPVGAVAMKKHIMEAVFNRMDRAVVHGSTFSKNNMAMAAGIATLEVLAEERLVENAAKLGEQIISGIRAMTDRYELLHAVRGKGMMIAVEFGAPKSFSLKAAWSLLETANKGLFSQMITIPLFKNHRILSQVAGHGMNVVKFLPPLVIGQRDADWILQAMDTVIADCHKVPGAIWDLGKNLTSHALKTKAG

SEQ ID NO: 30363 - protein, 310 aa, Methylococcus capsulatus str. Bath
MKIANSVTDLIGNTPLVRIHRLSAGCGAEVVAKLEFFNPAHSVKDRIGAAMIDAAEQAGLIGPDTVIVEPTSGNTGIALAMVCAARGYRCVLTMPETMSKERRMLLRAYGAELVLTPGPDGMGGAIRKAEELAASDPKYFMPQQFKNAANPEIHRRTTAEEIWRDTEGRVDIVVAGVGTGGTITGVGEVLKQRKPSLRCVAVEPDASPVLSGGEKGPHPIQGIGAGFVPPILNTTIYDEVIRVKNDDAFEFARRAAREEGLLVGISSGAALWAARQLACRPENAGKLIVTIIPSFGERYLSTALFAHLED

SEQ ID NO: 30364 - protein, 262 aa, Methylococcus capsulatus str. Bath
MRQKERLLLVLAVLAVTGALFVPPIPQDPAYHRFADGTARFGIPNFWNVVSNLPFLAVGLAGVLDVYRGRPAILGEFHIAYLIFFAAVALVAPGSAYYHLNPDNATLVWDRLPMTVAFMALFSIVLAEYVSVALGRRLLWPLLVIGVVSVVYWDFTEAQGRGDLRLYGLVQFLPMLLIPPILLLFRSRFGGTAYLWAVLGAYAVAKAAELLDEPIFRIFHPLSGHALKHLLAALGVYVFLAAIRRRSTVSPSSVCRHEKETP

SEQ ID NO: 30365 - protein, 342 aa, Methylococcus capsulatus str. Bath
MKAWVIDRIGPLDSSRTLLRATDLPVPEPGPGEILLQVAVCGVCHTEIDEIEGRTAPPRLPVVPGHQAVGRIAALGSGVAEFALGDRVGVAWIFSACGECEFCRSGRENLCFAFCATGRDVDGGYAQYMTVPAAFAFRIPEGFTDAEAAPLLCAGAIGYRSLNLSGLKNGQPLGLTGFGASAHLVLMMARYRFPDSEVYVFARHPEERAFALQLGAVWAGDTADIAPAPLAAIIDTTPAWKPVVAALANLAPGGRLVVNAIRKAPDDRACLAELDYARHLWMEREIKSVANVARSDVAGFLALAAEMGIRPETEEYPFEDADRALLDLKQRRIRGAKVLRVT

SEQ ID NO: 30366 - protein, 385 aa, Methylococcus capsulatus str. Bath
MRPSRRPRFRNILENRTIAAMTRSTIASFRAVSKHYGSHCALRDFNLELREGELLTLLGPSGCGKTTVLRLLAGLEIPDSGEIFLDGRTLAGVPPEARNVNTVFQSYALFPHLSVAENVAFGLRMKKLGSAEIRARTAEALRMVRLDGLGGHRPLQLSGGQQQRVALARALVNRPRVLLLDECLSALDYQLRREMQLELKGLQRQTGITFVFVTHDREEALSMSDRIAVMRTGRIEQLGPPRDIYERPANLFVAQFAGESNVLEATVTAITAPDSLIVELAGTPLTVRTDRRFRVGARLVLVLRPEDLHVHDDAAAEGGLAGHVLERTYRGVTLDTVIALDAGPRIKTSEFFREDTPALDHPPGQRVRVSWTPGWEIVLPHDPET

SEQ ID NO: 30367 - protein, 372 aa, Methylococcus capsulatus str. Bath
MTNPLFQPFRLGPHTLKNRMVMAPLTRSRAGQPGNVPTALNAEYYRQRASAGLIISEATQVSPQGQGYAWTPGIHSAEQVAGWRLVADAVHGAGGLMFMQLWHVGRVSHPALQPGGALPVAPSAIAPTGMAFIVNAEGQGELVPFVTPRVLELDEIPGIVGQYRDGARNAMAAGMDGVEVHAANGYLLDQFLNSSSNHRRDAYGGSPENRARLLMEVLEAVCGVWGADRVGVRLSPLGTFNDMGDADPEATFGYVAERLNDFGLAYLHVVEPFMAGNAPAATPDPRGEAIMAMIRMSFRGPLIVCGGYDQAKAVACLESGRADLVAFGRLFIANPDLPERFRRGAALNGWNEATFYGGGAEGYTDYPSLTDA

SEQ ID NO: 30368 - protein, 164 aa, Methylococcus capsulatus str. Bath
MNIYEFEVRTLEGETVRLDGYRGKVLLIVNVASRCGFTPQYAGLEALYRRHRNAGLVILGFPCNQFGGQEPGSETEIRRFCSSRYEVSFPLFAKIEVNGEHTHPLYAYLKSAQPGLLGSEAIKWNFTKFLVGRNGEVVKRYAPTATPESIEPGLLPLLTVGSGG

SEQ ID NO: 30369 - protein, 358 aa, Methylococcus capsulatus str. Bath
MGNPDQPTPQHIVDKLIESSRKGTNHRYSVSKGIPRLRRAICHWYLNRYGVELDPDSQAIVTIGSKEGLAHLALATVGPGDAVLVPNPAYPIHPYGFVLAGADVRHVPLLPGVDFFAELEMAIKTSWPKPKMLVLNFPANPTAQCVDLEFFEKVVEIAREYKIWVVHDLAYADLVFDGYVAPSILQVPGAEDIAVEFFTLSKSYNMPGWRVGFMCGNRELVSALGRIKSYLDYGTFTPIQVAAITALEGPQDCVENIRLMYQNRRDVLCKGLNDIGWPVEKPKGTMFVWARIPERYQSLGSLEFAKKMLLDAHVAVSPGIGFGEFGDDHVRFGLIENEHRTRQAIRGVRDMMRKDNAV

SEQ ID NO: 30370 - protein, 424 aa, Methylococcus capsulatus str. Bath
MNLKEFKQAGHWPTLLSAFLYFDVSFMVWVMLGPLSLYITKDLALPLEEKFTIVAIPILSGAVFRIILGSMADHVGPKPTGILAQLLVILGLAYVFWFGLHSKLEVELLGLLLGVAGASFAVALPQASRWYPPKFQGVVMGIAGAGNMGVVLDSMIVPWLAEKFGWQAVFGFLLIPLVIVLTVYAVLVKDAPDKRAPVTLANYASVMKDPDAWWFMFFYSITFGGFVGLGNALPLYFTHWYHVSGIAAGMMVAIVVFAGSMFRPVGGYLADRIGGIRALQILFVVVSLAYLAISFMPEGPAPEALGTAKVAGWSLGELPAQGWGAVAVFFAGTLALGMGNGSVFQLVPLRFRKEIGVVTGLVGCAGGVGGFFLAKTLGLSWEIQHGFALGFSVFAVLPLLGLGGLMLVRKRWRTTWGAVSGARV

SEQ ID NO: 30371 - protein, 250 aa, Methylococcus capsulatus str. Bath
MRRPLVVGNWKMNGRSASVARLLNDILAGIGDCKAEVGVCVPFVYIPQASEILKGTKVMLGAQNVADHNSGAFTGEISAGMLREFGCELAIVGHSERRLLYGESNELVASRYEQAIQGHLKPILCVGETLEQREQGRTLAVIGAQIDTVFEFAGVQSLEHAVIAYEPVWAVGTGRSATTGQAQEVHYHIRSLIARWNPEVAQAVQIIYGGSVKPENSAELFAMPDIDGGLIGGASLDARAFLSICHSVSV

SEQ ID NO: 30372 - protein, 156 aa, Methylococcus capsulatus str. Bath
MFSVAKSRRRGFLPALFAIGLAACGPSFDGEKNLMEARQFMAANGQKAGVVTTASGLQYEVIREGAGESPKATDTVTVNYKGGFPDGSTFDAGDGVSFPLNGVIPGWTEGLQLMKPGAKYRFFIPPELGYGEYGVGRLIPPNAALIFEVELLKVGG

SEQ ID NO: 30373 - protein, 340 aa, Atropa belladonna
MAFRNGSTTTTITTINHPNDASTIPKNGTNITTTLLKNGSTNEFGCIKPGWFSEFSQLWPGEAFSLKIEKLLFQGKSDYQDVMLFESATYGKVLTLDGAIQHTENGGFPYTEMIVHLPLGSIPSPKKVLIIGGGIGFTLFEVFRYPTIENIDIVEIDNVVVDVSRKFFPYLAAGFDDPRVTLVLGDGAAFVKAAQAGYYDAIIVDSSDPIGPAKDLFERPFFEAVAKALRPGGVVCTQAESIWLHMHIIKQIIDNCRQVFKGSVNYAWTTVPTYPTGVIGYMLCSTKGPQVDFRNPVNPIDKKTSHIKSKGPLKFYNSDIHKAAFILPSFARNLMESELD

SEQ ID NO: 30374 - protein, 338 aa, Hyoscyamus niger
MEVISNHNNGSTTKIILKNGSICNGNVNGNSHSNEKTENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYSTIEKIDIVEIDDVVIDVSRKYFPYLAAGFDDPRVTLIVGDGAAFVKAAQPGYYDAIIVDSSDPIGPAKDLFERPFFEAVTKALRPGGVVCTQAESIWLHMHLIKQIIANCRQVFKGSVNYAWTTVPTYPTGVIGYMLCSTEGPEVNFKNPVNSIDKDTTHVKSKGPLKFYNSDIHKAAFILPSFARDLVEF

SEQ ID NO: 30375 - protein, 336 aa, Atropa belladonna
MEVNHNNGSTTKIILKNGSICNGDVNGNSHTHKKIENKLVECTNSIKPGWFSEFSALWPGEAFSLKIEKLLFQGKSDYQDVMLFESATYGKVLTLDGAIQHTENGGFPYTEMIVHLPLGSIPSPKKVLIIGGGIGFTLFEVSRYPTIDTIDIVEIDDVVVDVSRKYFPYLAAGFDDPRVTLIIGDGAAFVKAAQPGYYDAIIVDSSDPIGPAKDLFERPFFEAVAKALRPGGVVCTQAESIWLHMHLIKQIIANCRQVFKGSVNYAWTTVPTYPTGVIGYMLCSTEGPEVNFKNPVNSIDKDTSHVKSKGPLKFYNSDIHKAAFILPSFARDLVEF

SEQ ID NO: 30376 - protein, 181 aa, Oryza sativa (indica cultivar-group)
HINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAWFMVQLATIPITGTGINPARTTGPAVIFNNEKAWHNQWIFWVGPFVGAAIAAFYHQYILRAGPIKALGSFRSNA

SEQ ID NO: 30377 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLEGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 30378 - protein, 445 aa, Citrobacter amalonaticus
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSEEGFNFIGTGVSGGEEGALKGPSIMPGGQKEAYELVAPILKQIAAVAEDGEPCVTYIGADGAGHYVKMVHNGIEYGDMQLIAEAYSLLKGGLNLSNEELATTFSEWNKGELSSYLIDITKDIFTKKDEEGKYLVDVILDEAANKGTGKWTSQSSLDLGEPLSLITESVFARYISSLKTQRVAASKVLTGPQAQPAGDKAEFIEKVRRALYLGKIVSYAQGFSQLRAASDEYNWDLNYGEIAKIFRAGCIIRAQFLQKITDAYAENPAIANLLLAPYFKQIADDYQQALRDVVSYAVQNGIPVPTFSAAVAYYDSYRAAVLPANLIQAQRDYFGAHTYKRT

SEQ ID NO: 30379 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELADTFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 30380 - protein, 445 aa, Citrobacter koseri
AVMGRNLALNIESRGYTVSVFNRSREKTEEGIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 30381 - protein, 446 aa, Escherichia coli
AVMGRNLALNIESRGYTVSIFNRSREKTEEVVAENPGKKLVPYYTVQEFVESLETPRRILLMVKAGAGTDAAIDSLKPYLDKGDIIIDGGNTYYHDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYSLLKHGLNLSNPELAETFTEWNKGELSSYLIDITKDIFTKKDENGIYLVDVILDEAANKGTGKWTSQSSLDLGEPLSLITESVFARYISSLKEQRVAASKVLSGPEVKPFTGDKAEFVEKVRRALYLGKIVSYAQGFSQLRAASEENNWNLNYGEIAKIFRAGCIIRAQFLQKITDAYAENPSIANLLLAPYFKKAADDYQQALRDVVAYAVQNGISTPTFSAAIAYYDSYRAAVLPANLIQAQRDYFGAHTYKRT

SEQ ID NO: 30382 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30383 - protein, 445 aa, Citrobacter koseri
AVMGRNLALNIESRGYTVSVFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAETFTEWNKGELNSYLIDITKDIFTKKDEEGKYLVDVILDEAANKGTGKWTSQSSLDLGEPLSLITESVFARYISSLKEQRVAASKVLSGPKAQLAGDKAEFIEKVRRALYLGKIVSYAQGFSQLRAASDEYNWDLNYGEIAKIFRAGCIIRAQFLQKITDAYAENAGIANLLLAPYFKKIADDYQQALRDVVAYAVQNGIPVPTFSAAVAYYDSYRAAVLPANLIQAQRDYFGAHTYKRT

SEQ ID NO: 30384 - protein, 445 aa, Escherichia coli
AVMGRNLALNIESRGYTVSIFNRSREKTEEVIAENPGKKLVPYFTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30385 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30386 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30387 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGNYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYSQNAGIANLLLAPYFKQIADDYQQALRDVVAYAVQNGIPVPTFSAAIAYYDSYRSAVLPANLIQAQRDYFGAHTYKRT

SEQ ID NO: 30388 - protein, 445 aa, Escherichia coli
AVMGRNLALNIESRGYTVSIFNRSREKTEEVIAENPGKKLVPYYTVKEFVESLETPRRILLMVKAGAGTDAAIDSIKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30389 - protein, 342 aa, Ginkgo biloba
MAPQAYPTAGQTTTVCVTGAAGFMASWLVKRLLEKGYIVHATVRDPENKAKVSHLLNLPGATDRLKLFRAELCEDGSFDAAVAGCNGVFHVATPTEFMPKDPENDLIKPAIEGTLNVLKSCTKVDSIKRVVVTSSAATVSINNSSEQNQYIDESCWTDVNFLTSQKPPGWAYPVSKTLAEQAALKYAEEHSLDVVTVIPVLVVGPAVTPTVPSSVELALSLITGDEFKMGALKGMQFVSGSISLVHIDDVCSAQIFLMEKPSAQGRYICFPVNTGIPQLAEFLSKRYPQYKVPTKFDDVPATPKLTISSQKLLDCGFSFKYGIEDIYDQAIEYMKTKGLLTC

SEQ ID NO: 30390 - protein, 192 aa, Apium graveolens var. dulce
GNSIPPIMPIGRGAYGIVCSIMNTETNEMVAIKKIANAFDNYMDAKRTLREIKLLRHLDHENIIALTDVIPPPVRRNFSDVYIATELMDTDLHQIIRSNQVLSEEHCQYFLYQLLRGLKYIHSANIIHRDLKPSNLLLNSNCDLKICDFGLARPNTDDEFMTEYVVTRWYRAPELLLNSSDYTAAIDVWSVG

SEQ ID NO: 30391 - protein, 437 aa, Arabidopsis thaliana
MYSLILHGRKLVQLQKWRHLRVSVNLFQNGSAFSNTFSSSAIAADVSSRDGRKGHNFTVSYLVDSLGLATKVAESISMKVSFDNKGNPDSVLSLLRSHGFTDSQISNIIRTFPRLLILDAEKSLAPKLQFLQSIGASSSELTETVSAVPKILGKRKGKSLSRYYDFVKVIIEADKSSKLEKLCHSLPEGSKQENKIRNLLVLREMGVPQRLLFSLLISDAGDVCGKEKFKESLKKAVEIGFDPTTATFVKALNVLYGLSDKGIENKFNACKRLGLAVDDVWAMFKKWPNILTKSEKKIENSVETFLGLGFSRDEFLMMVKRFPQCIGYSTELMKTKTEFLVTEMNWPLKAVASIPQVLGYSLEKRTVPRCNVIKVLISKGLLESELPPISSVLTSTSEVFLYMYVRKHDDKQLVAELMAIFTGDRVSLTDQKTRLEQ

SEQ ID NO: 30392 - protein, 479 aa, Arabidopsis thaliana
MNSASVSGESSLSDMIQTVHFSSGNPRIGETRGVMHLISDNAVSSSSSSSSSNLPIGRNPLVCVLGVPNHMTYADFCQFCGSFIQHILDMRTVRNDDIENRYSILIRFDSQESTDTFFQHFRGKQFNSLDEDVCRLLFALDVQFTGYSGSIDHTQPSAAGPIEQPTCPVCLERLDQDTGGILTTMCNHSFHCSCISNWPDSSCPVCRYCQQQPENSVCCVCQTTENLWMCVICGVVGCGRYKEGHARRHWEETEHCYSLELETQRVWDYAGDNYVHRLIQSKTDGKLVELNSHGSLSKDGCGSCEYSDSGMTDALLNSKVDMIISEYNELLQAQLENQKQYFEKLLQNVKEETEQKISEAASKAISQRLQKLQTRFDRCVKEKQFLEDLNENLVKNKDVWSTKITEMKEREKKAVRAKDEKIQGLEEQLGNLMAQMDGESEVSETKEVQDATVSTTNTSSSGAGNVIHANKKKSNRRKG

SEQ ID NO: 30393 - protein, 1166 aa, Ustilago maydis
MQAVTASRPNADSASASHRIPSQPNASNPPSASLRPPDQQLPTTAASLMREGPRDFTVIKDVGDGSFGTVCLADWKSPLPSGTMLSPMQHPTTRPEYIGKRLVAIKKMKKPFPSWQECMKLKELKSLLTIPPHPNIIPLYDAFLMPTTKELHFVFECMEGNLYQLTKSRKGRPLAAGLVASIYEQIVLGLDHIHQHGYFHRDMKPENLLITTTGLADYPNLQPALAAERDVLVIVKLADFGLARETLSKPPYTEYVSTRWYRAPEVLLRSRDYSNPVDMWALGTILAELVNLKPLFPGHSEVDQVLQICDILGDPSHSYGHDSRNRRNGGGPWDRGIRMARAVGFTFPIRKPAKFSRFFSDRVPQNLIDCIEDLLRYDPQARLTSKDCLQHDYMRLDAPRLRPPQAKPLVSATAPLRPQQNASRPLPSSHSTLLSSNHARPPFGAADSNLKPLAVLRQPDGSPIVRVNAAATSDPSLANGTTPASPMQEDATEVHWAPPVVSSSRDVSLSGYPAFPDSASLYAASSSTHPDGPPSGAPSSDATMVMSDAQLTDSTLKHTDPRHAQALQAHQYEQYQRQYRHDAGQSQSPGYDAHAAAAYDRDAALRGAAFVPFVASYPGSAATGQLAAATSSGELSQKNDSNASNETISSRDKERRRSKVWGLNISSKFGGSGSSGTLAGSSSGGAANATGTHLYAVGNAAAGRLPPNGPMQESRVSLEPTPAQRIAAEHSNATLATLPNGAPAKTADSKKARKEAEKAAREAEKAKREAQQKAARDRARAVMQKRNQLLASSNSKDPVEWLAGAIQSDEPYRSSPSEKARGKQPAIPGSQLSPSMPSFASGEFPRSPLQQPIHGLSPDYGMNANPAVMGSMAWRGVGAARYSRSNKARRREHDDDHSMSSFEDAVDPRRASMQSYQTGDSDPGPGTGQQVAQGHYVQRASSSSSLASAPSLVDQRRFAPSLESHRSSADTRSISSLDHQLITNMERMTAVEARARTPGNVSPGPAHVVGARQSLSRQSRTNSRASSTSAHRQGSASPLHHASGIPRFHPYSHGGPVTPSTGYHANYQLPPLHQSLAHPSGAQRSDTAGDRSVSPAFYSNASQPQQHVHQHHINPIFHVPAGNSGHGTTLPPFSSIAASIDVPAIDEKATQMLYAQARSPGPLPQS

SEQ ID NO: 30394 - protein, 442 aa, Nicotiana tabacum
MKITWESLVPSCFKGENPKPKAKEIKVVTKQSSFHRISISDFSASTISEDLSISLAGSNLYIFTLQELKVITQNFSSSNFLGEGGFGPVHKGFIDDKLRPGLKAQPVAVKLLDLDGTQGHREWLTEVIFLGQLRHPHLVKLIGYCCEEEHRLLAYEYMPRGSLENQLFRRYSVSLPWSTRMKIAVGAAKGLAFLHEAEKPVIYRDFKASNILLDSDYSAKLSDFGLAKDGPEGDDTHVSTRVMGTQGYAAPEYLMTGHLTAASDVYSFGVVLLELLTGRRSVDKTRPNREQNLVDWARPQLKDPRKLRRIMDPRLEGLYSEEGAQKAALVAYQCLSHRPKARPEMSSVVKTLEPLKDYKDISNMIFVYIAPAEVKEMCKESEKEDQKKTIKKENSPYHQKHHHHHLDRKHRRSPQNSTIYSEKALHKKLGPNSPLRNDFHRA

SEQ ID NO: 30395 - protein, 449 aa, Pseudomonas putida
NMPEHAGASLASQLKLDAHWMPYTANRNFLRDPRLIVAAEGSWLVDDKGRKVYDSLSGLWTCGAGHTRKEIQEAVAKQLSTLDYSPGFQYGHPLSFQLAEKITDLTPGNLNHVFFTDSGSECALTAVKMVRAYWRLKGQATKTKMIGRARGYHGVNIAGTSLGGVNGNRKLFGQPMQDVDHLPHTLLASNAYSRGMPKEGGIALADELLKLIELHDASNIAAVFVEPLAGSAGVLVPPEGYLKRTREICNQHNILLVFDEVITGFGRTGSMFGADSFGVTPDLMCIAKQVTNGAIPMGAVIASTEIYQTFMNQPTPEYAVEFPHGYTYSAHPVACAAGLAALCLLQKENLVQSVAEVAPHFEKALHGIKGAKNVIDIRNFGLAGAIQIAPRDGDAIVRPFEAGMALWKAGFYVRFGGDTLQFGPTFNSKPQDLDRLFDAVGEVLNKLLD

SEQ ID NO: 30396 - protein, 333 aa, Lactobacillus delbrueckii subsp. bulgaricus
MTKIFAYAIREDEKPFLKEWEDAHKDVEVEYTDKLLTPETAALAKGADGVVVYQQLDYTAETLQALADNGITKMSLRNVGVDNIDMAKAKELGFQITNVPVYSPNAIAEHAAIQAARILRQAKAMDEKVARHDLRWAPTIGREVRDQVVGVVGTGHIGQVFMQIMEGFGAKVIAYDIFRNPELEKKGYYVDSLDDLYKQADVISLHVPDVPANVHMINDKSIAKMKQDVVIVNVSRGPLVDTDAVIRGLDSGKVFGYAMDVYEGEVGVFNEDREGKEFPDARLADLIARPNVLVTPHTAFYTTHAVRNMVVKAFDNNLELVEGKEAETPVKVG

SEQ ID NO: 30397 - protein, 379 aa, Triticum aestivum
MATAGKVIECKAAVAWEAGKPLSIEEVEVAPPHAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 30398 - protein, 1754 aa, Oryza sativa (japonica cultivar-group)
MTVRQLVFFAKPTFEELMSRIKHELDWNDESVGMQGRYEVGGGVMSHKFMLDLNGEIEWQTYIDIVLGSHFKSLEVFAWKKDGRIGKKELIESPISCHELSERCSRKEELIEEDVEGGEGVNDMADVEVREENDPVREEVHAEENVPLREEVHAEDNVPLRDEVNVEENVPVREEGDVEDGREVGDDVELPEEEANAKNVSMGLRELARLKFYTREECEEAMIRSGLNPGWLEYDTEDELDESASDSDDDRPVRKMSEHERTVFAKLVGRNPEITQFEDLTRSGLAIADGDPQYDGAFEPMCDEPRKGLEFRSMDDLKIWLQSYSIRVHRPYHVKESNASVKYTVACLDRYCKWQINARKSGGDRWRVTRVGEDHTCCSAEVTGKHLQLTSRFIGNRLHAFVRAEPTLSPAAIVEAVEQIWHYRPTYGKAWRAKQVAMKVIWGDWDEAYVRLPTLMRAIKAKNPTMHFRVEAHPEKSRMVDGVQRRVFGRAYWIFGQSIEAFKHLRPVLAIDGTFLTGKYQGTLLTAIGVDAGLHLVPLVFALVEKENTSNWEWFINMLRNKLIGPNREVCIISDRHPGILNSIIHIMPHHLTIHHRWCMRHFCANFYTAGATTDQMKDLERICQINEKALFLDEIKRLMGVVGERPKKWLEDHMPLKVKWARAFDTNGRRHSIMTSNMAESFNNVLRGIRKLPVTAIVAYTFSKCNSWFVDRHKEATVDILCGKKWPTKVKDMLEEQQRRTLGQRAACFDFPSIKYEVSEQGGVTAAGVQWGGRHYIVVARDNTCSCQFPQLHHLPCSHMITVCKLRGLDVEVAPRMCYEASNKAVQDSYSPRFEPYLDPSQWPSYDGEFFVPDLSLKNNTRGRRRTRRFKNDMDKAYKGSANRRMEHFPGLEDFYEEKHRAPQIASGERLKTLRVRGHTAHILFDDRYVPYLRRAKLLAFVTMAQRPVPLYNAAALTALVDRWRPETHTFHLPCGELTVTLEDVAMILGLPIRGQAVTGDTASGNWRERVEEYLGLEPPVAPDGQRQTKTSGVPLSWLRANFGQCPAEADEATVQRYCRAYVLYIFGSILFPDSGGDMASWMWLPLLADWDEAGTFSWGSAALAWLYRQLCDACRRQGGDANLAGCVWLLQVWMWMRLLVGRPMWRTHQAWPHQDADRRPTVAHLWESVPSPVVGRRNLAYCHYTNEMDYLQPEHVVWMPYQAQEVLELELNPMCHIEDALKTLRCPLICFYAVEFQMCHRVMRQFGRLQTIPHRFSTSIDLHKVDRRKNKKVTDWAYYHQDHITQWEKFEENGVPDQGQHNGTEFDLYLAWLHRTYRLVLRPAWTLADIADDPEDVEEQNEYDTRTRLGTTVETGPVRDRVARELLRTVNDAGVALGTAPGSEGEGGTLRNALQRLRQRCRKLAARLGCRSTDVVEHAHAHQEGDEEGEVGDEEGEQDKEAEEGDEEEEGDEDREEEADELGPSQLEDAPESSQPDISQPGPSRPLRRRAPSQDWRYTPDVPRPRTRVLLKFSRAGTSAPCKMALTCPNSAPVHLALRSQHSHPEGLLGWAKAETAKSHLSARLTGAEFPTVSAIIAGAEVLARKPSRRLAGLGQGRNGQVPPQRQSAPLWLALRSQPASHPEGLLGWAKAETAKSYLSARLAGAEFPTVSAILAGAEVPARKPSRRLAGLGLGVAAKSHLSASPVGAEIAATSAGDRPRPPRWHNVSASPVGANTANVSANVFGAEATAYFWLKFLAGLKQFSGKLVGAR

SEQ ID NO: 30399 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGIFHTEWLE

SEQ ID NO: 30400 - protein, 471 aa, Klebsiella pneumoniae
MLLPVIMAGGTGSRLWPMSRELYPKQFLRLFGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDGQGNVLSGDAWVHNSENCYINSDEKLVAAIGVENLVIISTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 30401 - protein, 150 aa, Rickettsia rickettsii
MSNSSKKHLDLPYRPGVGMMILNADNHIFVGKRIDTKISAWQMPQGGIVPGETPSIAAMREMLEEIGSDKGYVIAESKCWYSYDVPSFLIPKLWNGNFRGQKQRWFLIRFTGNNEDININTSNPEFDQWRWASLDELLSIIIPFKRKLYQ

SEQ ID NO: 30402 - protein, 142 aa, Rickettsia akari
LDLPYRLGVGMMILNADNHIFVGKRIDTKLSAWQMPQGGIVPGETPSIAAMREMLEEIGSDKGYIIAESKCWYSYDVPSLLIPKLWNGNFRGQKQRWFLIRFTGNNEDININTSNPEFDQWRWASLDELLSIIIPFKRKLYQ

SEQ ID NO: 30403 - protein, 142 aa, Rickettsia canadensis
LDLPYRPGVGMMILNADNHIFVGKRIDTKISAWQMPQGGIVPGETPSIAAMREMLEEIGSDKGYIIAESKCWYSYDLPSFLIPKLWNGNFRGQKQRWFLIRFTGNNEDININTSNPEFDQWRWASLNELLSIIIPFKRKLYQ

SEQ ID NO: 30404 - protein, 142 aa, Rickettsia rhipicephali
LDLPYRPGVGMMILNADNHIFVGKRIDTKISAWQMPQGGIVPGETPSIAAMREMLEEIGSDKGYIIAESKCWYSYDVPSFLIPKLWNGNFRGQKQRWFLIRFTGNNEDINIKTSNPEFDQWRWASLDELLSIIIPFKRKLYQ

SEQ ID NO: 30405 - protein, 355 aa, Trichoderma asperellum
MSRSNAPNASASRKISFNVSEQYDIQDVVGEGAYGVVCSAIHKPSGQKVAIKKITPFDHSMFCLRTLREMKLLRYFNHENIISILDIQKPRSYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDTLSKEQLKQLIYQEIMR

SEQ ID NO: 30406 - protein, 137 aa, Listeria welshimeri
AAANQFEGAYNVDGKGLSVQDVTPKGGFGHITDGPTPDNLKLEGIDFYHRYKDDVKLFAEMGFKVFRTSIAWSRIFPNGDETEPNEAGLQFYDDLFDELLAHNIEPLITLSHYETPLHLSKTYDGWVNRKMIDFYEN

SEQ ID NO: 30407 - protein, 445 aa, Raoultella planticola
AVMGRNLALNIESRGYTVSVFNRSREKTEEVIAENPGKKLVPHYTVKEFVESLETPRRILLMVKAGAGTDSAIDSLKPYLNKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTKWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASNEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 30408 - protein, 445 aa, Escherichia vulneris
AVMGRNLALNIESRGYTVSVFNRSREKTEEVVAENPGKKLVPYYTVQEFVESLETPRRILLMVQAGAGTDAAINSLKPYLDKGDIIIDGGNTFFHDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNKGELSSYLIDITKDIFTKKDEEGKYLVDVILDEAANKGTGKWTSQSSLDLGEPLSLITESVFARYISSLKEQRVAASKVLSGPQSQPAGDKAEFIEKVRRALYLGKIVSYAQGFSQLRAASEEYNWDLNYGEIAKIFRAGCIIRAQFLQKITDAYAETPAIANLLLAPYFKQIADDYQQALRDVVAYAVQNGIPVPTFGAAVAYYDSYRAAVLPANLIQAQRDYFGAHTYKRT

SEQ ID NO: 30409 - protein, 445 aa, Citrobacter freundii
AVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVIYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRVAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRT

SEQ ID NO: 30410 - protein, 445 aa, Shigella dysenteriae
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAFLPANLIQAQRDYFGAHTYKRI

SEQ ID NO: 30411 - protein, 445 aa, Shigella flexneri
AVMGRNLALNIESRGYTVSIFNRSREKTEEVIAENPGKKLAPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRSALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30412 - protein, 445 aa, Shigella boydii
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGNKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30413 - protein, 445 aa, Shigella sonnei
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 30414 - protein, 445 aa, Klebsiella pneumoniae
AVMGRNLALNIESRGYTVSVFNRSREKTEEVIAENTGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPVGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 30415 - protein, 445 aa, Klebsiella sp.
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNEGELSSYLIDITKDIFTKKDEEGKYLVDVILDEAANKGTGKWTSQSSLDLGEPLSLITESVFARYISSLKDQRVAASKVLTGPKAQPAGDKAEFVEKVRRALYLGKIVSYAQGFSQLRAASDEYNWDLNYGEIAKIFRAGCIIRAQFLQKITDAYEQNAGIANLLLAPYFKQIADEYQQALRDVVAYAVQNGIPVPTFSAAIAYYDSYRSAVLPANLIQAQRDYFGAHTYKRT

SEQ ID NO: 30416 - protein, 445 aa, Raoultella terrigena
AVMGRNLALNIESRGYTVSVFNRSREKTEEVIAENPGKKLVPHYTVKEFVESLETPRRILLMVKAGAGTDSAIDSLKPYLDKGDIIIDGGNTFFQDTIRRNRELSADGFNFIGTGVSGGEEGALKGPSIMPGGQKEAYELVAPILEQIAARAEDGEPCVAYIGADGAGHYVKMVHNGIEYGDMQLIAEAYALLKGGLALSNEELATTFTEWNQGELSSYLIDITKDIFTKKDEEGKYLVDVILDEAANKGTGKWTSQSSLDLGEPLSLITESVFARYISSLKDQRVAASKVLTGPQAQPASDKAEFIEKVRRALYLGKIVSYAQGFSQLRAASNEYSWDLNYGEIAKIFRAGCIIRAQFLQKITDAYEENAGIANLLLAPYFKQIADEYQQALRDVVAYAVQNGIPVPTFSAAIAYYDSYRSAVLPANLIQAQRDYFGAHTYKRT

SEQ ID NO: 30417 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENVDIANLLLAPYFKKIADEYQQALRDVVAYAVQNGIPVPTFSAAVAYYDSYRAAVLPANLIQAQRDYFGAHTYKRT

SEQ ID NO: 30418 - protein, 445 aa, Salmonella enterica
AVMGRNLALNIESRGYTVSVFNRSREKTEEVIAENPGKELVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYSENAGIANLLLAPYFKKIADEYQQALRDVVAYAVQNGIPVPTFSAAVAYYDSYRAAVLPANLIQAQRDYFGAHTYKRT

SEQ ID NO: 30419 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 30420 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKLLSGPKAQPAGNKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30421 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFLDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYLWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30422 - protein, 445 aa, Salmonella enterica
AVMGRNLALNIESRGYTVSIFNRSREKTEEVIAGNPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 30423 - protein, 445 aa, Salmonella enterica
AVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKNAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 30424 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30425 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDENGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30426 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30427 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30428 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 30429 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30430 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNCELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYFGAHTYKRT

SEQ ID NO: 30431 - protein, 445 aa, Salmonella enterica
AVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYFGAHTYKRT

SEQ ID NO: 30432 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30433 - protein, 445 aa, Salmonella enterica
AVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPASDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30434 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30435 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGQNLSNEELASTFTEWNNGELSSYLIDITKDIFTKKDEDGNYLVDVILDEAANKGTGKWTSQSALDLGEPLSLITESVFARYISSLKAQRVAASKVLSGPKKHPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30436 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASGEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30437 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30438 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVSYAVQNGIPVPTFSAAVAYYDSYRAAVLPANLIQAQRDYFGAHTYKRT

SEQ ID NO: 30439 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 30440 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYFGAHTYKRT

SEQ ID NO: 30441 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTKWNNGELSSYLIDITKDIFTKKDEDGNYLVDVILDEAANKGTGKWTSQSALDLGEPLSLITESVFARYISSLKAQRVAASKVLSGPKAQPAGGKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRT

SEQ ID NO: 30442 - protein, 445 aa, Salmonella enterica
AVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAILPANLIQAQRDYFGAHTYKRT

SEQ ID NO: 30443 - protein, 490 aa, Debaryomyces hansenii
MAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 30444 - protein, 330 aa, Staphylococcus aureus subsp. aureus N315
MTKIMFFGTRDYEKEMALNWGKKNNVEVTTSKELLSSATVDQLKDYDGVTTMQFGKLENDVYPKLESYGIKQIAQRTAGFDMYDLDLAKKHNIVISNVPSYSPETIAEYSVSIALQLVRRFPDIERRVQTHDFTWQAEIMSKPVKNMTVAIIGTGRIGAATAKIYAGFGATITAYDAYPNKDLDFLTYKDSVKEAIKDADIISLHVPANKESYHLFDKAMFDHVKKGAILVNAARGAVINTPDLIAAVNDGTLLGAAIDTYENEAAYFTNDWTNKDIDDKTLLELIEHERILVTPHIAFFSDEAVQNLVEGGLNAALSVINTGTCETRLN

SEQ ID NO: 30445 - protein, 246 aa, Methanothermobacter marburgensis str. Marburg
MVSLTKRCIAEFIGTFILVFFGAGSAAVTLMIASGGTSPNPFNIGIGLLGGLGDWVAIGLAFGFAIAASIYALGNISGCHINPAVTIGLWSVKKFPGREVVPYIIAQLLGAAFGSFIFLQCAGIGAATVGGLGATAPFPGISYWQAMLAEVVGTFLLMITIMGIAVDERAPKGFAGIIIGLTVAGIITTLGNISGSSLNPARTFGPYLNDMIFAGTDLWNYYSIYVIGPIVGAVLAALTYQYLTSE

SEQ ID NO: 30446 - protein, 294 aa, Saccharum officinarum
MEQYEKVEKIGEGTYGVVYKGLDKATNETIALKKIRLEQEDEGVPSTAIREISLLKEMNHDNIVRLHDVIHSEKRIYLVFEFLDLDLKKFMDSCPEFAKNPTLIKSYLYQILRGVAYCHSHRFLHRDLKPQNLLIDRRTNTLKLADFGLSRAFGIPVRTFTHEVVTLWYRAPEILLGAKQYSTPVDVWSVGCIFAEMVNQKPLFPGDSEIDELFKIFRVLGTPNEQSWPGVSCLPDFKTAFPRWQAQDLATIVPNLEPAGLDLLSKMLRYEPSKRITARQALEHEYFKDLEMVQ

SEQ ID NO: 30447 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 30448 - protein, 134 aa, Staphylococcus aureus
HETDEEINKKAHAIFKHGMTPIICVGETDEERESDKANDVVGEQVKKAVAGLSEEQLKSVVIAYEPIWAIGTGKSSTSEDANEMCTFVRQTIADLSSKEVSEATRIQYGGSVKPNNIKEYMAQTDIDGALVGGA

SEQ ID NO: 30449 - protein, 1227 aa, Brucella suis 1330
MTDNIPVSKVAVFQNFAPPIREQSALRQAITAAYRRPEAECVSALAEQATLPEETRQQIRSTARKLIEALRAKHKGTGVEGLVHEYSLSSQEGVALMCLAEALLRIPDMATRDALIRDKISNGDWKSHIGGGRSLFVNAATWGLVVTGKLTNTVNDRGLSAALTRLIARCGEPVIRRGVDMAMRMMGEQFVTGETIDEALKRAKELEERGFRYSYDMLGEAATTAADAERYYKDYETAIHAIGRASAGRGIYDGPGISIKLSALHPRYTRAQSERVMGELLPKVKALAAIAKSYNIGLNIDAEEADRLELSLDLLQSLCEDPDLAGWDGIGFVVQAYGKRCPFVLDFIIDLARRTKRRVMVRLVKGAYWDAEIKRAQVDGLEDFPVYTRKVHTDVSYIACARKLLAATDVIFPQFATHNAQTLATIYHLAGPDFKTGKFEFQCLHGMGEPLYDEVVGPEKLGRPARIYAPVGTHETLLAYLVRRLLENGANSSFVNRIGDKNVSVDELIADPVEVVRSMAVVGARHDQIALPENLYGARRNSAGFDLSNEVTLAELSKTLKETAGRAWTAEPQVAGAKVKGVSRPVLNPGDRNDVVGTVTEIAEADVAKAMKAAQTATTSWSAVAPAERAACLERAADIMQRDMPALLGLVMREAGKSMPNAIAEVREAIDFLRYYAEQTRRTLGVGHKALGPVVCISPWNFPLAIFTGQIAAALVAGNPVLAKPAEETPLIAAEGVRILHEGGIPADALQLLPGDGRIGAALVAAPETCGVMFTGSTEVARLIQAQLASRLLPNGKPVPLIAETGGQNAMIVDSSALAEQVVFDVIASAFDSAGQRCSALRVLCLQEDVADRILTMLKGALRELSIGRTDQLKVDIGPVITDEAKNTIEKHIQAMRDLGRKVEQLPLGPETQNGTFVAPTIIEIESLRDLKREVFGPVLHVVRYKRDDMESLIDDINSTGYGLTFGLHTRLDETIANVADRIRVGNIYINRNIIGAVVGVQPFGGRGLSGTGPKAGGPLYLGRLVETAPIPPRHASVHTDAALKDFARWLGNRGMNDLAQAARDTGSASALGLELELPGPVGERNLYALHPRGRVLLVPQTEIGLYRQLTAVLATGNTAVIDEACGLRAVLKDLPETVAARAIWTGDWQADAPFAGALIEGDSARIKEVNSRIAALPGPLVLTQAASPEDLAANQDAYCLNWLLEEVSTSINTTAAGGNASLMAIG

SEQ ID NO: 30450 - protein, 421 aa, Talaromyces emersonii
MKFLASFLCTLLFFSILALGVPTAPKRKGRSFKVDRVRRSDYVPYGPAALRKAYRKFNITQTNFGLDVLDFEPIKPSEIASKATGNPSEPDEQGAVSAMSINNDAEFVSPVQIGGQTLVMDFDTGSSDLWVFNTQLSKAAQQGHTIYDPAKSSTFKPIEGATFAISYGDGSSASGNVGTDTVNIGGATVENQAVELATEVSQSFIEDTSSNGLVGLAFSKLNTVQPQQQKTFFDNIASSLDEPVMTASLKAGGVGTYEFGRIDQTKFTGQLANISVDNSNGFWQFNSAQFAVGDGQLQNIRLAPTAIADTGTSLMLVSPEVAEAYYSQVQGAVFANQAGGFIFPCGAQLPSLSIAVGDDNLATVPPAVGSFSEIGTNTTTGQKRIQSNQGSQFQIFGDVFLKSMFVVFDQRGPSLGLATPT

SEQ ID NO: 30451 - protein, 242 aa, Cyanidium caldarium
MFIAYLTAGAPDLNTTKQALLNLANDGADVIEIGVPYSDPLADGMILQKASQQALKNGFRLEQLWHLLAEIELPVPVVILAYYNQIFHYGVEKWVTTLVNLKVKALIVPDLPYEEAAILRAACARHHLHMIWLISPTTPKVRAKQLALACDDWIYLVSRTGVTGVDAHFDNQIPNMIAELKQVTTTPIALGFGIHQKQQLQLVKSWGADGVIIGTACMQILLEKGVDQLTEWISAMKKSSYP

SEQ ID NO: 30452 - protein, 417 aa, Aspergillus oryzae
MSLSNKLAITDVDLKDKRVLIRVDFNVPLDADKKITNNQRIVGALPTIKYAIENGAKAVVLMSHLGRPDGKANPKYSLKPVATELEKLLSKSVIFAENCVGKETEEIVNKATGGQIILLENLRFHAEEEGSSKDAEGKKVKADKEKVEEFRKGLTALGDVYINDAFGTAHRAHSSMVGVDLPQKASGFLVKKELEYFAKALESPQRPFLAILGGAKVSDKIQLIDNLLPKVNSLIITGAMAFTFKKTLENVKIGNSLFDEAGSKIVGDIVEKAKKNNVKIVLPVDYVTADKFAADAKTGYATDADGIPDGYMGLDVGEKSVELYKKTIAEAKTILWNGPPGVFELEPFANATKKTLDAAVAAAQSGSIVIIGGGDTATVAAKYGAEAKLSHVSTGGGASLELLEGKVLPGVDALSSK

SEQ ID NO: 30453 - protein, 322 aa, Brassica oleracea
ELVSEFSFWLNRNADDEEGGELVFGGVDPKHFKGQHIYVPVTQKGYWQFDMGDVLIGGAPTGYCESGCSAIADSGTSLLAGPTTIITMINHAIGASGVASQQCKTVVDQYGQTILDLLLSETQPKKICSQIGLCTFDGKRGVSMGIESVVDKENAKLSNGVGDAACSACEMAVVWIQSQLRQNMTQERILDYVNELCRRIPSPMGESAVDCAQLSTMPTVSLTIGGKVFDLAPHEYVLKVGEGAAAQCISGFIALDVAPPRDLSGSWEMYSWANTTPCLTLEKHRLDLQKQPKHTVGRMVVSWLYVNNLSLFVCSGRVCVKD

SEQ ID NO: 30454 - protein, 227 aa, Phleum pratense
YYEAGARFAKWRAVLKIGPNEPSQLSIDQNAQGLARYAIICQENGLVPIVEPEILVDGPHDIDRCAYVTEVVLAACYKALNDQHVLLEGSLLKPNMVTPGSDAKKVAPRESLAEYTVRTLQRTVPPAVPAIVFLSGGQSEEEATVNLNAMNKLQTKKPWFLSFSFGRALQQSTLKAWSGKEENVGKAQKAFLVRCKANSEATLGTYKGDATLGEGASESLHVKDYKY

SEQ ID NO: 30455 - protein, 288 aa, Hordeum vulgare
MEGKEEDVRLGANKYSERHAIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARNVSLTRAVFYIIMQCLGAICGAGVVKGFQQGLYMGNGGGANVVASGYTKGSGLGAEIHGTFVLVYTVFSATDAKRNARDSHVPILAPLPIGFAVFLVHLATIPITGTGINPARSLGAAIIYNREHAWSDHWIFWVGPFIGAALAAIYHQVVIRAIPFKTKS

SEQ ID NO: 30456 - protein, 210 aa, Schizosaccharomyces pombe
MASNTAPKNVVTINQKLVLLGDSAVGKSSLVLRFVKDQFDDYRESTIGAAFLTQTLPIDENTSVKLEIWDTAGQERYKSLAPMYYRNANCAIVVYDITQASLEKAKSWIKELQRQAPEGIVIALAGNKLDLAQERRAVEKADAEAYAAEANLLFFETSAKTAENVNELFTAIAKKLPLEDKLNQARGAVNRGVNLSEARPAAQPSGSCSC

SEQ ID NO: 30457 - protein, 322 aa, Pyrus pyrifolia
MENFPVINLESLNGEGRKATMEKIKDACENWGFFELVSHGIPTEFLDTVERLTKEHYRQCLEQKFKELVASKGLEAVKTEVNDMDWESTFYLRHLPQSNISQVPDLKDEYRNVMKEFALKLEKLAEQLLDLLCENLGLEQGYLKKAFYGTNGPTFGTKVSNYPPCPNNDKIKGLRAHTDAGGLILLFQDDKVSGLQLLKDGEWVDVPPMRHSLVINLGDQLEVITNGKYKSVEHRVIAQTDGTRMSIASFYNPSSDAVIYPAPTIVEKNAEEKNQVYPKFVFEDYMKHYVGVKFQAKEPRFEAMKAVEVKTSFGLGPVKTTA

SEQ ID NO: 30458 - protein, 322 aa, Pyrus pyrifolia
MENFPVINLESLNGEGRKATMEKIKDACENWGFFELVSHGIPTEFLDTVERLTKEHYRQCLEQKFKELVASKGLEAVQTEVKDMDWESTFYLRHLPQSNISQVPDLKDEYRNVMKEFALKLEKLAEQLLDLLCENLGLEQGYLKKAFYGTNGPTFGTKVSNYPPCPNNDKIKGLRAHTDAGGLILLFQDDKVSGLQLLKDGEWVDVPPMRHSLVINLGDQLEVITNGKYKSVEHRVIAQTDGTRMSIASFYNPSSDAVIYPAPTLVEKNAEEKNQVYPKFVFEDYMKHYVGVKFQAKEPRFEAMKAVEVKTSFGLGPVKTTA

SEQ ID NO: 30459 - protein, 322 aa, Pyrus pyrifolia
MENFPVINLESLNGEGRKATMEKIKDACENWGFFELVSHGIPTELLDTVERLTKEHYKQCLEQRFKELVASKGLEGVQTEVKDMDWESTFHLRHLPQSNISEVPDLKDEYRNVMKEFALKLEKLAEQLLDLLCENLGLEQGYLKKAFYGTKGPTFGTKVSNYPPCPNPDLIKGLRAHTDAGGLILLFQDDKVSGLQLLKDGEWVDVPPMRHSIVINLGDQLEVITNGKYKSVEHRVIAQTDGTRMSIASFYNPGSDAVIYPAPTLVEKEAEEKNQVYPKFVFEDYMKLYAGVKFEPKEPRFEAMKAVEIKASFGLGPVISTA

SEQ ID NO: 30460 - protein, 314 aa, Pyrus pyrifolia
MATFPVVDMSLVNGEERAATLEKINDACENWGFFELVNHGISTELLDTVEKMNKDHYKKTMEQRFKEMVVAKGLDAVQSQIHDLDWESTFFLRHLPSSNISEIPDLEEDYRKTMKEFAVELEKLAETLLDLLCENLGLEKGYLKKAFYGSKGPNFGTKVSNYPPCPKPDLIKGLRAHTDAGGIILLFQDDKVSGLQLLKDGEWVDVPPMHHSIVINLGDQIEVITNGKYKSIMHRVIAQSDGTRMSIASFYNPGDDAFISPAPALLEKKSEETPTYPKFLFDDYMKLYSGLKFQAKEPRFEAMKARETSSVATA

SEQ ID NO: 30461 - protein, 213 aa, Geobacillus stearothermophilus
MNLVLMGLPGAGKGTQAEKIVETYGIPHISTGDMFRAAIKEGTPLGLQAKEYMDRGDLVPDEVTIGIVRERLSKDDCQKGFLLDGFPRTVAQAEALENILAELNRSIDYVIHIHVDKDILMERLTGRRICKNCGATYHLVFNPPAKPGVCDKCGGELYQRADDNEETVANRLEVNVKQTQPLLDFYEKKGYLRHINGQQDIEKVFADIRELLG

SEQ ID NO: 30462 - protein, 493 aa, Delftia acidovorans
MSQKFIDRHGLWSDAQKAAAVEVLKKIEQDGIQMIRLSWPDQYGLLRGKMLSVAALRSAFGSGSEITMAPFFFDTVSTFVFNPFSSDGGFGNPELAGSPNVVMVPDPTTFRVLPWADRTGWMLADLYMRSGRPFPLSPRALLKKALGQLADLGYDFHGGLEVEWYLTRIVDPCLEPETLGGPGTPAAPPKVMPVAKGYSYLLENHLDEVEPIMAEVRQHLLTLGMPLRSIEDELGPSQMETTFDVMSGLDMADTMVLFRNAVKQICRRRGYLASFMCKPKIEGFIASGWHLHQSLAARDSGVNAFVPQTGEPLSALGRAYVGGLLKHACAASSFTTPTVNGYRRRRPFSLAPDRVTWAEDNRAAMARVIAAPEDSASRVENRVGEPAANPYLYLASQLFSGIDGIRRQLDPGPLQETPYAADVPILPRNLAEALDVLEGSSFFREAFGEEFIHYWLHLRRSEWARFVAAEGADVDMAGDPVTDWEHREYFELF

SEQ ID NO: 30463 - protein, 344 aa, Oryza sativa (japonica cultivar-group)
MAEQAPLAPMPRVKLGTRGLEVSKLGFGCMGLTGAYNSPLDDDAGAAVIAHAFRRGVTFFDTSDVYGPLANEILLGKALKQLPREQVQVATKFGIRRGADGVRAVCGRPEYVRACCEASLGRLGVDYIDLYYQHRVDTTIPIEDTIGELKKLVEEGKVRYIGLSEASPDTIRRAHAVHPITAVQMEWSLWARDIEPEIVPLCRELGIGIVPYSPIARGFFGGRGVTEQLSAESNLQGHPRFSAENLEKNKQLYLKTEELAKKHQCSPAQLALAWVLHQGDDVVPIPGTTKIKNLDANIDSLKVNLTDDDLKEISSQVREEDVAGGRQYTSFAHYTWKYADTPKK

SEQ ID NO: 30464 - protein, 148 aa, Oryza sativa (japonica cultivar-group)
MARKNLLLLGVFLSALLFFFLDVAHARELAEASESEGKNVKPTGRSGVEDQKWGGAHGGGYGYGGGYGGGGYGHPGYGGGYGGGYGHPGYGGGYGGGYGQGYGCGYGHPGHSGGYGGGYGGGYGGGYGGGGGYGGGGGYGGGHGGGWP

SEQ ID NO: 30465 - protein, 136 aa, Oryza sativa (japonica cultivar-group)
MARKNLLLLGVFLSALLFFFLDVAHARELAEASESEGKNVKPTGRSGVEDQKWGGAHGGGYGYGGGYGGGGYGHPGYGGGYGGGYGHPGYGGGYGGGYGQGYGCGYGHPGHSGGYGGGGGYGGGGGYGGGHGGGWP

SEQ ID NO: 30466 - protein, 153 aa, Oryza sativa (japonica cultivar-group)
MASKSLLLLSVVVASLLLVAQEVAAARELTEANEAKGKNMEPEVVHVPQDEKIAYHGDGYGHGGGYGGGYGSGYGGGNGGGYGGGYGGYGGGYGGGYGGGGGGGGYGGYGGYGGGGYEGYGRGYGGGGGGGGYGGGGYPGGGYYGGGGGGGWH

SEQ ID NO: 30467 - protein, 163 aa, Oryza sativa (japonica cultivar-group)
MADLNLVFLFFLLLSPPILSDGVLQVMGTSMNRRSLLQAKGGCPVSFENQNYTTITSKCKSPWPADLCCPALNEFACNFSQYINDESTNCAESMWVYLNAHGSYPAGLFSNECAVLDCNGNNSTISTNQTANGSGTRGAKGISEMYSLVTTLIVSGLPVLLFY

SEQ ID NO: 30468 - protein, 480 aa, Oryza sativa (japonica cultivar-group)
MPREGTRMAGLWEREVGCLPPKLFANSVMASQDFVRSLGVQKRLRKHRGCVNTISFNEDGSLLLSGSDDRAAVLWNWQEGTPTFAFHTGHSDNVFHALFMPFSGDRSIITCAADGQVRHSQIQEGGRVITNELVDTEVAVHKLAIEPGNPHTFFSCGDNGSVFLFDLREKYVAELFKCAEVDHFGGDTIELYAIAIDPRKPSCFAVAGSDEYVRIYDSRKIDVNGNSSFGRPIEYFCPPHMMGENKDGISGLAFSQTSELLASYSYDNIYLFSREHGLHFNNIEVGKRLLMDEIEGDCHINTAPLPFCRDKLPAPQIFKGHRNKHTMKGVNFLGPNCDYVTTGSDCGRVFIWRKKDGELMRVMKGDKQIVNCVEQHPYGIVIANCGIDKDIKIWAPGGSENPDEVETDSCCSDISESYDSVYFDDYIFSSDFDSSEEDDEDDDDDDDDDDDDEEDGLSVSINEDMSYEEKDAASDHDSDV

SEQ ID NO: 30469 - protein, 1049 aa, Oryza rufipogon
MQPPHFSYKTQSNRLPIPVLSLALVLLLNFTSPTSSCTEQEKNSLLNFLTGLSKDGGLSMSWKDGVDCCEWEGITCRTDRTVTDVSLPSRSLEGYISPSLGNLTGLLRLNLSYNLLSSVLPQELLSSSKLIVIDISFNRLNGGLDKLPSSTPARPLQVLNISSNLLAGQFPSSTWVVMANLAALNVSNNSFTGKIPTNFCTNSPSLAVLELSYNQFSGSIPPELGSCSRLRVLKAGHNNLSGTLPDEIFNATSLECLSFPNNNLQGTLEGANVVKLGKLATLDLGENNFSGNIPESIGQLNRLEELHLNNNKMFGSIPSTLSNCTSLKTIDLNSNNFSGELMNVNFSNLPSLQTLDLRQNIFSGKIPETIYSCSNLTALRLSLNKFQGQLSKGLGNLKSLSFLSLGYNNLTNITNALQILRSSSKLTTLLISNNFMNESIPDDDRIDGFENLQVLDLSGCSFSGKIPQWLSKLSRLEMLVLDNNQLTGPIPDWISSLNFLFYLDVSNNNLTGEIPMALLQMPMLRSDRAAAQLDTRAFELPIYIDATLLQYRKASAFPKVLNLGNNEFTGLIPQEIGQLKALLLLNLSFNKLYGDIPQSICNLRDLLMLDLSSNNLTGTIPAALNNLTFLIEFNVSYNDLEGPIPTGGQFSTFTNSSFYGNPKLCGPMLTHHCSSFDRHLVSKQQQNKKVILVIVFCVLFGAIVILLLLGYLLLSIRGMSFTTKSRCNNDYIEALSPNTNSDHLLVMLQQGKEAENKLTFTGIVEATNNFNQEHIIGCGGYGLVYKAQLPDGSMIAIKKLNGEMCLMEREFSAEVETLSMARHDNLVPLWGYCIQGNSRLLIYSYMENGSLDDWLHNKDDDTSTILDWPRRLKIAKGASHGLSYIHNICKPRIVHRDIKSSNILLDKEFKAYIADFGLSRLILPNKTHVPTELVGTLGYIPPEYAQAWVATLKGDVYSFGVVLLELLTGRRPVPILSTSKELVPWVQEMVSNGKQIEVLDLTFQGTGCEEQMLKVLEIACKCVKGDPLRRPTMIEVVASLHSIDPDGLT

SEQ ID NO: 30470 - protein, 1046 aa, Oryza rufipogon
MQPPHSSCKTQSNRFPIPVLGLALVLLLNFTSPTSSCTEQEKSTLLNFLTGFSQDGGLSMSWKDGMDCCEWEGINCSQDKTVTEVSLPSRSLEGHISPSLGNLTGLLRLNLSYNLLSGAIPQELVSSRSLIVIDISFNHLNGGLDELPSSTPARPLQVLNISSNLFKGQFPSSTWKVMKNLVKLNVSNNSFSGHIPTNFCTNSPSFAVLELSYNQFSGGVPPELGNCSMLRVLKAGNNNLSGTLPDELFNATSLECLSFPNNNLEGNIGSTPVVKLSNVVVLDLGGNNFSGMIPDTIGQLSRLQELHLDNNNLHGELPSALGNCKYLTTINLKSNSFSGDLGKVNFSTLPNLKTLDIDMNNFSGKVPESIYSCSNLIALRLSYNNFYGELSSEIGKLKYLSFLSLSNNSFTNITRALQILKSSTNLTTLFIAYNFMEEVIPQDETIDGFENLQALSVDHCSLSGRIPLWLSKLTNLKLLFLSNNQLTGPIPDWISSLNRLFYLDISNNSLAGEIPITLMDMPMIRTTQNKTYSEPSFFELPVYDGKFLQYRTRTAFPTLLNLSLNKFMGVIPPQIGQLKMLVVLDFSHNNLSGQIPQSVCSLTSLRVLDLSNNNLTGSIPGELNSLNFLSAFNVSNNDLEGPIPIGAQFSTFPNSSFDGNPKLCGSMLTHKCKSAEEASASKKQLNKRVILAIVFGVLFGGAAIVLLLAHFLFSLRDAIPKIENKSNTSGNLEAGSFTSDPEHLLVMIPRGSGEANKLTFTDLMEATDNFHKENIIACGGYGLVYKAELPSGSTLAIKKLNGEMCLMEREFAAEVEALSMAQHDNLVPLWGYCIQGNSRLLIYSYMENGSLDDWLHNRDDETSSFLDWPTRFKIARGASQGLSYIHDVCKPHIVHRDIKSSNILLDKEFKAYVADFGLSRLILPNKNHITTELVGTLGYIPPEYGQGWVATLRGDVYSFGVVLLELLTGRRPVSILSTSEELVPWVLEMKSKGNMLEVLDPTLQGTGNEEQMLKVLEVACKCVNCNPCMRPTITEVVSCLDSVGSD

SEQ ID NO: 30471 - protein, 1051 aa, Oryza rufipogon
MQPLHFPSYRYSSKLPTISSLSLGLLLLISLASLTSSCTEQEKGSLHQFLAELSQDGNLSMSWRNDRNCCVWEGITCNRNGAVTDISLQLKGLEGHISPSLGNLTSLLRLNLSHNSLSGYLPWELVSSSSISVLDVSFNRLRGELQDPLSPMTAVQPLQVLNISSNSFTGQFPSTTWKAMKNLVALNASNNRFTGQISDHFCSSSPSLMVLDLCYNLFSGGIPPGIGACSRLNVLKVGQNNLSGTLPDELFNATSLEHLSVPNNGLNGTLDSAHIMKLSNLVTLDLGGNNFNGRIPESIGELKKLEELLLGHNNMYGEVPSTLSNCTNLKTIDIKSNSFSGELSKINFSTLPNLQTLDLLLNNFNGTIPQNIYSCSNLIALRMSSNKFHGQLPKGIGNLKSLSFLSISNNSLTNITDTLQILKNSRSLSTLLMGVNFNGELMPEDETIDGFENLQFVSIDDCSLIGNIPFWLSKLTNLQMLDLSNNQLTGQIPAWINRLNFLFYLDISNNSLTGGIPTALMEIPRLISANSTPYFDPGILQLPIYTGPSLEYRGFRAFPATLNLARNHLMGAIPQEIGQLKMLRTLNISFNSISGEIPQPLCNLTDLQVLDLSNNHLIGTIPSALNNLHFLSKLNVSNNDLEGSIPTGGQFSTFQNSSFVGNSKLCGSNIFRSCDSSRAPSVSRKQHKKKVILAITLSVSVGGIIILLSLSSLLVSLRATKLMRKGELANNRNEETASFNPNSDHSLMVMPQGKGDNNKLTFADIMKTTNNFDKENIIGCGGYGLVYKAELPDGSKLAIKKLNSEMCLMEREFTAEIEALTMAQHDNLVPLWGYCIHGNSRLLIYSYMENGSLDDWLHNRDDDASSFLDWPTRLKIAQGASLGISYIHDVCKPHIVHRDIKSSNILLDKEFKAYIADFGLSRLILPSKTHVTTELVGTLGYIPPEYGQSWIATLRGDIYSFGVVLLELLTGRRPVPLLSTSKELVPWVQEMRSVGKQIEVLDPTVRGMGYDEQMLKVLETACKCVNYNPLMRPTIMEVVASLDSIDADRNT

SEQ ID NO: 30472 - protein, 1047 aa, Oryza rufipogon
MQLLHYKKHSNKFPIPVLALALVLLINLASLTSSCTEQDRSSLLKFIRELSQDGGLSASWQDGTDCCKWDGIACSQDGTVTDVSLASRNLQGNISPSLGNLTGLLRLNLSHNMLSGALPQELVSSSTIIIVDVSFNRLNGGLNELPSSTPIRPLQVLNISSNLFTGQFPSSIWDVMKNLVALNVSSNKFTGKIPTRFCDSSSNLSVLELCYNQFSGSIPSGLGNCSMLKVLKAGHNKLSGTLPGELFNDVSLEYLSFPNNNLHGEIDGTQIAKLRNLVTLDLGGNQFIGKIPDSISQLKRLEELHLDSNMMSGELPGTLGSCTNLSIIDLKHNNFSGDLGKVNFSALHNLKTLDLYFNNFTGTIPESIYSCSNLTALRLSGNHFHGELSPGIINLKYLSFFSLDDNKLTNITKALQILKSCSTITTLLIGHNFRGEVMPQDESIDGFGNLQVLDINSCLLSGKIPLWLSRLTNLEMLLLNGNQLTGPIPRWIDSLNHLFYIDVSDNRLTEEIPITLMNLPMLRSTSDIAHLDPGAFELPVYNGPSFQYRTLTGFPTLLNLSHNNFIGVISPMIGQLEVLVVLDFSFNNLSGQIPQSICNLTSLQVLHLSNNHLTGEIPPGLSNLNFLSAFNISNNDLEGPIPTGGQFDTFSNSSFEGNPKLCDSRFNHHCSSAEASSVSRKEQNKKIVLAISFGVFFGGICILLLLGCFFVSERSKRFITKNSSDNDGDLEAASFNSDSEHSLIMITRGKGEEINLTFADIVKATNNFDKAHIIGCGGYGLVYKAELPDGSKIAIKKLNSEMCLTEREFSAEVDALSMAQHANLVPFWGYCIQGNLRLLIYSLMENGSLDDWLHNWDDDASSFLDWPTRLKIAQGASQGLHYIHDVCKPHIVHRDIKSSNILLDKEFKSYIADFGLSRLVLPNITHVTTELVGTLGYIPPEYGQSWVATLRGDMYSFGVVLLELLTGRRPVPILSTSEELVPWVHKMRSEGKQIEVLDPTLRGTGCEEQMLKVLETACKCVDCNPLKRPTIMEVVTCLDSIGTEIKI

SEQ ID NO: 30473 - protein, 1049 aa, Oryza rufipogon
MHPLHSPCKKHSNKFPIPVLALALVLLINLASLTSSCTEQDRSSLLRFLRELSQDGGLAASWQDGTDCCKWDGITCSQDSTVTDVSLASRSLQGRISPSLGNLPGLLRLNLSHNLLSGALPKELLSSSSLITIDVSFNRLDGDLDELPSSTPARPLQVLNISSNLLAGQFPSSTWVVMKNMVALNVSNNSFSGHIPANFCTNSPYLSVLELSYNQLSGSIPPGFGSCSRLRVLKAGHNNLSGTIPDEIFNATSLECLSFPNNDFQGTLEWANVVKLSKLATLDLGENNFSGNISESIGQLNRLEELHLNNNKMFGSIPSNLSNCTSLKIIDLNNNNFSGELIYVNFSNLPNLKTLDLMRNNFSGEIPESIYTCSNLTALRVSSNKLHGQLSKGLGNLKSLSFLSLAGNCLTNIANALQILSSSSNLTTLLIGHNFMNERMPDGSIDGFENLQVLSLSECSLSGKIPRWLSKLSRLEVLELDNNRLTGPIPDWISSLNFLFYLDISNNSLTGEIPMSLLQMPMLRSDRAAAQLDRRAFQLPIYISASLLQYRKASAFPKVLNLGKNEFTGLIPPEIGLLKVLLSLNLSFNKLYGDIPQSICNLTDLLVLDLSSNNLTGTIPAALNNLNFLSEFNISYNDLEGPIPTGGQLDTFTNSSFYGNPKLCGPMLVRHCSSADGHLISKKQQNKKVILAIVFGVFFGAIVILMLSGYLLWSISGMSFRTKNRCSNDYTEALSSNISSEHLLVMLQQGKEAEDKITFTGIMEATNNFNREHIIGCGGYGLVYRAELPDGSKLAIKKLNGEMCLMEREFSAEVETLSMAQHDNLVPLLGYCIQRNSRLLIYSYMENGSLDDWLHNKDDGTSTILDWPRRLKIAKGASHGLSYIHNICKPRIVHRDIKSSNILLDKEFKAYIADFGLSRLILPNKTHVTTELVGTLGYIPPEYGQAWVATLKGDVYSFGVVLLELLTGRRPVPILSTSKELVPWVQEMISEGKQIEVLDSTLQGTGCEEQMLKVLETACKCVDGNPLMRPTMMEVVASLDSIDPDLKMQ

SEQ ID NO: 30474 - protein, 1063 aa, Oryza rufipogon
MQKQQQLHSSCKKCSNRCFIDFLRFNLAFALLLLLSLASPTSSCTEQERSSLLQFLSGLSNDGGLAVSWRNAADCCKWEGVTCSADGTVTDVSLASKGLEGRISPSLGNLTGLLRLNLSHNSLSGGLPLELMASSSITVLDISFNHLKGEIHELPSSTPVRPLQVLNISSNSFTGQFPSATWEMMKNLVMLNASNNSFTGHIPSNFCSSSASLTALALCYNHLSGSIPPGFGNCLKLRVLKVGHNNLSGNLPGDLFDATSLEYLSFPNNELNGVINGTLIVNLRNLSTLDLEGNNIAGWIPDSIGQLKRLQDLHLGDNNISGELPSALSNCTHLITINLKRNNFSGNLSNVNFSNLSNLKTLDLMGNKFEGTVPESIYSCTNLVALRLSSNNLQGQLSPKISNLKSLTFLSVGCNNLTNITNMLWILKDSRNLTTLLIGTNFYGEAMPEDNSIDGFQNLKVLSIANCSLSGNIPLWLSKLEKLEMLFLLDNRLSGSIPPWIKRLESLFHLDLSNNSLIGGIPASLMEMPMLITKKNTTRLDPRVFELPIYRSAAGFQYRITSAFPKVLNLSNNNFSGVIPQDIGQLKSLDILSLSSNNLSGEIPQQLGNLTNLQVLDLSSNHLTGAIPSALNNLHFLSTFNVSCNDLEGPIPNGAQFSTFTNSSFYKNPKLCGHILHRSCRPEQAASISTKSHNKKAIFATAFGVFFGGIAVLLFLAYLLATVKGTDCITNNRSSENADVDAPSHKSDSEQSLVIVSQNKGGKNKLTFADIVKATNNFDKENIIGCGGYGLVYKADLPDGTKLAIKKLFGEMCLMEREFTAEVEALSMAQHDNLVPLWGYCIQGNSRLLIYSYMENGSLDDWLHNRDDDASTFLDWPKRLKIAQGAGRGLSYIHDACKPHIIHRDIKSSNILLDKEFKAYVADFGLARLILANKTHVTTELVGTLGYIPPEYGQGWVATLKGDIYSFGVVLLELLTGRRPVHILSSSKELVKWVQEMKSEGNQIEVLDPILRGTGYDEQMLKVLETACKCVNCNPCMRPTIKEVVSCLDSIDAKLQMQNSVKT

SEQ ID NO: 30475 - protein, 1050 aa, Oryza rufipogon
MEKTMQPLHFSNKNHKNRFHMTYLGHALVLLLFLASPTSSCTEQERNSLIQFLTGLSKDGGLGMSWKNGTDCCAWEGITCNPNRMVTDVFLASRGLEGVISPSLGNLTGLMRLNLSHNLLSGGLPLELVSSSSIVVLDVSFNYMTGGMSDLPSSTPDRPLQVLNISSNLFTGIFPSTTWQVMKSLVAINASTNSFTGNIPTSFCVSAPSFALLELSNNQFSGGIPPALGNCSKLTFLSTGRNNLSGTLPYELFNITSLKHLSFPNNQLEGSIEGIMKLINLVTLDLGGNKLIGSIPDSIGQLKRLEKLHLDNNNMSGELPWTLSDCTNLVTIDLKSNSFSGKLTNVNFSTLPNLKTLDVVWNNFSGTVPESIYSCRNLTALRLSYNGFHGQLSERIGNLQYLSFLSIVNISLTNITRTIQVLQSCRNLTSLLIGRNFKQETMPEGDIIDGFENLQVLSLANCMLSGRIPHWLSKLKNLAVLFLYNNQFTGQIPDWISSLNFLFYLDLSSNSLSGEIPKALMEMPMFKTDNVEPRVFELPVFTAPLLQYRRTSALPKVLNLGINNFTGVIPKEIGQLKALLLLNLSSNKFSGGIPESICNITNLQVLDISSNDLTGPIPAALNKLNFLSAFNVSNNDLEGSVPTVGQLSTFPNSSFDGNPKLCGPMLVHHCGSDKTSYVSKKRHNKTAILALAFGVFFGGITILFLLARLILFLRGKNFVTENRRCRNDGTEETLSYIKSEQTLVMLSRGKGEQTKLTFTDLKATKNFDKENIIGCGGYGLVYKAELSDGSMVAIKKLNSDMCLMEREFSAEVDALSTAQHDNLVPLWGYCIQGNSMLLIYSYMENGSLDDWLHNRNDDASSFLNWPMRLKIAQGASQGISYIHDVCKPQIVHRDIKCSNILLDKEFKAHIADFGLSRLILPNRTHVTTELVGTFGYIPPEYGQGWVATLRGDMYSFGVVLLELLTGRRPVPILSSSKQLVEWVQEMISEGKYIEVLDPTLRGTGYEKQMVKVLEVACQCVNHNPGMRPTIQEVVSCLDIIGTELQTTKLN

SEQ ID NO: 30476 - protein, 1051 aa, Oryza rufipogon
MEKTMQPLQFSNKNYSNRFPITSFGLALALLLFLASPTSSCTEKESNSLIQFLDWLSKDGGLGMSWKNGTDCCVWEGITCNPNRTVNEVFLATRGLEGIISPSLGNLIGLMRLNLSHNSLSGGLPLELVSSSSIMILDVSFNYLTGDLSDLPSSTHDRPLQVLNISSNLFTGNFPSTTWEVMKSLVALNASNNSFTGKIPTSFCASAPSFALLDISYNQFSGGIPPGLSNCSTLTLLSSGKNNLTGAIPYEIFDITSLKHLSFPNNQLEGSIDGITKLINLVTLDLGGNKFIGSIPHSIGQLKRLEEFHLDNNNMSGELPSTLSDCTNLVTIDLKKNNFSGELTKVNFSTLPNLKTLDVVWNKFNGTIPESIYSCSNLTALRLSFNNFRGQLSEKIGNLKSLSFLSLVKNSLANITSTLQMLQSSKNLTTLIIAINFMHETIPLDDSIDGFENLQVLSLYGCSLSGKIPHWLSKLTNLEMLFLHDNQLTGQIPIWISSLNFLFYLDITNNSLSGEIPTALMEMPMLKTDNVAPKVFELPIFTAQSLQYRINSAFPKVLNLGINNFAGAIPKEIGQLKALLLLNLSSNKLSGQIPESICNLTNLQMLDLSNDNLTGTIPEALNKLHFLSAFNVSNNDLEGPVPTVGQLSTFPSSIFDGNPKLCGPMLANHCSSAQTSYISKKRHIKKAILAVTFGVFFGGIAILVLLAHLLTLLRSTSFLSKNRRYSNDGTEAPSSNLNSEQPLVMVPQGKGEQTKLTFTDLLKATKNFDKENIIGCGGYGLVYKGELSDGSMLAIKKLNSDMCLMEREFSAEVDALSMAQHDNLVPLWGYCIQGNSRFLIYSYMENGSLDDWLHNRDNDASSFLDWPMRLKIAQGASQGLAYIHDVCKPNIVHRDIKSSNILLDKEFKAYVADFGLSRLILPNKTHVTTELVGTLGYVPPEYGQGWMATLRGDMYSFGVVLLELLTGRRPIPVLSASKELIEWVQEMRSKGKQIEVLDPTLRGTGHEEQMLKVLEVACQCVNHNPGMRPTIREVVSCLDIIGTELQTTELN

SEQ ID NO: 30477 - protein, 447 aa, Streptococcus thermophilus
MAITAADIRREVKEKNVTFLRLMFSDILGIMKNVEIPATDEQLDKVLSNKVMFDGSSIEGFVRINESDMYLYPDLDTWTVFPWGDENGSVAGLICDIYTSAGEPFAGDPRGNLKKALRHMEEVGYKSFNLGPEPEFFLLKLDEQGNPTLEVNDKGGYFDLAPTDLADNTRREIVNVLTEMGFEVEASHHEVGVGQHEIDFKYTEVLKACDNIQIFKLVVKTIARKHGLYATFMAKPKYGIAGSGMHCNMSLFTEEGNAFFDPEDPHGMQLSQDAYYFLGGLMKHAYNYTAIINPTVNSYKRLVPGYEAPVYIAWAGSNRSPLIRVPASRGMGTRLELRSVDPMANPYLAMAVLLEAGLDGIINKIEAPAPIETNIYSMSPEERKEAGIIDLPSTLRNALKALETDEVVRQALGNHIYTNFLDAKRLEWASYATFVSQWEIDNYLDLY

SEQ ID NO: 30478 - protein, 161 aa, Fragaria x ananassa
NLFGVAIGYTIASSISMVAIKRSNCFHSSDGKDECHVNSNPYMIAFGIAEIIFSQIENFDQLWWLSIVAAVMSFTYSTIGLGLGIGKVVETGTIRGSMTGVDIGTVTEAQKIWRSFQALGDIAFAYSYSLILIEIQDTVESHHREAKTMRKHSNQCAPHPF

SEQ ID NO: 30479 - protein, 472 aa, Magnolia kobus
QTEAKASVGFKAGVKEYKLTYYTPEYETKDTDILAAFRVTPQPGVPPEEAGAAVAAESSTGTWTTVWTDGLTSLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASQGNEIIREASKWSPELAAACEVWKEIKFEFKAVDTL

SEQ ID NO: 30480 - protein, 473 aa, Annona muricata
QTEIKASVGFKAGVKEYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALCKAQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSTPGVLPVASGGIHVWHMPALTEIFGDDSVLQFGGGTLGHPWGNAPGAVANRVALEACVQARNEGRDLARQGNEIIREASKWSPELAAACEVWKEIKFEFQAVDTLD

SEQ ID NO: 30481 - protein, 470 aa, Mosannona vasquezii
TKASVGFKAGVKEYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREASKWSPELAAACEVWKEIKFEFEAVDTLD

SEQ ID NO: 30482 - protein, 481 aa, Thermosphaera aggregans
MKFPKDFMIGYSSSPFQFEAGIPGSEDPNSDWWVWVHDPENTAAGLVSGDFPENGPGYWNLNQNDHDLAEKLGVNTIRVGVEWSRIFPKPTFNVKVPVERDENGSIVHVDVDDKAVERLDELANKEAVNHYVEMYKDWVERGRKLILNLYHWPLPLWLHNPIMVRRMGPDRAPSGWLNEESVVEFAKYAAYIAWKMGELPVMWSTMNEPNVVYEQGYMFVKGGFPPGYLSLEAADKARRNMIQAHARAYDNIKRFSKKPVGLIYAFQWFELLEGPAEVFDKFKSSKLYYFTDIVSKGSSIINVEYRRDLANRLDWLGVNYYSRLVYKIVDDKPIILHGYGFLCTPGGISPAENPCSDFGWEVYPEGLYLLLKELYNRYGVDLIVTENGVSDSRDALRPAYLVSHVYSVWKAANEGIPVKGYLHWSLTDNYEWAQGFRQKFGLVMVDFKTKKRYLRPSALVFREIATHNGIPDELQHLTLIQ

SEQ ID NO: 30483 - protein, 357 aa, Euglena gracilis
MDYYTVAHIDEPCSQPWYKSRVAAFFGGCLLATCMSLRFKGTVQENYAVGTKPAVHSLPLAALGTWGRSQVPQNPPQNGFNNFGRRSSALQMTVGGWAPSAKMPRKFIVGGNWKCNGDRASIKALIQALNAGESTIGSGVDVVVAPPMLYGDYARGLLRSDFGVAFQNCWVGGNGAFTGEVSADMIKDAGFDWVILGHSERRSLPEIKETDETVATKTAYALEAGLKVMLCIGETLDARQSGKTDEVNARQLAAVAEKVSDWSNIVIAYEPAWAIGTGVVATPEQAQETHTQIRKWLAENISPQVAQQMRIMYGGSANAANADSLARQPDIDGFLVGGASLRPEFLRIVESWKRKVE

SEQ ID NO: 30484 - protein, 474 aa, Frankia alni
MFTKAEDVLRYIRDEDVQFIDVRFCDLPGIMQHFTIPTQVFAESVFTDGLMFDGSSIRGFQAIHESDMLLLPDPQTAFVDPFREHKTLAMTFFIHDPITKEQYSRDPRNIAKKAETYLRGTSIADTAYFGPEAEFYIFDDVRYDYNPYGSMHHVDSVEAAWNTSRKEEGGNLGYKPRFKGGYFPVPPTDHFTDLRSEMTRVLYETGITVEMQHHEVGTAGQAEIDIRYDTLLKTADNLMLYKYVIRNVARSRGKTVTFMPKPLFEDNGSSMHVHSSLWKDGEPLFYSPNGYGGLSDTARYYIGGLLHHAPALLAFTNPTTNSYRRLVPGYEAPVNLVYSARNRSACCRIPLGGDSPKAKRVEFRVPDPSCNPYLAFAAMLMAGLDGIRNKIDPPDPIDKDLYELPPDELAAVPQVPGSLEKVLDALEADNDFLREGDVFTTDLIETWLEYKRLNEVDAIRLRPHPYEFTLYYDI

SEQ ID NO: 30485 - protein, 425 aa, Serratia marcescens
MSVTASDLAFDQRHIWHPYTSMSRPLPCYPIESASGVELQLADGRSLVDGMSSWWAAIHGYNHPRLNQAASQQLEKMSHVMFGGITHPAAISLCRRLVEMTPEALQCVFLADSGSVAVEVSLKMALQYWQARGERRQRILTLRHGYHGDTFGAMSVCDPDNSMHSLYQGYLAPHLFATAPQCRFDEEWREEDIAPFAALLEQHAGEVAAVILEPVVQGAGGMRIYHPTYLKRVRDVVRVAIKLLLIADEIATGFGRTGKLFACEHAQVVPDILCLGKALTGGYMTLSATLTTRHVAETISNGAAGCFMHGPTFMGNPLACAVADASLALLAENRWQAQVSAIETQLKRELLPLGRCRRWPHVRVLGAIGVVEMREPVDVAELQRGFVERGVWIRPFGKLIYLMPPYIIEAEQLSRLTAAVADAAR

SEQ ID NO: 30486 - protein, 273 aa, Carica papaya
ACENWGFFELVNHGIPIELLDTVERLTKGHYRKCMEQRFKEIMASKGLDGIQTEVTDMDWESTFFIRHLPEPNIAEIPGLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPGSDAVIYPAPILVEKETEEKKTTYPKFVFEDYMKLYAGLKFQAKEL

SEQ ID NO: 30487 - protein, 482 aa, Citrobacter freundii
MSDAPLIPVIMAGGTGSRLWPLSRELYPKQFLHLTEDNSLLQTTLLRLSSLSCKTPLVISNEQHRFIVAEQLRQINQLHDNIILEPCGRNTAPAIALAAFSALKRNEKKEPLLLVLAADHVINESSAFCEAVKNSIPLAEDGHVVTFGIIPEYAETGYGYIERGLPLEKNKSSGDSLFYHVNKFVEKPNRRLAEEYVSSGNHFWNSGMFLFKASTYLCELKKYRPDIYDACESAMSTSYHDLDFIRLSEESFKGCPAESIDFAVMEKTECCVVYPLNIGRSDVGSWQSLWNISEKTETGDVCKGDVLTYNTKNNYIYSDSTLVAAIGIEDVVVIQTKDAILVSKKSEVQNVKKIVDMLKHQNRTEHVTHREVFRPWGKFDAIDQGDRYKVKKIIVKPGEGLSLRMHHHRSEHWIVLSGTAKVTLNNEIKLITANESIYIPLGAVYSLENPGVIPLNLIEVSSGDYLGEDDMVRQKERYRNED

SEQ ID NO: 30488 - protein, 368 aa, Citrobacter freundii
MSKQQIGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELATTFTEWNEGELSSYLIDITKDIFSKKDEEGKYLVDVILDEAANKGTGKWTSQSSLDLGEPLSLITESVFARYISSLKDQRVAASKVLSGPQAKRAGDKAEFVEKVRRALYLGKIVSYAQGFSQLRAASDEYNWDLNYGEIAKIFRAGCIIRA

SEQ ID NO: 30489 - protein, 367 aa, Salmonella enterica subsp. enterica serovar Urbana
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIR

SEQ ID NO: 30490 - protein, 365 aa, Streptomyces coelicolor A3(2)
MAVRTAVRAAVVPAPGAPLEVTGIELPEPGPGRVRVRLAAAGVCHSDLSLSNGTMRVPLPAVLGHEGAGTVVAVGEGVTHVAPGDEVVLNWAPSCGACHACSLGEVWLCAHALAGAADVHARRADDGTDLHPGLNVAAFAEETVVAASCVLPAPEGIPLTEAALLGCAVLTGYGAVHHSARVREGETVAVFGVGGVGLATLQAARIAGASKIVAVDVSPEKEELARAAGATDYLLASDTTAREIRALTGKQGVDVAVECVGRAVTIRTAWESTRRGGRTTVVGIGGKDQQVTFNALEIFHWGRTLSGCVYGNADPARDLPVLAEHVRAGRLDLGALVTERIALDGIPAAFDNMLAGKGGRALVVF

SEQ ID NO: 30491 - protein, 462 aa, Streptomyces coelicolor A3(2)
MKAHDGMYIDGAWRPADGRDTIDVVNPVDEQVIGKVPAGSALDVDTAVRAARAALSGWAATPPAERAARLAALRDVLVARKDEIAETVTAELGSPLKFSQAVHAGAPIAVAGSYAELAATHAFEEKVGNSVVHHEPVGVVGAITPWNYPLHQIVAKAAPALAAGCTMVLKPAEDAPLVAQLFAEAVHEAGIPAGVFNLVTGLGPVAGQALVEHPGVDLVSFTGSTAVGRRIGATAGAAVKRVALELGGKSANVILPSADLAKAVNVGVANVMSNSGQTCSAWTRMLVHRDQYDEAVSLAAEAAAKYGDRIGPVVNAEQRERVRGYIGKGVAEGARLVAGGPEAPREQGYFVSPTVFADVTEEMTIAQEEIFGPVLSILRYEDEDDALRIANGTVYGLAGAVWAGDEADAVAFARRMDTGQVDINGGRFNPLAPFGGYKQSGVGRELGAHGLTEYLQTKSLQF

SEQ ID NO: 30492 - protein, 370 aa, Penicillium olsonii
MRTSILSMLALGAAAVSAAPAAAAAPAELVERGSSCTFTSASAAKAGKKSCSSIVLDNIKVPAGETLDLSNLKSGTKVTFKGETTFGYKEWKGPLIRFSGKNIEVNGASGHVINGGGASWWDGKGTNGGKTKPKFFYAHSLDDSTITGLNVKNTPVQGFSVQADNLVLDHITIDNTDGDKTNGGHNTDAFDVGESTYITISNANIKNQDDCLAINSGENIIFTGGTCSGGHGLSIGSVGGRDDNTVKNVTISDSTVSNSDNGIRIKTIYKAKGEVADVTFSNIELSNIAKYGIVIEQDYENGSPTGKPTTGVPITGLTVEKVTGSVKSSGTDVYILCGSGSCSDWTWSGNKVSGGKTSSKCKNVPSGASC

SEQ ID NO: 30493 - protein, 380 aa, Penicillium olsonii
MIAGSKLLMLGLFGALAVHALPEPAKAQVTAAPKLEERATSCTFSGSAGASSASKSKTACATIVLSAVAVPSGTTLDLTGLNDGTTVIFEGETTFGYKEWSGPLVSVSGTDITVKGASGATLNGDGSRWWDGKGSNGGKTKPKFFYAHKMFSSTISDIHIVNSPVQVFSINGATDLTLSGITVDNRDGDTDEGGHNTDAFDVGSSTGITITGATVYNQDDCLAVNSGTDITFTGGLCSGGHGLSIGSVGGRSNNDVANVIIENSQIQDSTNGVRIKTVYEATGSVKNVTYKDITLSGITKYGIVIEQDYENGSPTGTPTDGVPITDLTLDGVKGTVASSGTNVYILCAEGACSDWTWDGVSVSGGKTSSACENVPSSASC

SEQ ID NO: 30494 - protein, 333 aa, Colletotrichum gloeosporioides f. sp. malvae
MKFTAALATVFAGLVAATPTPTVDNVADRAHLVKRASISDKATIGYATLNGGTSGGAGGTVTTVSSLAEFTAAVNEKDASAKVVVVKGVIKGAVNVRIGSNKSVIGLPGAGFDGVALHARRQSNIIIRNIKSTNVLASTGDGLKIEESTNVWVDHSEFSSALVADKDYYDGLVDASHGADYITISYTYFHDHWKTSLIGHSENNGAEDSGHLRVTYANNYWANFGSRGPSVRFGTAHIYNSYYLNANSAINTRQNAQVLVQSNVFKNVTEPLMTKDSDIVGYAVAIDNDFGGAANTAPVGTLNANSPPYAYTLLGSANVVANVLANAGQKLTF

SEQ ID NO: 30495 - protein, 332 aa, Colletotrichum gloeosporioides f. sp. malvae
MKFTGLASWALLAIAASASPTPTVEDGRVLSKRAAVTDACNIGYCTQNGGTKGGAGGTTTTVTSLAQLSAAANASGPGIIVVQGNIVGKAKVQVGSDKTIVGKSGSSLEGIGLTILGQKNVIVRNMKIGKVEAAYGDAITIQLSKNVWVDHCELYATREGVDKDFYDGLADLSHAADWVTISNVYFHDHSKGSLVGHSDSNAAEDTGTLRVTYANNHWYNIRSRGPLLRFGTAHVYNNYVNGMDTGLNSRMGAQALIQSSLFENTGKKAIFTESSKEVGYVVAIDVTLTGESANTAPLGKLTASSPPYSYSLLGSANVKAAVTKEAGQTLGF

SEQ ID NO: 30496 - protein, 482 aa, Arabidopsis thaliana
MAPAQNPISSQHVVVIGAGAAGLVAARELSREGHTVVVLEREKEVGGLWIYSPKAESDPLSLDPTRSIVHSSVYESLRTNLPRECMGFTDFPFVPRFDDESRDSRRYPSHMEVLAYLQDFAREFNLEEMVRFEIEVVRVEPVNGKWRVWSKTSGGVSHDEIFDAVVVCSGHYTEPNVAHIPGIKSWPGKQIHSHNYRVPGPFENEVVVVIGNFASGADISRDIAKVAKEVHIASRASEFDTYEKLPVPRNNLWIHSEIDTAYEDGSIVFKNGKVVYADSIVYCTGYKYRFTFLETNGYMNIDENRVEHLYKHVFPPALSPGLSFVGLPSMVSLKQYLGVPSSSLTWFLSLSFFYQGIQFVMFEIQSKWVAAVLSRRVTLPTEDKMMEDISAWYASLDAVGIPKRYTHKLGKIQSEYLNWVAEECGCPLVEHWRNQQIVRGYQRLVSHPETYRDEWDDNDLMEEAYEDFARKKLISFHPSHIL

SEQ ID NO: 30497 - protein, 458 aa, Arabidopsis thaliana
MAPALSPTRSHHVAVIGAGPAGLVAARELRREGHSVVVFEKQKQVGGTWIYTDEVESDPLSVDPTRSVVHSSVYRSLRINGTRECTGYRDFPFVVRSGVSRDPRRFPSHGEVLAYLKDFAKEFGIEEMVRFETEVVKVSPAAEEGIGKWRIESTEKEKKVRRDEIYDAVVVCNGHYVEPRLAQIPGISSWPGKEMHSHNYRIPEPFRDKVLVFIDDNVVVLIGNSSSAEDISRDIARVAKEVHVACRSNPADTFIKQTGYNNLWTHSMIESVHEDGSVVYQNGKTISVDIIMHCTGYKYHFPFLDTNGIVTVDDNRVGPLYKDVFPPAFAPWLSFIGIPWQVLPFPMFELQSKWIAGVLSGRIPLPSKEDMMIEIKTFYSTLEVQGIPKRYTHRMGNTQFEYYNWLASQCGCSETEEWRKEMCLANGVRKEAHPETYRDEWDDHHLVSEAYQDFSLYS

SEQ ID NO: 30498 - protein, 424 aa, Blastocladiella emersonii
TLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 30499 - protein, 326 aa, Streptomyces coelicolor A3(2)
MHAITIPEPGGPEALVWAEVPDPQPGEGEVLVEVAASAVNRADIMQRQGFYDPPPGASPYPGLECSGRVAEVGPGVSGWSVGDEVCALLAGGGYAEKVVVPAGQLLPVPQGLDVKRAAALPEVVCTVWSNVFMVAHLRPGETLLVHGGSSGIGTMAIQLAKAVGAKVAVTAGTKEKLERCAELGADILINYREQDFVAEVKDATGGAGADVILDNMGAKYLDRNVQALAVNGRLAIIGMQGGRKGELNIGTLLAKRAAVSATSLRARPLEEKAAIVAAVKEHVWPLLAGGHVRPVVDREMPMSEAAEGHRVVEESGHIGKVLLVTS

SEQ ID NO: 30500 - protein, 279 aa, Pyrococcus abyssi GE5
MVWKMAKVSDFKRIGDDKVTAIGMGTWGIGGKEFPDYSKDRESIEALRYGLELGINLIDTAEFYGAGHSEELVGKAIEGFNREEIFIVSKVWPTHFGYESAKKAARASAKRLGTYIDLYLLHWPGDTWKKIEETLHALEELVDEGLIRYIGVSNFDLELLRRSQEAMRKYEIVVNQVKYSLMDRTPEETGLLDYMKREGITLMAYTPLEKGILARNKCLAEIGKRYGKTSAQVALNYLIWEENVVAIPKASNKDHIKENFGAMGWRLSREDRERAKLCV

SEQ ID NO: 30501 - protein, 227 aa, Pyrococcus abyssi GE5
MVEVKKHKFPGVYIVIDDDGSEKIATKNLVPGQRVYGERVIKWEGEEYRIWNPHRSKLGAAIMNGLKNFPIKPGKSVLYLGIASGTTASHVSDVIGWEGKIFGIEFSPRVLRELVPIVEDRKNIVPILGDATKPEEYRALVPKVDVIFEDVAQPTQAKILIDNAEVYLKKGGYGMIAVKSRSIDVTKEPEQVFREVEKELSEYFEVIERLNLEPYEKDHALFVVRKT

SEQ ID NO: 30502 - protein, 404 aa, Pyrococcus abyssi GE5
MKAFIAENVRGIYAFDENGKLIAKRYYTDKPEKVLDKLLKGEFVKDLEVFLGELKEKGYDEFVFEHSELTRKAKELGYNAKTEFPNIAGERLRSNPEEFLGENWYEDYYKVGVELTRLRIQEQSGARDKMVIQAIEALDDLDKVINLLVSRLREWYSLHFPEIDEILPRHPQYVSFVKTIGHRDNVEEEKLRELGLSEEKIKKILEAKEKTMGAWMDETDIRVVQDFAEEIDRLYKLRKELEDYIDKAMDDVAPNLKALVGAKLAARLISLAGGLRELAMLPSSTIQVLGAEKALFRHLRTGAKPPKHGVIYQYPAINRSPWWQRGKIARALAGKLAIAARVDYFSGEYIAEELKKELEARIREIKEKYPKPPKRKREERRKPWKEKKKKKKKKKREKEKGKRR

SEQ ID NO: 30503 - protein, 330 aa, Pyrococcus abyssi GE5
MHPKVDALLSRFPRITLIPWETPIQYLPRISRELGVDVYVKRDDLTGLGIGGNKIRKLEFLLGDALSRGCDTVITIGAVHSNHAFVTALAAKKLGLGAVLILRGEEVLKGNYLLDKLMGIETRIYEADNSWELMKVAEEVAEELKGEGKKPYIIPPGGASPVGTLGYIRGVGELYTQVKKLGLRIDTVVDAVGSGGTYAGLLLGSAIVNAEWSVVGIDVSSATEKAKERVKNLVEKTKELLGINVKVQEPRIYDYGFGAYGKIVKEVAKLIKSVGTMEGLLLDPVYTGKAFYGLMDLAKKGDLGESVLFIHTGGLPGIFHYGEEMLELLV

SEQ ID NO: 30504 - protein, 283 aa, Pyrococcus abyssi GE5
MLLYTYRSFDMELPTVSIEEADYVIMGLPFDGTTSYKPGARFGPVLIRQATLNLESYILDYDVDIAELKIADAGDVALPVNVEDAIKVGIEAIKELRSVNRKALPIFLGGEHSMTYPPVAVLKPKSYVVFDAHLDLRDSYQGSRFNHACVARRIHENGVEVAIFGVRSGTREEVKYATENGIEWVHARDYNFDAFVDLVASLSEPIYVSIDIDVFDIPLVPETGTPEPGGLRFWDVVNALEWLTERKNVVGFDIMEVSGDKLGNVTSITAAKLLFHILGMSSR

SEQ ID NO: 30505 - protein, 466 aa, Pyrococcus abyssi GE5
MINMTKWDEIKKYTSKKVDENLKIVELDEEYLPRAIGFKYYPLVIERAKGSRVWDKDGNEYIDFLTSAAVFNVGHAHPKVVEAIKEQVDKFLNYTIGYLYTEPPVRLAELLSEMTPGDFEKKVTFGFSGSDAVDSSIKASRAYTKKVHIISFRHSYHGMTYGALSVTGIVDEKVKSIVQPMSNVHIVDYPDPYRNPWNIDGYENPSELANRALDEVEKKIKELNGDVAGIILEPIQGDAGVVIPPLEFIKGLKKLTDEYGMVFIDEEVQTGMGRTGKWWAIEHFEVVPDLLVSAKALGGGMPISAVVGRAEIMDSVPSPLFVFTHVGHAVNASAAIATIKVIKEEKLVERAKELGDYALKRFRELQEEYPIIGDVRGKGLMIGVDIVKEGTKDPNRELAQKICWRAWEKGLIIITFGKHGNVLRIAPPLTISKEDFDRGIEIIEEAIKDAINGKVPDDVIKFLRAW

SEQ ID NO: 30506 - protein, 279 aa, Pyrococcus abyssi GE5
MEFIEWYPRGYGVAFKVKEKIFEGHSKFQKIEVYETEGFGRLLALDGTVQLVTEGEESYHESLVHPVMLAHPNPRRVLVIGGGDGGTIREVLRHEEVEEAIMVEIDEEVIEVAIKFIGIDGGLLDKMMKGECKRAKLIIGDGVEFIKENSGFDVVIVDSTDPVGPAKMLFSREFYERAYEALNDPGIYVTQAGSVYLFTDELVTAYENMSRVFDKVYAYSFPVIGYASPWAFLVGIKGDLDFRKIDLERAKKLNLKYYDPENHETIFQMPRYVREMLKP

SEQ ID NO: 30507 - protein, 407 aa, Pyrococcus abyssi GE5
MYDVAVIGGGPAGMAAAIKARELGLSVILIDENDYLGGILPQCIHPGFGIHYFKEELTGPEFAYKLMNRLRDVEVRTSARVVEIINYSDIEKRLKVISPSGIEEIRAKTIIYAAGARERHAFEIGITGDRVAGIFTAGEAQTLMDIYGIMPGREILIVGSGDVGLIMARRFALEGARVKAVIELMPYPGGLARNVMILNDFNIPLYLSHKVVEIRGKGRVQRVKIVKVDENLREIPGTEFWVDVDTVIISAGLIPNVKLLTKVGVAIDPSTGGPIVNDRLETTVPGIFVAGNALVINDLVDYVVEQGELAAEGAKEFIDNDGIRSRKWTRLIKGENVRFVVPHYLSGDRDVWIYLRVSRPMEDVRLEMPEIGKRMRLPIVKPSEMIRIKLRGKDVKGVDKITVRVVK

SEQ ID NO: 30508 - protein, 463 aa, Pyrococcus abyssi GE5
MSDIRKKLWTLAWPAIMGNISQTLLNLVDTMIVGHVSSVALGAVGLGGQVSWFMFPIMMAISTGTLALVARRVGEKNFEEASRIAEQSMYIAFIIGIPVMLFGLFLGDEVLKIMGAKGEVLEIAYAYLRVLFLFYPIRFMGFAFFSALRGAGDTKTPMKLNILMNVINAVLDYLLVFGKFGFPRLGPVGAAWASGIGITIAFLVGMYLFITNKLILKPVLDLSLRFDIIEKILRIGTPTMLERGLFSFYNFLYVSIVARFGKIALSAHYIGLRIESIAYMPAFGFSIATSALVGQNLGAKKPEEAERTVKEALKMTTMFMSAMAFVLMVFPGYLTEPFLSHNDPNYQAVKSLAVIYLIIVGISEIPLGMTFVLSGALRGAGDTKSPLYVTSVSKLLFRILPAYLLGFGFEIPELSIGPFTFPGFKFPGMGVIAAWIGMSLETFVTAGLFWLVFKRGKWKKIKI

SEQ ID NO: 30509 - protein, 284 aa, Pyrococcus abyssi GE5
MSFAKLEFFNPFSRSIKDRAVYNMLIKALRSGEIDGTNVLYEATSGNVGISIAALSAVFGLKFRAYIPKPTPKTTELLIKVFGAEVVRTNFDTIDKKFVEFVKLEARRDKALNLNQFENDANFEAHYYGTARELEEQLRSIDKIPEIIIAGIGTSGHIAGISKYFKERYETKIIGVVPAKGETIPGIKRLETRPKWFFKVEVDEVVEVTAREAFEGILKVARSDGLLIGMSSGAVVKAYEKVRPEGTTVLIFPDDGFKYGEIFEMLLGEAQGKISSRTSQLQGS

SEQ ID NO: 30510 - protein, 364 aa, Pyrococcus abyssi GE5
MSLYRKRLKIVRGEGIYVWDSEGKRYLDLIAGIGVAILGHNHPKWVEEVGNQLNKLVVAGPMFEHEEKEEMLEELSRWVNFEYVYMGNSGTEAVEAALKFARLYTGRKEIIAMTNAFHGRTMGALSATWKSKYKKDFEPLVPGFKHIPFNDVEAAKEAITRTTAAVIFEPIQGESGIIPAKEEFVKTLRDLTEDVGALLIADEVQSGLRTGKFLAVEHYKVEPDIVTLGKGIGNGVPVSLTLTNFDVERGKHGSTFGGNPLACKAVAVTLRILRKERLVEKASEKFIKVKGKDVVTTRGRGLMIGIVLKKPVGRYVEELQNEGYLVHTSGQRVIRLLPPLIISKEKMMEVKSAIEGVINGDTEG

SEQ ID NO: 30511 - protein, 248 aa, Pyrococcus abyssi GE5
MFRDGSLIPYLTAGDPSAKATLRFLLAIEEYSGAIELGIPFSDPIADGKTIQQSHFRALKGGFKLEHAFNIVREFRKHSDVPIVLMTYYNPVFRVGLREFIGKAKDSGVDGMLIVDLPVMHASEFLEVAREEGIKTVFLAAPNTPDERLKEIDKASTGFVYLISLYGTTGARDKIPETAFNLLKRAKRICKNKVAVGFGVSKREHVEMLLNAGANGVVVGSALINIIAEHGENAEEKLREKVRELAGL

SEQ ID NO: 30512 - protein, 440 aa, Pyrococcus abyssi GE5
MRVVVIGSGTAGSNFALFLRKLDRKAEIIVIGKEPTMQYSPCALPHVISGTIEKPEDVIVFPNEFYEKQKIKMMLGVEAKKIDRERKVVITDKGEVPYDKLVLATGSKAFIPPIKGVENEGVFTLKSLDDVRRIKEYIGKRNPKKAVVIGAGLIGLEGAEAFAKLGMEVLVVELLEHLLPTMLDKDMASIVQKNMEEHGVKFRFGVGVSEIIGNPVEAVKIGDETVEADLVLVATGVRANVDLAKDAGLEVNRGIVVNEYLQTSDPDIYAIGDCAEVIDAVTGKRTLSQLGTSAVRMAKVAAEHIAGKDVKFRPVFNTAITELFDLEIGTFGMTEERAKREGIDVVVGKFRGSTKPEYYPGGKPITVKLIFRKEEGRLIGAQIVGGERVWGRIMTLSALAQMGAKVEDIAYLETAYAPPISPTIDPITVAADMALRKMKR

SEQ ID NO: 30513 - protein, 431 aa, Pyrococcus abyssi GE5
MKAIDVIERYSKIIAPANRMHYFPLVPVRAENAKIWDIEGKEYIDFLSNAAVQNVGHNNPRVVKAIKEQVEKLTHASYIYSYPVEPLLLAEKLAEIAPVDDPKISFGLTGADANDGAIKYARAYTKRQAILSYMKSFYGSTYGAMSLTGLDFQVRAMVGELSEIHYIPYPNCYRCPFGKEPGSCKMECVEYLKEKFEGEVYAEGVAALFAEPIQGDSGIVVPPKDYFRKVVKILREHGILFVVDEVQSGMGRTGKWFAIEHFGVRPDIITVGKSLGGGLPISATIGRREIIDSLPPLSHAFTLSGNPTASRAALAVIEEIEEKNLLRRAEKLGNHAMKRLKKMMDEHELIGDVRGIGLMIGVELVKDRETKERAIEETQKVIERAFELGLIVTHFNGNVLRIEPPLTIEEETLDEGLDILERAISEVEEEK

SEQ ID NO: 30514 - protein, 305 aa, Pyrococcus abyssi GE5
MVLVMICSIGELLVDVIATEEGDLKDVRLFEKHPGGAPANVAVGIARLGFDSCLVSKVGDDPFGEFLVESLRRENVKTDGIVKDEEKHTGIVFVQLTGVSPSFILYDGVAYFNLRREDINWELINSSRIVHFGSVILARSPSRETVLDVIKRVKTIVSFDVNLRLDLWKNRGEDMLRTIEEAIKLADIVKASEEEVDYLEDNGIEVEGKLITAITMGSKGAKLNGIQVPGYKVNPVDTTGAGDAFTAALLVGIMKVREITNENLEKIGKFANLVAALSTLKRGAWSVPKVEELLKYKEAREILRL

SEQ ID NO: 30515 - protein, 454 aa, Pyrococcus abyssi GE5
MELKPNVKEIPGPKARKVIEEHHKYMATTTNDPNEYFLVIEKAEGVYWIDVDGNVILDFSSGIGVMNVGLRNPKVIEAIKKQLDLVLHAAGTDYYNPYQVELAKKLIEIAPGDMERKVFLSNSGTEANEAALKIAKWSTNRKMFIAFIGAFHGRTHGTMSLTASKPVHRSRMFPTMPGVEHVPYPNPYRNPWGIDGYENPDELINRVIEYIEDYLFEHYVPAEEVAGIFFEPIQGEGGYVVPPKNFFKELKKLADKHGILLIDDEVQMGMGRTGRMWAIEHFDVVPDIITVAKALGGGIPIGATIFRADLDFGVSGVHSNTFGGNAVAAAAALAVIEELQNGLIENAQKLEPLFRERLEEMKEKYEIIGDVRGLGLAWGVEFVKDRKTKEYATKERNEIVVEALKRGLALLGCGKSAIRLIPPLIISEEEAKIGLDIFEEAIKVVSERHGYKIH

SEQ ID NO: 30516 - protein, 329 aa, Pyrococcus abyssi GE5
MVRVELRGVEKKFPGFKLRVDLEVKDGELISILGPSGCGKTTTLRIIAGLERPDKGNVLFDGRDVTFLPPYSRNIGFVFQDYALFPHMNVFKNVAFGLEVRKLPRKEIERKVREVLELVGLKGFENRMPEQLSGGQQQRVALARALVIEPEVLLLDEPLSNLDAKVRESLRMEIKRIQKELGITTMYVTHDQEEAMAISDRIAVMNFGRIEQVGRPLELYYNPKTEFVAKFLGTGNLLKLRSTNGVACLGELCFNVGVDGPVKVFFRPESVEIGKEGVEAEVMDYEILPGRIRFRLSVQGKEIIAEDSLARYEEIPKKVYIKVKRFSLL

SEQ ID NO: 30517 - protein, 393 aa, Pyrococcus abyssi GE5
MVIFRIKNYVEKDINLPWDQREGEIKMKPLHDPLYITAVFKQVGDAYPTDRGTELKYSREENPTVRKLEDKLAELEGSDNALAFNSGMSAISTLYFSLLEGGDKVVLSMEGYGTTIELAKLLRKFGVDVKLAYPSADSLIETIDEETKLVLVETMTNPTLKVIDVPEVAKRCREVGAILVVDNTFVTPLLYKPLEDGASYVVHSLTKYIAGHNDVLGGAVLWNGEFSRDLWEWRRRLGTIIQPFDAWMIERGMRTLEVRFERQSENAMAIAEFLKDHPKVREVHYPGLKDDPYYKVARRLFKKDLYGGVVAFDLGSGDNALAFLRGLKRIFPSPSLGGVESIATYPVKSAAKTLDEEIREILGITDGLIRLSVGLEPLDELIEDIDNALGVVR

SEQ ID NO: 30518 - protein, 474 aa, Pyrococcus abyssi GE5
MPKLIKERVPTPERSVEERIRDFNEVNLGYTWELALREAERCLQCPKEYAPCIKGCPVNIDIPGFIRALRENRDDPDKAVREALKIIWDSNSLPAITGRVCPQEDQCEGVCVVGKVGDPVNIGKLERFVADYARQHGIEDELLEEQIRGIKRNGKRVAVIGAGPAGLTCAAELAKMGYEVTIFEALHEPGGVLAYGIPEFRLPKEIVKKEVEKLKRLGVKIETNVLVGKTVTFEELREEFDAIFIGTGAGTPRIYPWPGVNLNGIYSANEFLTRINLMKAYKFPEYDTPIKIGKRVAVIGAGNTAMDAARSALRLGAEVWILYRRTRKEMTAREEEIKHAEEEGVKFMFLVSPKRFIGDENGNLKAIELEKMKLGEPDETGRRRPIPTGETFVMEFDTAIIAIGQTPNKTFLQTVPELKVDEKGRIIVDENLMTSIPGVFAGGDAIRGEATVILAMGDGRKAAKAIHKYLSSSS

SEQ ID NO: 30519 - protein, 410 aa, Pyrococcus abyssi GE5
MFRLGDFNYHNKVVFLRVDLNSPMKDGKIISDARFRAVLPTIKYLLENGARVVVGTHQGKPYSEDYATTEEHARILSNLLNQHVEYVEDIFGRYAREKIQELKPGEIAMLENLRFSAEEVKNKPIEECEKTFFVKKLSKVIDYVVNDAFAAAHRSQPSLVGFARIKPMIMGFLMEREIEALMKAYYSKESPRVYVLGGAKVDDSLKVAENVLRRGFADVILTGGLVANVFTLAKGFDLGRKNIEFMKKKGLLELVKHAEKILDEFYPYVRTPVDFAIDYKGDREEIYLLSEKRELLNDYQIMDIGSRTIEKYRDIIMKAKVVVANGPMGVFEREEFALGTVEVFKAIAESEAFSVLGGGHSIASIQKYGIEGITHISTGGGAMLTFFAGEELPVLRALQISYEKFKEVKA

SEQ ID NO: 30520 - protein, 437 aa, Pyrococcus abyssi GE5
MGWFERYFEFEKYGTNMKTEVLAGITTFMTMAYILFVNPDILSKAMGEGAKEALVAVTALSAGLTTIMMGLYAKKPFALAPGMGLNAYFAFTVAPKYGWKVALAAVFVEGIIFIILSVTKVRSAIIHAIPISQKYAIGAGIGLFLTLIGLANVGIVTNGPTILALNASKFVTKDGLLFILGLFVAAILVSLRIKGALLISILLTSIVGWIVKAAPWPSQIFSWPDISYTFLKLDFQGLLNAGALGVVFAFFMVDFFDTLGTVTGLSAKAGFLTKEGKIPDAEKVLLTDAVGTTLGALLGTSTVTTYIESAAGIEEGGRTGMTALVTGLLFLVIGLFIGPLAGSIPAFATAPALVIVGYYMMSAMKNVDFNDPTEALPAFLVLITIPYTYSIADGIGVGFISYTLLKIFTGRWKEVHPLMYILALVFVGYFAYLAGVF

SEQ ID NO: 30521 - protein, 220 aa, Pyrococcus abyssi GE5
MNILIFGPPGSGKSTQARRITERYGLTYIASGDIIRAEIKARTPLGIEMERYLSRGDLIPDTIVNTLIISKLRRVRENFIMDGYPRTPEQVITLENYLYDHGIKLDVAIDIYITKEESVRRISGRRICSKCGAVYHVEFNPPKVPGKCDICGGELIQRPDDRPEIVEKRYDIYSKNMEPIIKFYQKQGIYVRIDGHGSIDEVWERIRPLLDYIYNQENRR

SEQ ID NO: 30522 - protein, 334 aa, Pyrococcus abyssi GE5
MIGEIYYSRKFLLHKPDNYHPENPGRLWLVLTAIRELGLENHVLEPSPIGEELIYRIHEREYVEKIRELSRRGGGYLDADTYVSPRTWEAAILALGASRLATLSALRYGGMNLALVRPPGHHAGRRGKALGAPTLGFCIFNNSAMAALTSKEETGKALVIDFDAHHGNGTQEIFWDDADVVHIDLHERDIYPGSGDVGEIGGINAKGSKINLPMPHYSEDGDYIYAWEEVVIPIVEEVKPKVVIVSAGFDGFKGDGLTTLKLTEVFYSYAGATLRKYPLAVILEGGYSSGLKKGFPAFIRGYEEDKVRDHAQPSYETLKLVEEVKDILSPWWSL

SEQ ID NO: 30523 - protein, 465 aa, Pyrococcus abyssi GE5
MKTLILAGGKGTRLWPLSREAMPKQFIKVFSDRSLFQKTVERALLFSKPKEIFIVTNKEYKFRVLDDLNELGLKVPEENILLEPVGKNTLPAIYWGLKVIDENYGDSVVAVLPSDHAIKVNDNYMEAFKKAEKLAEKYLVTFGIKPTKPHTGYGYIKPGEKIKVEGKTIGYLVDEFKEKPDLETAKKYVENGYYWNSGMFMFRTSVFMEEARKHAPETVRAFEEGKSIEEIYELVPEISVDYGIMEKTDKAAVVPLNTYWNDLGSFDAVYEALDKDENGNAVQVAGFKAKYININSRNNLILTERLTATVGVEDLIIVDTGDALLVAKRGETQKVKEVYKRLREENDERAIVHRTAYRPWGSYTVLEEGERYKIKRITVLPGKRLSLQIHYHRSEHWVVVRGTAKVVVGDKEFILRPGESTFIPAGVPHRLENPGKVVLEVIETQIGEYLGEDDIVRLQDDFGRE

SEQ ID NO: 30524 - protein, 456 aa, Pyrococcus abyssi GE5
MGKLFGTFGVRGIANEKITPEFTLKIGMAFGTLLKREGREKPLVVVGRDTRVSGEMLKEALISGLLSVGCDVIDVGIAPTPAIQWATKYFNADGGAVITASHNPPEYNGIKLLEPNGMGLKKEREAIVEELFFKEEFDRAKWYEIGEVRKEDIIKPYIEAIKSKVDVEAIKKRKPFVVVDTANGAGSLTLPYLLRELGCKVVTVNAQPDGHFPGRNPEPNEENLKEFIEIVKSLGADFGVAQDGDADRAVFIDEKGRFIQGDKTFALVADAVLRERGGGLLVTTVATSNLLDDIAKRNNAKVMRTKVGDLIVARTLFEHNGTIGGEENGGVIFPDHVLGRDGAMTVAKIVEIFAKSGKKFSELIDELPKYYQIKTKRHVEGDRHGIVNKVAEIARGRGYNVDTTDGAKIIFEDGWVLVRASGTEPIIRIFSEAKSEEKAKEYLNLGLGLLDEVLSS

SEQ ID NO: 30525 - protein, 457 aa, Pyrococcus abyssi GE5
MDYPRIVVNPPGPKAKELIEREKRVLSTGIGVKLFPLVPKRGFGPFIEDVDGNVFIDFLAGAAAASTGYSHPKLVKAVKEQVELIQHSMIGYTHSERAIRVAEKLVKISPIKNSKVLFGLSGSDAVDMAIKVSKFSTRRPWILAFIGAYHGQTLGATSVASFQVSQKRGYSPLMPNVFWVPYPNPYRNPWGINGYEEPQELVNRVVEYLEDYVFSHVVPPDEVAAFFAEPIQGDAGIVVPPENFFKELKKLLDEHGILLVMDEVQTGIGRTGKWFASEWFEVKPDMIIFGKGVASGMGLSGVIGREDIMDITSGSALLTPAANPVISAAADATLEIIEEENLLKNAIEVGSFIMKRLNELKEQFDIIGDVRGKGLMIGVEIVKENGRPDPEMTGKICWRAFELGLILPSYGMFGNVIRITPPLVLTKEVAEKGLEIIEKAIKDAIAGKVERKVVTWH

SEQ ID NO: 30526 - protein, 478 aa, Pyrococcus abyssi GE5
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 30527 - protein, 341 aa, Pyrococcus abyssi GE5
MRLRRITGLRVISMGGAEMHATLSEIRKAPEGIIKAQEAFESVKDEISLPRRITYTGCGSSNFLSQLLAMATNALGGEGFSLPSSEFLNARNYYFLNHELIVAISRSGETTEVLKVLDVANSKTLGITAYESSLSRNADYSLVVHTPEESVVMTHSFQAFYFAYLQLLRNSYGFDPYDHSDVVELSKEALANEDYVKWMVEDFDFKRVFFLGSGILYPVALEGMLKMKEMALFWSEACQTFEVRHGFKSVIDSETLVVLMVDYEHEWHEKLIKELQGQGAKVLLIGKESLGAKYFIEMPRSDSLLKPIFVLPVVQLLSYYKAVKRGLNPDNPRFLEKVVRW

SEQ ID NO: 30528 - protein, 439 aa, Pyrococcus abyssi GE5
MNVSEVKSGATRSPKFVQLIFVDINGMPKGMEIPASRLQEAIEDGISFDGSSVPGFQGIEDSDLIFKADPDTYVEVPWDNVARVYGYIYKDGKPYGADPRGVLKRVIEKLAEMGIKAYIGPEPEFYLFKKNGSWELEIPDVGGYFDILTLDKAKDIKREIAEYMPSFGLVPEVLHHEVGKAQHEIDFRYDEALKTADNIISFKYIVKAVAEVHGLYATFMPKPIYGMPGNGMHLHISLWKEGENIFKGEEGLSETALHFIGGLLKHAKALTAITNPTVNSYKRLVPGYEAPVYISWGYKNRSALIRVPAFWGNGARIEYRCPDPSANPYFAFAAILMAGLDGIKHKVEPFAYVEENVYEMDEGKRKELGIDTLPGSLGEALDELEKDKVVREALGEAYKNFIEYKRKEWESYLEYLEAKHLPKDTKRVTEWELERYFFI

SEQ ID NO: 30529 - protein, 485 aa, Pyrococcus abyssi GE5
MGKFAKKLERAIRGYTFDDVLLIPQATEVEPKDVDVSTQITPNVKLNIPILSAAMDTVTEWEMAVAMAREGGLGVIHRNMSIEEQVEQVKRVKKAERFIVEDVITISPEETVDFALFLMEKHDIDGLPVVENEKVVGIISKKDIAAREGKLVKELMTKDVITVPENIEVEEALKIMIENRIDRLPVVDKEGRLIGLITMSDLVARKKYKNAVRDENGELLVAAAVSPFDIRRAIELDRAGADVIVVDTAHAHNLKAIKAMKEMRQKVDADFIVGNIANPKAVDDLTFADAVKVGIGPGSICTTRIVAGVGVPQITAIAMVADRAQEYGLYVIADGGIKYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIKELKEKGEFVIITSAGLRESHPHDIIITNEAPNYPLEK

SEQ ID NO: 30530 - protein, 430 aa, Pyrococcus abyssi GE5
MTMENPYEIVAVIAREILDSRGNPTVEVDVHTPISMGRAAVPSGASTGTHEAVELRDGGKRYHGKGVRRAVENVNKIIAPELVGMDVRWQREIDRLLIELDGTENKSNLGANAILAVSLAVAKAAANALELPLYQYLGGVNAYVLPVPLSNVINGGVHAGNDLDFQEFMIMPIGANSFREAIRWVSETYHVLKKVIAEKYGKNAVNVGDEGGFAPPMKEVTEPLDVLIKAIEEAGYKPGEEIALALDAASSEFYKDGKYIVSGKEYTREELLELYKELTSTYPIVSIEDPFHEEDWEGFVMITRELGKKVQIVGDDLFVTNPKRLKKGIEMGAANALLLKVNQIGTLTEAMDAAYMAFRAGYGVVVSHRSGETEDATIADLAVALNAGQIKTGAPARSDRNAKYNQLIRIEEELEGVAVYAGKNFRKVFF

SEQ ID NO: 30531 - protein, 390 aa, Pyrococcus abyssi GE5
MGKFYIASEEDIKAGKTTDVYFIRTKKILEAKGIKKKVLADVTTTSLPNNWKWGVLVGVEEVAKLLEGLPINVYAMPEGTIFHPYEPVLQIEGDYSEFGIYETALLGMLSQASGVATAALRIKIAAKFKPVYSFGIRHMHPAIAPMIDRAAFIGGCDGVSGVLGAEMMGEKAVGTMPHALIITVGDQVKAWKYFDEVIEEEVPRIALVDTFYDEKVEAVMAAETLGKKLFAVRLDTPSSRRGNFRKIIEEVRWELNVRGYDWVKIFISGGLDEEKIKEIVDVADAFGVGGAIASAKPVDFALDIVEVEGKPIAKRGKLSGRKQVYRCENGHYHVVPAGKKLERCPICNAKVEPLLRPIIENGEIVAEFPKAREIREYVLEQARRFNLTIE

SEQ ID NO: 30532 - protein, 475 aa, Pyrococcus abyssi GE5
MPKLIKERVPTPERSPVERVRDFNEVNLGYTWELALREAERCLQCPKEYAPCIKGCPVNIDIPGFIRALRENRDNPRKAVREALKVIWACNSLPAITGRVCPQEDQCEGVCVVGKVGDPINIGKLERFVADYAREHGIDDELLMEEIRGIKRNGKRVAVIGAGPAGLTCAAELAKMGYEVTIFEALHEPGGVLAYGIPEFRLPKEILRKELKKLKFLGVEIKTDHIVGRTVTIPELLEEYDAIFISTGAGTPKLLKIPGINLNGIYSANEFLTRINLMKAYKFPEYDTPIVVGKRVIVIGAGNTAMDAARSALRLGAEVIIAYRRGKEDMTARIEEVQHAKEEGVKFMFFVNPVEFIGDEEGRVKAVKFEKMKPLEERDKRGKRKIVGTGEYITVEADTVIIAIGQTPNKILWRTTPGLKVREDGTIIVDENLMTSIPGVFAGGDAIRGEATVILAMGDGRKAAKAIHEYLSKSA

SEQ ID NO: 30533 - protein, 484 aa, Pyrococcus abyssi GE5
MVGSMKMEDVYIWDLNAKWLGITPFQLMENAGSGVARIIEERFGKGLKVAVFCGTGNNGGDGFVTARHLSFENDVTVFLIGDETKIRSEEAKLNWSILKNLEFVKIKILKDSSQVKKLSLEEFDVIVDALLGAGTRGEPREPIRSAIEKINEYHGKAKIVSIDLPSGYPSKVRVKCDFAVTFQWDKEEYRDFDRVIVKIGYPRELYHLIGPAHVKFAFKRKGEHKGQNGKILIIGGSENYYGAPYLAGKASSYLVDLVYLLTPERVARRIDDPNLIVREVPGDNLRGEHIELALELSERVDAVVIGPGIGTKEETKEFVLEFIKKVEKPMVIDADGLKIIAEDLDALKNRKFVLTPHAGEFKLLFGVKPGGSLVEKSKLVKEKAEEINGVILLKGAYDIVSDGKVWLYNKTGNRGMTTGGTGDVLAGVVGSFLALGNEPLRAASAGAFLTGFSGDLVYEEKGEAFTALDVANKIPLALKRILEL

SEQ ID NO: 30534 - protein, 318 aa, Carica papaya
MENFPVIDLSKLNGEERALTMELIHDACENWGFFELVNHGISHDLMDTVERLTKEHYMKCMEQRFKEMVESNGLEAVQSEINDMDWESTFFLRHLPASNMHEIPDLEDDYRKAMKEFAVGLQKLAEQMLDLLCENLGFEKGYLKKVFYGSKGPNFGTKVSNYPPCPKPDLIKGLRAHTDAGGIILLFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 30535 - protein, 482 aa, Salmonella enterica subsp. enterica serovar Urbana
MSDVSLIAVVMAGGTGSRLWPLSRELYPKQFLQLSGEHSLLQTTLLRLSALACKDPLVITNEQHRFIVAEQLRQIDQLHDNIILEPCGRNTAPAIALAAFSALKRNEQEDPLLLVLAADHVIAKENVFCNAIKKAVPIAENGNIVTFGIIPEYAETGYGYIERGAPFSVNGNSTGIDFYHVKNFVEKPERLTAEKYISAGNYFWNSGMFMFKASVYLNELKKFRPDIYSICEQVVSSSYRDLDFIRIPEALFKDCPAESVDFAVMEKTEHCIVCPINIGWSDVGSWQSLWDISEKTNEGDVCKGDILTYNTKNNYIYSESALVAAVGVEDIVIVQTKDAILVSKKSDVQDVKKIVEMLKTQDRTEYISHREVFRPWGKFDSIDQGERYRVKKIVVKPGEGLSLRMHHHRSEHWIVLSGTAKVTLDDKTMLVTANESIYIPLGATYSLENPGVIPLNLIEVSSGDYLGEDDIVRQKERYRKDD

SEQ ID NO: 30536 - protein, 303 aa, Pinus taeda
SYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETECPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 30537 - protein, 303 aa, Pinus taeda
SYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQ

SEQ ID NO: 30538 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPLTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 30539 - protein, 330 aa, Pinus taeda
VAFNNITRLAFGKRFVNEEGKMDPQGVEFKEIVATGLKLGASLTMAEHIPYLRWMFPLEEGAFAKHGARRDNVTKAIMEEHTLARQTSGAKQHFVDALLTLQEKYDLSEDTIIGLLWDMITAGMDTTAITVEWAMAELVRNPRIQQKAQEEIDRVVGRDRVMNETDFPHLPYLQCITKEALRLHPPTPLMLPHKATQNVKIGGYDIPKGSNVHVNVWAIARDPAVWKDPVTFRPERFLEEDVDIKGHDYRLLPFGAGRRICPGAQLGINLVQSMLGHLLHHFVWAPPEGMQAEDIDLTENPGLVTFMAKPVQAIAIPRLPDHLYKRQPLN

SEQ ID NO: 30540 - protein, 400 aa, Gordonia sp. TF6
MSAVRVGDSGRDVSVVIVGTGVAGITAAETLRGNGFDGTITVFGEEPHLPYRRTALSKSLVVGDLSDAKITLRPPGYWSERGIDIVTSTRVVDTSSRLVRLADATEAGYDALVLATGGRARQLPGGSSSPSSLRTRRDAEGLREAIADGPVVIVGGGLIGLEIAAAVATAGEGSQVTVVERGSSLLSRVVPASVAEAVATLHRERGVRILTGAEPIALGAQTVTLADGQTLTGTVISAVGMEPELDLARSAGLSVDSAGVVVDDALRTGVPGVYAAGDVAARPHPLTGAPMRAEQWLTATEHGRLVAMTIAADLGSDADTSVPVPRVPLAWTMQYSTNIQVVGWPTSGDRVDVELDDPSSVVRTFAGDRLVGAVCIGRGASGRALRAEIESSLQPAGVGG

SEQ ID NO: 30541 - protein, 108 aa, Chlamydomonas reinhardtii
MSTLSARAPFSCPSVSRRSGKVSTRFSRSTRAVVVRAAVVPAPKGISMPPKQPDVPPPKNGFVDYAERMNSRAAMIGFFALLAVEGIFGKGLLELVGITTGNGLGFEL

SEQ ID NO: 30542 - protein, 480 aa, Pectobacterium carotovorum subsp. carotovorum
MSVQQLPKDFLWGGAVAAHQVEGGWDQGGKGVSICDVLSGGAHGVDRVITDGVQPGVSYPNHQAVEFYSHYKQDVALFAEMGFKCFRTSIAWTRIFPNGDELEPNEAGLQFYDDLFDELLKYNIEPVITLSHFEMPHHLVKQYGGWLNRKVVDFFVRYSEVVMKRYQSKVKYWMTFNEINNQRNWQYPVFGYCCSGVIFTDHDKPEQAMYQTLHHQFVASAKVVKLGHEINPNFKIGCMLALVPIYPWSCHPDDVMFAQEAMRERHLFGDVQLRGYYPSYILKEWARKGYQIDMQPEDEQTLRDGCTDYLGFSYYMSSAVQLAAKGQKKEDSITGFDGGVKNPHVKASEWGWQIDPVGLRYTLNSFYERYQKPMFIVENGFGAVDKVEADGSINDDYRIEYLKAHIDQMKKTVVEDGVELMGYTPWGCIDCVSFTTGQYSKRYGFIYVDKHDDGTGTFKRSKKKSFDWYKKVISSNGAEL

SEQ ID NO: 30543 - protein, 257 aa, Stellaria longipes
MGRKFFVGGNWKCNGTQESVSKIVDTLNEPTIAANDVVTVVVSPPYVFLPDENAELKHEIQVAAQNCWVKKGGAFTGEVSAQMLANLGITWVILGHSERRTLLGESNEFVGKKAAYAQSEGLGVIACIGELLEEREAGKTFDVCFKQLKSFARFPAKPWDNVVVAYEPVWAIGTGKVASPEQAQEVHVAVRDWLKTNVSEEVASKTRIIYGGSVNGGNSLALAAQEDVDGFLVGGASLKGPEFATIINSVTAKKVAA

SEQ ID NO: 30544 - protein, 200 aa, Vicia faba
MATIGHNNLNAKLVLLGDMGAGKSSLVLRFVKGQFLEFQESTIGAAFFSQTLAVNDATVKFEIWDTAGQERYHSLAPMYYRGAAAAIIVYDITSSDSFTRAKKWVQELQKQGNPNMVMALTGNKSDLEDKRKVTAEEARVYAEENGLFFMETSAKSAANVNDVFYEIAKRLPRAQPAQNPAGMVLVDRPTEGSRAASCCS

SEQ ID NO: 30545 - protein, 317 aa, x Doritaenopsis sp.
MELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 30546 - protein, 331 aa, Clostridium difficile
KILVFGARDYEEPVIKKWSEEHKDVQVDIYPENMTEENVVKAKGYDGISIQQTNYIDNPYIYETLKDAGVKVIASRTAGVDMIHFDLVNENGLIVTNVPSYSPNAIAELAVTQAMNLLRKTPLVKKKVCEGDYRWIAELLGTEVRSITVGVIGTGKIGATSAKLFKGLGANVIAFDQYPNSDLNDILTYKDSLEDLLKEADLITLHTPLLEGTKHMINKDTLAIMKDGAYIVNTGRGGLINTGDLIEALESGKIRAAALDTFETEGLFLNKKMNPGELTDPEINKLLSMEQVIFTHHLGFFTSTAIENIVYSSLSSAVEVIKTGTATNRVN

SEQ ID NO: 30547 - protein, 309 aa, Carica papaya
MENFPVINMEGLNGEERAATMKKIEDACENWGFFELVNHGIPIELLDTVERLTKGHYRKCMEQRFKEIMASKGLDGIQTEVTDMDWESTFFIRHLPEPNIAEIPDLDDEYRKVMKEFALKLEKIAEELLDLLCENLGLEKGYLKKAFYGSRGPTFGTKVSNYPPCPKPNLIKGLRAHTDAGGIILLFQDDKVSGLQLLKDGKWVDVPPMRHSIVVNLGDQLEVITNGKYKSVEHRVVAQTDGTRMSIASFYNPSDAVIYPAPILVEKETEEKKTAYPKFVFEDYMKLYAGLKFQAKEPRFDAMKAAAKA

SEQ ID NO: 30548 - protein, 397 aa, Brassica napus
MGSYLGIYTILVLCLLGYSANAEVFTAGGPPNSDITAAVLKAFTSACQAPAPSQVLIPKGDFKLGETVMTGPCKSPIEFTLQGNVKTDGGSTQGKDRWVVFEKINGFKLNGGGTFDGEGNAAWKANNCHKTFECKKLPISVRFDFVDNAEIKDVTSLDAKNFHFNVISGKNMTFDNIKIIAPAESPNTDGIHLGRCEGVKILNTKIATGDDCISVGDGMKNLLIEKVVCGPGHGISVGSLGRYGWEQDVTDITVKNCTLEGTSNGLRIKTWPSAACTTTAAGIHFEDIILNKVSNPILIDQEYCPWNQCNKNKPSTIKLVDITFRNIRGTSENKDAVKLLCSKGHPCENVEIGDINIEYTGPDGPPTFECTNVTPKLVGAQNPKACVGPVVKAPGKE

SEQ ID NO: 30549 - protein, 466 aa, Berzelia lanuginosa
SVGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVSYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFIFPAMDTL

SEQ ID NO: 30550 - protein, 289 aa, Glycyrrhiza uralensis
MEGKEQDVSLGANKFPERQPIGTAAQTQDDGKDYKEPPPAPLFEPNELTSWSFYRAGIAEFVATFLFLYITILTVMGVNRSESKCKSVGIQGIAWAFGGMIFALVYCTAGISGGHINPAVTFGLFLARKLSLTRAVFYMVMQCLGAICGAGVVKGFEGKTLYGKYNGGANFVNSGYTKGDGLGAEIVGTFVLVYTVFSATDAKRSARDSHVPILAPLPIGFAVFLVRLATIPITGTGINPARSLGAAIIFNKDRGWNDHWIFWVGPFIGAGLAALYHVVVIRAIPFKSK

SEQ ID NO: 30551 - protein, 319 aa, Pinus radiata
MEITHTLLEDVPGFIQVYEDGFVARFDHRLTPASPQVASDGARSKDVVIDPVKGISARLFLPAELPLAQKLPLLFYFHGGGFCIGTTAWEGYHLFLSLLAATTRALVISVDYRLAPEHRLPAAYDDCFDAVEWVASGGGKAEPWLDAHADYGRCFLAGESAGGNIAHVVGSRTADQDLGPLKIRGLIVIHPYFGSEERIECEKVAAGDDAAALELNDLFWRLALPPGSDRDYPTCNPRGPRSADLRKVPLPPVLVTVAGLDLLKTRGLLYYELLQSCGKEAELMEAEGEIHAYHVFHPRSEATRLLQERMSQFIHRFDA

SEQ ID NO: 30552 - protein, 374 aa, Gibberella fujikuroi
MVRNIAIAALLPAAWALPSSSLQERDACTVTDYSGLATAVSSCTNIVLAGFQVPAGKQLDLSKLKAGTTVTFKGKTTFATTADNDFDPIVISGSGITITGASGHVIDGNGQAYWDGEGSNNKDNPKPDHFIVVKKTTGNSKITNLNIQNWPVHCFDITGSSQLTISGLILDNRAGDKPNAKSGSLPAAHNSDGFDISSSDHVTLDNNHVYNQDDCVAVTSGTNIVVSNMYCSGGHGLSIGSVGGKSDNVVDGVQFLNSQIVNSENGCRIKSNSGTTGTINNVTYQNIALTNISKYGVDVQQDYLNGGPTGKPTNGVKISNIKFTKVTGTVASSAQNWYILCGDGSCSGFTFSGNAITGGGKTSSCNYPSNTCPS

SEQ ID NO: 30553 - protein, 342 aa, Spinacia oleracea
MVVQGEIVCVTGAAGFIGSWLVKRLLEHGYIVRATVRDPGNVKKVQHLLDLPNANTHLTLWKADLNEQGSFDEAISGCAGVFHVATPMDFDSNDPENEVIKPTINGMLDIMRSCAKAKIRRLVFTSSAGTVNVEEIQKPVYDETCWSDMEFCSSKKMTGWMYFVSKTLAEKAAWKFAAENNLDFISIIPPLVVGPFITPTMPPSLITALSPITRNEAHYSIIKQGQFVHLDDLCMAHIYLYEHPNAKGRYIASACDATIYDIGKMLREEYPEYNIPTKFKDFEEDMEHVHFSSEKLMGLNFKFKYELKDMYKGAVDTCRTKGLLPPSYGENENNENPNTIID

SEQ ID NO: 30554 - protein, 340 aa, Phytolacca americana
MVAQGETVCVTGAAGFIGSWLIKTLLDRGYVVRATVRDPDNTKKVQHLLDLPNAKTYLTLWKADLNEEGSFDDAINGCTGVFHVATPMDFDSKDPENEVIKPTINGLLDIMRSCVKAKIRRLVFTSSAGTVNVEEVQKPVYDESCWSDMEFCRSKRMTGWMYFVSKTLAEQAAWKFAAENKLDFVTVIPPLVVGPFITPTMPPSLITALSPITRNEAHYSIIKQGQFVHLDDLCMAHIFLYEHPNAQGRYIASACDATIFNIGKMLREEYPEYNVPTKFKDFKEDMERVHFSSKKLTDLGFEFKYGLKEMYTGAVESCRAKGLLHDHAANSLDNDVNGTT

SEQ ID NO: 30555 - protein, 118 aa, Corynebacterium glutamicum
MEKPQIELPVGPAPEDLVISDIIVGEGAEARPGGEVEVHYVGVDFETGEEFDSSWDRGQTSQFPLNGLIAGWQEGIPGMKVGGRRQLTIPPEAAYGPEGSGHPLSGRTLVFIIDLISA

SEQ ID NO: 30556 - protein, 1447 aa, Nicotiana tabacum
MAQLVGSDEIESFRMDLAEIGRSLRSSFRGQSSSFRSNSALSASQKDDAVDEENMLAWAAIERLPTFDRLRSSLFEEINGNDANVKRKRVTDVTKLGALERHVFIEKMIKHIEHDNLQLLHKIRKRIDKVGVELPTVEVRYKNLTIEAECELVHGKPLPTLWNSLKSITMNLARLPGLQSELAKIKILNDVSGVIKPGRMTLLLGPPGCGKTSLLKALSGNLDKSLKVSGEISYNGYKLEEFVPQKTSAYVSQNDLHIPEMTVRETLDYSSRFQGVGSRAEIMTDLSRREKEAGVVPDPDIDTYMKAISIEGQKKNLQTDYILKILGLDICADTLVGDAMRRGISGGQKKRLTTGELIVGPIKALFMDEISNGLDSSTTYQIVACLQQLAHITDATILVSLLQPAPETFDLFDDIILMAEGKILYHGPRNSALEFFESCGFKCPERKGVADFLQEVTSKKDQAQYWHGTKETYKFVSVDMLSRKFKESPYRKKLNEELSVPYDNSRSHRNSITFRDYSLPKWELFRACMSREFLLMKRNSFIYIFKTVQLAIIASITMTVFLRTRMDTDLVHANYYLGALFYALIILLVDGFPELSMTITRLAVFYKQSELCFYPAWAYTIPATILKIPLSLLESVIWASMTYYVIGFSPEAGRFFRQLLLLFAVHMTSISMFRFLASVCRTIVASTAAGGLSILFVLCFSGFIIPRPSMPIWLKWGFWISPLTYGEIGLAVNEFLAPRWQKTLPTNTSIGNEVLESRGLNFDGYFYWISVCALFGFTILFNIGFTLALTFLKAPGSRAIISTDKYSQIEGSSDSIDKADAAENSKATMDSHERAGRMVLPFEPLSLVFQDVQYYVDTPAAMTELGFTQKRLQLLSDITGALRPGILTALMGVSGAGKTTLLDVLAGRKTTGYVEGEIKVGGYPKVQETFARVSGYCEQTDIHSPQITVEESVIFSAWLRLHPQIDSKTKYEFVKEVIETIELDGIKGMLVGMPGVSGLSTEQRKRLTIAVELVANPSIIFMDEPTTGLDARSAAIVMRAVKNVADTGRTIVCTIHQPSIDIFEAFDELILLKTGGRMIYWGHLGRNSCKMIEYFEGISCVPKIKNNHNPATWMLEVTSTSSEADISIDFAEVYKNSALHKNNEELVKKLSFPPAGSKDLHFPTRFSQNGWGQFKTCFWKQYWSYWRSPSYNLMRSLHMLFASLVSGLLFWDKGKKLDNQQSVFSVFGAMFTAVIFCGINNSSSVLPYVTTERSVLYRERFAGMYASWAYALAQVAIEIPYLLAQALAFTVITYPMIGYYWSAYKVFWYFYSMFCTLLYFTYLGMMLVSMTPSFPVAAILQSSFYTMFNLFAGFLMPKAQIPKWWIWFYYLTPTSWTLNGMLTSQYGDIEKEITVFQEKKTVAAFLGDYFGFHHNQLPIVAFVLIAYPLVFASLFAFFIGKLNFQRR

SEQ ID NO: 30557 - protein, 484 aa, Agrobacterium tumefaciens
MIKLKNAALLRDACLVNGRWLKAADGKTIAVENPANSMIIGHVPSLSADEVKAAVESAGKAFSEWSRRSAKDRAAILRRWFDLMVANADDLGALMTAEQGKPFAEAKGEALYAASFVEWFAEEAKRVYGDTIPSPTTDKRITILKQPIGVCAAITPWNFPAAMITRKAAPALAAGCAMIVKPAEQTPLTALALGVLAEEAGVPAGVFQVVTGAARDIGKVFTESDTVRKISFTGSTEVGRLLMAQSAPTIKKLSLELGGNAPFIVFDDADLDAAVEGAIVSKYRNAGQTCVCSNRIYVQDGVYDAFAEKLVKRVESLSVGEGTEPVVLIGPLIDQEAVPKVEDHVADALGKGAKIVIGGKRHALGGTFYEPTVLTGATQAMKVAREETFGPVAPLFRFGTEDEAVAMANDTEFGLAAYFYTENVRRTWRVAEALEYGMVGHNTGLISNEVAPFGGVKQSDLGREGSHYGIDEYLEIKYLCSAIG

SEQ ID NO: 30558 - protein, 317 aa, Oleomonas sagaranensis
MTLDAQAKAILDQIARSPMPKLHQVPASVARQMFEISCKLTEIKNLPIGRVEDRVIPGPDDTELPIRIYTPVAAPPGPLPVLVFFHGGGFVIGSLDSHDAPCRLIANEARCLVVSVDYRLAPENRFPAAVDDCLAAVTWVARNAAEINADPTRIAVGGDSAGGNLSAVVSQQLRDAGGPKIVFQLLIYPATDALHEGLSRTSNAEGYMLDKDLMSWFFAQYLGDGGGVDLADPRFSPLRHANLGNLGTIHVVVAGFDPLRDEGIAYAEALKAAGNKVTLSEFKGQIHGFCSMAGVIEAGRTALVEGAALLKEAFAQA

SEQ ID NO: 30559 - protein, 506 aa, Chlamydomonas incerta
MQFIVQRIIRGLGSTVDGSGAWRGARALHAGSAARCAEFQLNTVRAESFYDSTVEKYAAQDVEVLSLRQMLSFGRNAWNDPDKVLKSARYVQRELPKRLARRLLDLQLLPYIVVTNPHIKKVYNQYYVSFETLRRVPTIKTLEDNQDFCQLLRQHLDSHAPMLDSLATGLRECKSKELVGSCLHMDSFFDSMLRSRISRRVIAEQHLHINNKRPAFIGIICTDLDVHDSIDFAVQKTKQVCMETYGTAPDVVVSGDPHVTIPYIPAHLDYMLYELLKNAMRAVVEQGRAQQAARQAQAGGAGNPAFSCPPPKLPPVHVRVCPGVNGTLTIRISDQGGGVAEELIDKVWSYGFTTIGRNAQAPSGGSSSSSSSSNGAGKDGMGPDVVEGLGSGMVQQMAAGAGASGSAAAATSTGRGGSGGRRQQPGGGLQVLMRGPGGHSRYQMAGLGFGLPLSRLYARYFGGDLRLQTIPGYGVDAYLTLRRLEEHEWEEHVDEPGTLPINMAPY

SEQ ID NO: 30560 - protein, 351 aa, Medicago truncatula
MEKYEVVKDIGSGNFGVARLMRHKDTKQLVAMKYIERGHKIDENVAREIINHRSLRHPNIIRFKEVVLTPTHLGIVMEYAAGGELFDRICSAGRFSEDEARYFFQQLISGVSYCHSMQICHRDLKLENTLLDGSPAPRLKICDFGYSKSSLLHSRPKSTVGTPAYIAPEVLSRREYDGKLADVWSCGVTLYVMLVGAYPFEDQDDPKNFRKTINRIMAVQYKIPDYVHISQECRHLLSRIFVASPARRITIKEIKSHPWFLKNLPRELTEMAQAVYYRKENPTYSLQSIEDIMKIVEEAKNPPQASRSVGGFGWGGEEDDDEINEAEAELEEDEYEKRVKEAQESGEIHVN

SEQ ID NO: 30561 - protein, 383 aa, Rhizopus oryzae
MVQFLSLSSSVAAFFLLSLGIHDVAAAANCVVAPSSGDAAANIVSAFNSCNNGGTVTFTKGVTYNLNSVVTIQGLKHVNVNFAGTINLPARSSSFKNLDHYIELKGDNVQVFGGGTVNGNGQAWYDAQDHTAPTVFRFSLTNSKVSGINIINAPRAHLGVTNSQNLVLDNITLKTVSTSKNLAKNTDALDVSSSQGIIFQNSHLTVGDDCLAVNAGVTNITLNNVNCVGGHGFSVGSLGKGGATENVNLVRILNSSCTNCQNGVRIKTWPGGKGKVSDVKYIGLSLVNVDNPIIITTHYCDQNQESYCNGNDASSLSITGVTISGITGSVSSAGNPIVDIDCSTNTPCTDFTISGVTVNKASNTKKNVCINLQGSSGFPICSQ

SEQ ID NO: 30562 - protein, 138 aa, Shorea roxburghii
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVGNHDELMSNFFAQPDALAFGKTPEELHR

SEQ ID NO: 30563 - protein, 138 aa, Shorea roxburghii
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGKTPEELHR

SEQ ID NO: 30564 - protein, 138 aa, Shorea bracteolata
EKNIPVLLGLLSIWNVSFLGYPARAILPYSQALEKFAPHIQQVSMESNGKGVSIDGVPLPFEAGEIDFGEPGTNGQHSFYQLIHQGRVISCDFIGSAKSQQPIHLKGEVVSNHDELMSNFFAQPDALAFGKTPEELHK

SEQ ID NO: 30565 - protein, 138 aa, Hopea dryobalanoides
EKNLPVLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGKTPEELHK

SEQ ID NO: 30566 - protein, 138 aa, Hopea bilitonensis
EKNIPVLLGLLSIWNVSFLGYPARAILPYSQALEKLAPHIQQVSMESNGKGVSIDGVPLPFEAGEIDFGEPGTNGQHSFYQLIHQGRVIPCDFIGSAKSQQPIHLKGEMVSNHDELMSNFFAQPDALAFGKTPEELHK

SEQ ID NO: 30567 - protein, 138 aa, Hopea odorata
EKNIPVLLGLLSIWNVSFLGHPARAILPYSQALEKFAPHIQQVSMESNGKGVSIDGMPLPFEAGEIDFGEPGTNGQHSFYQLIHQGRVIPCDFIGSAKSQQPIHLKGEVVSNHDELMSNFFAQPDALAFGKTPEELHE

SEQ ID NO: 30568 - protein, 138 aa, Shorea laevis
EKNIHVLLGLLSMWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELRK

SEQ ID NO: 30569 - protein, 138 aa, Shorea maxwelliana
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKNQQPIHLKGEVVSNHDELMSNFFAQPDALAFGKTPEELHK

SEQ ID NO: 30570 - protein, 138 aa, Shorea materialis
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEAVSNHDELMSNFFAQPDALAFGKTPEELHK

SEQ ID NO: 30571 - protein, 138 aa, Shorea isoptera
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHNELMSNFFAQPDALAFGKTPEELHK

SEQ ID NO: 30572 - protein, 138 aa, Shorea scaberrima
EKNIPVLLGLLSIWNVSFLGYPARAILPYSQALEKFAPHIQQVSMESNGKGVSIDGVRLPYEAGEIDFGEPGTNGQHSFYQLIHQGRVIPCDFIGSAKSQQPIHLKGEVVSNHDELMSNFFAQPDALAFGKTPEELHK

SEQ ID NO: 30573 - protein, 138 aa, Shorea scaberrima
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELQK

SEQ ID NO: 30574 - protein, 138 aa, Shorea smithiana
EKNIPVLLGLLSIWNVSFLGYPARAILPYCQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30575 - protein, 138 aa, Shorea macroptera
EKNIPVLLGLLSIWNVSFLGYPARAILPYSQALEKFAPHIQQVSMESNGKGVSIDGMPLPYEAGEIDFGEPGTNGQHSFYQLIHQGRVIPCDFIGSAKSQQPIHLKGEVVSNHDELMSNFFAQPDALAFGKTPEELHR

SEQ ID NO: 30576 - protein, 138 aa, Shorea leprosula
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSHFFAQPDALAFGKTPEELHK

SEQ ID NO: 30577 - protein, 138 aa, Shorea leprosula
EKNIPVLLGLLSIWNVLFLGYPARAILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30578 - protein, 138 aa, Shorea leprosula
EKNIPVLLGLLSIWNVSFLGYPARGILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30579 - protein, 138 aa, Shorea singkawang
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFIGSAKSQQPIHLEGEVVSNHDELMSNFFAQPDALAFGKTPEELHK

SEQ ID NO: 30580 - protein, 138 aa, Shorea ovalis
EKNIPVLLGLLSLWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30581 - protein, 138 aa, Shorea ovalis
EKNIPVLLGLLSIWNVSFLGYPARAILPYSQALEKFAPHIQQVSMESNGKGVSIDGVPLPYEAGEIDFGEPGTNGQHSFYQLIHQGRVIPCDFICSAKSQQPIHLKGEVVSNHDELMSNFFAQPDALAFGKTPEELHK

SEQ ID NO: 30582 - protein, 138 aa, Shorea ovalis
EKNIPVLLGLLSLWNVSFLGYPARAILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEQLHK

SEQ ID NO: 30583 - protein, 138 aa, Shorea ovalis
EKNIPVLLGLLSIWNVSFLGYPARAILPYSQALEKFAPHIQQVSMESNGKGVAIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30584 - protein, 138 aa, Shorea ovalis
EKNIPVLLGLLSIWNVSFLGYPARAILPYSQALEKFAPHIQQLSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30585 - protein, 138 aa, Shorea beccariana
EKNIPVLLGLLSIWNVSFLGYPARTILPYSQALEKFAPHIQQVSMESNGKGVSIDGVPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30586 - protein, 138 aa, Shorea pilosa
EKNIPVLLGLLSIWNVSFLGYPARAILPYSQALEKFAPHIQQVSMESNGKGVSIDGMPLPYEAGEIDFGEPGTNGQHSFYQLIHQGRVIPCDFIGSAKSQQPIHLKGEVVSNHDELMSNFFAQPDALAFGKTPEELHK

SEQ ID NO: 30587 - protein, 309 aa, Oryza sativa (japonica cultivar-group)
MPGGTVSGGILCLSGRMTSPTFWLAVVGFLIIAFCLIKNVKGAMIYGILFVTFISWPRNTAVTVFPDTPAGDESFGYFKKVFDVHRIQSTAGALDFRGARHGYFWEALFTFLYVDILDTTGGLYSMARFAGFVDDATGDFEGQYFAFMSDATAIVFGSLLGTSPVTAFIESSTGIREGGRTGLTALTAAAYFAAALFVTPLLASIPSWAVGPPLVLVGVMMMRAVAEVDWADMRQAVPAFLTLALMPLTYSIAYGLIGGIASYMLLNSWDWACHAVAVLRSRRRRGARAETRSAAAGDNGEQRKNLEMA

SEQ ID NO: 30588 - protein, 223 aa, Oryza sativa (japonica cultivar-group)
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGIRKISSGSHSLLSLLRKDLRDGSLQSFLGGSSYVSNPPAAAPDPFLSSLICSLPVAEPSKDLHSDSSDNNFLLNKFPDDKTAERAEPSLSEKDQKERAQRSKFVRGLVLSTIFEDDNL

SEQ ID NO: 30589 - protein, 454 aa, Oryza sativa (japonica cultivar-group)
MKAPPPPSPVAKRARVSPFVFLLVLFLLLFSFLYGEDLKELLGSQAQARPSLHFNAAAAGDGIELPAATAATTEGRTTTRRWRGRLPFAANGDGEEEEEECDVFSGRWVRDEAARPLYREADCPYIPAQLACEAHGRPETAYQRWRWQPRGCALPAFDAAAMLDRLRGKRVMFVGDSLGRGQFTSLVCLLLAAVPDPAARSFATSPDQQRSVFTAAAYNATVEFYWAPFLLQSNADNAAVHRISDRMVRRGSIGHHGRHWEGADVIVFNTYLWWCTGLQFRILEDGPFDAGGNSSTTTWVSTEEAYAMAFREMLQWAREHMDFATTRVFFTSMSPTHGKSQDWGGGEPGGNCYGETEMIGDAAYWGSDSRRGVMRAIGEVLDGDGADVPVTFLNVTQLSLYRKDAHTSVYKKQWTPPTPEQLADPKTYADCVHWCLPGLQDTWNELLYTKLFYP

SEQ ID NO: 30590 - protein, 247 aa, Oryza sativa (japonica cultivar-group)
MATTAATTMVAAVHHPRPCFRVRAAWDMNPSASPKPKAKPPPPPPPPLPTAPAPTHADLFARHSNSEGQVPKKTTSMGFERWWLPPPPEVKKPRSLYNAASLAYLGDCIYELYARRHFFFPPLSINDYNKRVMDVVKCESQDLLLNKLLGEDFLTQEERDILRWGRNIVSSKTRTRKRAGIAVYNRASSLETLIGYLYLTNFKRLEQLMFQLGFTSGASSHHIADELVSGFKKKNSTSVQSQQQAAQ

SEQ ID NO: 30591 - protein, 251 aa, unidentified bacterium
MNTGDLAWVLISAALVWLMTPGLALFYGGLGERRNLLHTMFVPILIIGIATMVWFTVGYSLAFGGAGDIIGNFKHLFLSGVSFTHSTKSLTIPDGAFALFQGMFPIITAAIITGSVIGRVRIKAMIVFITLWLIFIYTPLAHMVWGGGLLAKLGAIDFAGGTVVHISSGVTGLVLALMIGHRHNDKHVPVRPSYVLIGGALLWVGWFGFNSGSALAANGIAVLALVNTWLASAAGVLTWGLAEYKMHGPGI

SEQ ID NO: 30592 - protein, 451 aa, Haloarcula marismortui ATCC 43049
MADKKVPGDGVVVGYGKVDGRRVYVFAHDFTVFGGSLGEAFAQKVCKVMDKAIETGAPIIGLNDSAGARIQEGIDSLAGYADIFHRNQQASGVVPQISAIMGPCAGGAVYSPSITDFVYMVEETSHMFITGPDVIETVTGEEVGFDELGGAKTHASESGVAHFTAADEKDAMDDIRYLLSYLPQNNVEDPPRVKPWDDPERRDEELKSAVPDAPQKPYDMTDVVGRIVDEDSFFEVAEDFARNIVIGFARMDGHSVGVVGNQPRVNAGTLDINASRKGARFVRFCDAFNIPILTFVDVPGFMPGKDQETNAIINHGAKLLYAYSEATVPLVTVITRKAYGGAYDVMASKHIGADMNYAWPTAEIAVMGPQGAVNVLYDDELEDADDVEARRQQLIDEYRDAFANPYTAAKRGFVDDVIEPQETRPRLIDDLDLLRGKRKDQPDRKHGNIPL

SEQ ID NO: 30593 - protein, 360 aa, Haloarcula marismortui ATCC 43049
MGTGPTRSLPAVSLHVPRYENHIRSRADCGERFCRYRLTHTAMRAVRFHEYGGTDVLRVDDIERPTPGPEEVLLEVEAAAVNPVDTYFRTGDYEPGELPWIPGSDCAGTVAATGERVASVTEGDRAFATGLGNWLQGTCAEYVTVPESHLARLPDGVSAEAGAAVALVGVTAWQTLVDACSLEPAERALIHGGSGGVGHVAVQLAAANGARVTTTASPAYHNQLADLGADDVFDYSRDDLADAVVDAGAPDVVLDHRLDDYLAFDAEVAAQGARIAAIGNTDLAATFENVPRCRAKALSVHHVSMFNTPEFGAVLSRLATLMADDELTPVVARRYDLAEVPAAHDDVRNDSFLGKLVVTP

SEQ ID NO: 30594 - protein, 379 aa, Haloarcula marismortui ATCC 43049
MAQLTLDEVTKTFQDDDGEIIAVDEVSVDIEDGEFLCVVGPSGCGKSTTLRMIAGLEDITRGEIRLDGQIINDQPPARRNVAMVFQSYALYPHMTVRENMAFGLEESTDMPDDEINERVEKACKDMGIFELIDRKPGELSGGQQQRVALGRAIVRDPEVFLMDEPLANLDAKLKAEMRTELQELQQDLDVTTVYVTHDQTEAMTMSDRIAILNDGVLQQCATPLECYHEPNNLFVAGFIGEPSMNFFPTTLEGSTLKGEWFEYELSDETVAAVEGTSDITLGIRPEDIEFVQSDVGPNVFDSTVHVVEPRGNENTAHLQFDESMDDQFIATVGGMKQLKAGQHVKIRFPENAIHLFDTSSGSAIRNRTLDEIETVESVV

SEQ ID NO: 30595 - protein, 401 aa, Haloarcula marismortui ATCC 43049
MTLITDIRLRRVLDSRGNATVEADVLTESGGFGRGKAPSGASTGEYEAIELPANEAIAKAREEALPRLIGEVHAGNQRDVDAALHAADGTDDFSGIGANSAVAISMAAAKAGADVLGAPLYQHLGGTFRGNEYPTPLGNIIGGGEHAADATNIQEFLAAPVGAPSVEEAVFANAAVHQEVHDILADRDLPAGKGDEGAWAPSVSDDEAFEIMDEAVETVADDFGFAISFGLDVAGAELYDDEADGYVYDDGVKSTEEQIEYIAGKVEEYDLVYVEDPLDENDYEAFADLTAQVGDQTLVCGDDLFVTNVERLQAGINADAGNSILIKPNQIGTLTDAVDAIELATASGYESVVSHRSGETEDTTIAHLAVATDAPFIKTGAVGGERTAKLNELIRIEDNAV

SEQ ID NO: 30596 - protein, 445 aa, Haloarcula marismortui ATCC 43049
MSKTPPGPKGEPLFGSSRTYARDPFRFISALERAYGDVARFDMGPMDTVMLCDPTAIERVLVSEADRFRKPDFQGDALGDLLGDGLLLSEGETWEQQRKLANPAFSMARLSGMADRITGHAEDRIADWSHGDVIDAEQSMTRVTLDVILDLMMGVELSEQRVQTIEEQLLPLGQRFEPDPIRFAMPQWMPMPDDAEFNRAVRTLDEVLDDIIEVREDSLGTDEDGPMDFLSVLLRARDDGNQSPEQLRDEMMTMLLAGHDTTALTLTYTWFLLSEHPEVEQRVHEELDDVIGDDRPGMEHVRELDYLEWVIQEAMRLYPPVYTIFREPTEDVTLSGYEVEAGTTLMVPQWGVHRSERFYDDPETFDPERWKPERASERPRFAYFPFGGGPRHCIGKHLAMLEAQLITATTASQYRLEFQGETPLELLPSLTAHPRQKMSMRVQER

SEQ ID NO: 30597 - protein, 330 aa, Haloarcula marismortui ATCC 43049
MYSTHSILGALLRGPIVFSRCMQSYAQRDDDGTVPASVTDLIGDTPLVCLDSFAGNLLGKVEAANPYSVKDRIALYMVEAAAESGDLTDDGMVVEATSGNTGIGLAAVCAARGYDCVLTMPESMSEERRQLLSGLGADLELTPADGGMSGAIERANELADAPGTVRARQFENEANPRAHRETTGPEIWADTDGDVDAVVAGVGTGGTITGISEYIKERVGADLTSVAVEPEQSKLLSAADPDSHDIQGIGPGFVPDILRRDLIDEVRTASKAESVAASQRLASQAGIMVGISSGAALHAAAEYATEHPEETVVVVLPDTGERYLSTDLWE

SEQ ID NO: 30598 - protein, 508 aa, Haloarcula marismortui ATCC 43049
MSSDSKQQSATERKSAIKKRHEQAANEVLPDRRELYIGGEWVQSSGGETFETIDPTTGETLAEVQAGTAEDIDSAVAAAWNAYDETYSELSTGERQAMLDGIADAIAERSEEFAKLESLDNGKPITEARIDIDLVIDHFRYFAGLARSGEGRTIETDDSRHVQTLREPYGVVGQIIPWNFPLLMAAWKLAPALSAGNTVVLKPAEETPLSILKLMEITEDVIPDGVVNVVTGFGPEAGEPLSKHPDIRKLAFTGSTEIGSKVMQSAAESITDVTLELGGKSPLVVFPDADLEQAVQTTITSIFFNTGECCCAGSRLFVHEDIKDEFLDELAAAAEDLTVDDPLLESTDLGPKVTAEQVERTLGYIEEAEREGAAFVTGGSQPDDEALSDGCFVAPTLIDEIDHDSKAVQEEIFGPVQEVFSWSEYDEMIELANDVDYGLAAGVLTEDLSKAHQCAKDIEAGNIWVNTYNDFPAGQPFGGYKQSGIGREIGQETIDHYTQTKTVNISLD

SEQ ID NO: 30599 - protein, 484 aa, Haloarcula marismortui ATCC 43049
MSKSQTRSPEAELGLLDATMIGMGAMIGAGIFVLTGLAAEIAGPAAILVFALNGVVTAFTGLSYAELAASIPKSGGGYAFVREIFDDFASFIMGWMLWFAYMIAGALYALGFAPNFLELLHVYDVVPSPDEIGAVAVPVIDVGLPPAFLLAFIAVLGLVALNAVSTAASGSVETIFTIIKVSILVVFVAFGLTSPMFSGAEFQPLFPEGSGAAAVLPAMGLTFIAFEGYDLITTVTEEVQNPRENIPKAIFISLAVTVVVYLAVVTVAIGTLGAEGLADAGEAGIATAATSFMPTGLPIIQNGGALIVFGAVFSTLTALNAVVIASSRVAFSMGREGQLLPSIGQIHHRYGTPFVAILTSAIVMLGSVALPTQSAGNMSSLFFLLSFIIVNVAVIRLRRERPNMNRPYEMPFYPAPPIIGIALNLILTGVLIEFLLRTDPLALGLSVAWILLGAVVYFALKRIRQQSDREQATAVSEIKPEAED

SEQ ID NO: 30600 - protein, 384 aa, Haloarcula marismortui ATCC 43049
MLAAASAVIRLASESSAMTALFSPLELRETTVPNRVMVSPMCQYSCDARDGLATDWHRTHLGSRAVGGAGLVMTEATAVEARGRISPEDLGIWSDEHAAALEPITGFISEQGSVPGIQLAHAGRKASIERPWDGHDPLQPDDGGWEVVGPSDDPWPYEDTEAPPTTALDQDGIEAVIDSFRTAAERALDAGFEVAEVHAAHGYLLHQFLSPVTNHREDDYGGDFKGRTRLTREVTAAVRDVWPDDKPVFVRISATDWLPDRDAWTVEDSVRLSDRLADIGADFIDVSGGGIHPESRPDYAGPNYQLQYAEQIRAETESDIAVGAVGGITTPEQAEAVIANDRADMAIVGREHLRDPYFTMTAAKELDATDEIEGPPQYRRAWGF

SEQ ID NO: 30601 - protein, 250 aa, Haloarcula marismortui ATCC 43049
MTQPLLSIDDLHKSYGSEEVLEGVGLEMDQGDVTVLIGPSGSGKSTLLRCVNRLTEINSGRIALDGEDVTGADTDVNELRKQVGMVFQDFNLFAHLTALENVTLGPKKVLGMDAADAEAAGRTHLEQVGLLEQADSYPAELSGGQKQRVGIARALAMDPELLLFDEPTSALDPELVGEVVEVMRDLAAEGITMLVVSHEMDFARSAASDIVFLDDGEVVEHGPPEQLFQNPTADRTEQFLSRLHAHEETA

SEQ ID NO: 30602 - protein, 440 aa, Haloarcula marismortui ATCC 43049
MDRDTAEPCVDSMPGPQSSEWVEYHHETAAPSTYVYDFVWDITEDAIGPFCTDADGNVLLDFTCHVAASPLGYNNPKMLDRADEFDMVDPLKIAGQDFYISTGGSPDETSLPGPAHLMDKLTDITSQYDFDTVFLSNSGAEAVENAMKICYDNCETPKYGITFDGAFHGRTLGALSLNRSKSVYRRKFPEISGIHDVEYSEAGVERLRSKLDADTGHIPPEEVAFLILEPIQGEGGYRVPNPEFLSAVDDLCREHDIPIIADEIQSGVGRTGEMWAVDHYDIEPDVITSAKALRVGATVSRSDIFPSETSRLSSTWGAGDILGSMRGALTLAAIEDHDLLDNAAEKGTYFMDRLREISAGRSLVEDVRGLGLMTALEFDTADRRDAVMETALQHGLLTLGCGQKSLRLLPPLDVTERELELCLDILDSVFTEVADPVASA

SEQ ID NO: 30603 - protein, 304 aa, Haloarcula marismortui ATCC 43049
MQEQVRVLGVPMDLGADRRGVDMGPSAIRYGGLADQLSDIGIDCIDGGDIAVPRPEERDPDAGGLDSGRAKFFRETKEVCEDVTTAVDATLREGRFPLVLGGDHSIGIGTVAGAAREDEELGVIWFDAHGDFNTPATTPSGNIHGMSLAAVLGLGAFSDHAWAHTPAVSEENVVIVGLRDVDDGERRLIEESDITAYTMSDIDARSAPAVVDEALDIATDGTDGIHVSLDLDWLDPTEAPGVGTPVRGGVSYREAHIAMEYVAEQHDQLRSMELVEVNPILDEHNRTAELACELVASAFGKRVL

SEQ ID NO: 30604 - protein, 319 aa, Haloarcula marismortui ATCC 43049
MTELVTFGETMLRLSPPGDERLETADQYAVRAAGAESNVAVAAQRLGVDAMWASKLPDSPVGRRVTGELKHHGVSVDVAWDDSDSARQGTYYLEQGSPPRGNDVIYDRQNASVTTATPAELPTEAIADAAGFHTSGITPALSETLESTTADLLSLAQDAGTTTSFDLNYRSKLWTPAEARSVLTELFPSVDLLVVAERDANVVLDRTGDAETIARDLAAEYGFEATVITRGSDGALALADGTVTEQPTFESTDAHPVGTGDSFVGGFLSQYLSGGTVADGLAWGAATAALKRTIPGDIAVVSPDEIRSILSGDTEAISR

SEQ ID NO: 30605 - protein, 494 aa, Haloarcula marismortui ATCC 43049
MANDSEPFSEKLRVPEALTFDDVLLRPKESRVEPDEADTTTRVSKSVELTVPVVSAAMDTVTESDMAIAMARQGGIGVLHRNMNADQMATEIERVKRADELIIRDVVTASPNQTVREVDEMMEHEGVSGAPVVDDDNGEVLGIISGTDIRPYLEVGEDDAVTDAMTDEVVTAPEDVTPREALELMYDHKIERVPIVDGENRLVGLVTMQGILQRREYDQAARADDGSLRCGAAVGPFEMDRAQVADEAGADILFIDCAHAHNANVIESAREIKAEVDADVVVGNIGTREAAEAVVDFADGVKVGIGPGSICTTRVVTGSGMPQITAVAQVADVASQHDVPVIADGGIRYSGDAIKAIAAGADAVMLGSYFAGTDEAPGRVITMNGKKYKQYRGMGSVGAMNEGGGERYLKDDEEGEEFVPEGVEAATPYKGSLASELHQLVGGMQSGMGYVGAETIPEFKQRAEFVRVSAAGQQESHPHDVMITDEAPNYSPDN

SEQ ID NO: 30606 - protein, 280 aa, Haloarcula marismortui ATCC 43049
MSNGWFAGLDPDDDAAAVEQIEAGRADTPEDWPQQAVEAGFADDEAAYYDRLHEVTMAATSAAVAEQEGADDQQLVHAVRAMADCERTANELAERVAEWGGSRHGDSGSGVEYARSLADREDEDEGDRALRSLAEQTAALADEADSIRAYIERTAPAVAPNLSMLAGPVLAARLISLAGGLEALAKKPSGTVQVLGAEDALFAHLKGSAPSPKHGVIFTHEYVRGTRREDRGSAARAFAGKLSIAARIDHYSGDRRPDLQVELDERIERIQARAEEGDDE

SEQ ID NO: 30607 - protein, 210 aa, Haloarcula marismortui ATCC 43049
MTLPSGVERHDFGGETSLATQGQPVYGERTDGDWRRWDPHRSKLGAMLAHGMDTGLGGGETVLYLGAAAGTTVSHVADFGGPTYAVEFAPRPVRELLDAAESRRNLFPLLKDARKPESYAHVVEPVDVVVQDVATRGQARVATLNKQFLTDDGRLLAAIKARSEDVTADPDAVFDSVRAELSAEYELLETARLDPYHEDHLGIVARPRKD

SEQ ID NO: 30608 - protein, 376 aa, Haloarcula marismortui ATCC 43049
MSRQTRTQQTSDFDDVDAAVANPNRTVLELDDVSKDYGHEVAVENLSLGVKDGELLTLLGPSGCGKTTTLRMIAGLERPSDGQISIADEVIADGSSFRKPEERNVGIVFQDYALFPHLTVAENIAFGLTEMEEDAVAERVDELLELVDLSAHHDKMPSQLSGGQQQRVALARSLAPEPDVLLLDEPFSNLDVRLRVEMREEVRKILKRAGVTAISVTHDQEEALSISDRVAIMNDGTIAQIGDPAEVFENPESRFVASFLGQASFLSARVTNDRIETGLGSFNVELLNGPVEAYNGAMVDVLVRPDDLQAMPTNESKADGYVVHRQYNGPSFVYRVELHSGDVVHCMHNHVETFEPGQPVEVDLVADHDLAWYPTE

SEQ ID NO: 30609 - protein, 441 aa, Haloarcula marismortui ATCC 43049
MERTAHTPPGLPVVGNLPRLARDPLRFLTGMQDAYANQYPLVRVDPQVGQSVTVVLDPDIAHEVLADRDRFRRPNVGAQEQRRQGLVSSDGALWEQQRSVLDPEFVGGRLADYAEIAGDTLEETLTAWPESGRVDLFEELSILTMRVITRSLFSQDTDRERGETVHEALAALNDEFDASVFDLVLPEQLQSGVSAEFEEADAVLDSVATEFVDWHLNHEDPPRDVITALIDAKADPDIELSENELIDQTVLFMTGGQETTALTIAYAFYWLSQNPAAKERVRAEAQDVLDGGQPGWADLSDLTYTERVVRETLRLTPAVWSVSREAREPVTLAGTDLDAGEFVMLPIYAHHRDSRVWSDPLTFDPDRWAGSASRGDSAYYPFGSGPRVCIGRQVALTEAQFALAHVLQHYDVQVTADELDLQPSVTLRPSGPMEAEISALE

SEQ ID NO: 30610 - protein, 480 aa, Haloarcula marismortui ATCC 43049
MLTGSEMGVVDENAAALGVPRKQLMESSGHAVARAVRTLADPGDQVTIVAGRGNNGGDALVTARFLDEYDLRVLLLGRPDAISTTIARENWDALQHAEYPTEPVKDSSAFDLGSPDIVVDAMLGTGIAGALREPEATAATAMNESDATVLSVDVPSGLDAETGRLAENAVDADHVVTFHDTKPGLPDLDVPVTVADIGIPDTAELFIERGDLTRLERDPASHKGDNGEVLVVGGGPYTGAPALTAQAALRSGADLVRVACPAVVAREIQSYSENLIMRPFDGDHLAPHHVDRLAELAADHDTLIVGPGLGNADATLDAVADLLSGFAGTAVVDADALSVVPDIETDADLVCTPHQGELLGMGGETAEDWRERADLVESFAAEVGQTLLVKGPYDIVSNGERTRVGRTGNPGMTVGGTGDVLAGVTGALASVQDPLDAAAIAAYTVGSVGDRVVDDRGYGLVATDLLDEIPSVLWQRDAEP

SEQ ID NO: 30611 - protein, 303 aa, Haloarcula marismortui ATCC 43049
MKDSILDTIGSPLVSVRAPEGATVAAKIESFNPGGSAKDRPAKYMIDDAERNGSLQPDDTLVEPTSGNTGIGMAMVGATKGYDVVLVMPSSKSPERRQIMKAYGAEIELVEGDISDAKERANELCERDDYVQLRQFENPANPTAHYETTGEEILEQVGDRTVDALVAGVGTGGTLTGTGRRLQDAFPGMDIVAVEPADNAVLSGMEPGTGEDSFQGMGPGFVSDNLDTDLLDDVMTVELPDAEDECRRLAHEEGILVGQSSGASNLAAREFAEQLIRDGVDDPLVVTVYWDSGERYMSTGMFD

SEQ ID NO: 30612 - protein, 1133 aa, Haloarcula marismortui ATCC 43049
MSTQQEPVSLDLDRRSFMKASALAGGVALGVSGAGRALQEDSEETDGTDTDTELTKTICNYCSVGCGFRGEREGNSFVGMEPWHEHPINAGSLCSKGAGIYETEHSEKRLKHPMIQEDGEWRKLGWNETYDRLATDIRALWPDDDTSPDEAVDVDAEHSRESVMLLGSAHHSNEEAYAIRKLAAFMGTNNIDHQARICHSTTVTGLANTWGYGAMTNTVQDYRNFDLNIIIGQNPAEAHPIAMQHILEGQKRGGTILNLDPRFTKTSAHADEFMRFRPGTDVALMMGIIKELRDKHGLAMDPDADEIGQNMLTDRVQGWEDVDAELDEYDKETVEEITWVSAEDIERIADMIDEARPHVQIEWAMGGTQHNNGTQNIRSYAVASLASGSAARSGGGLQVMRGHANVQGATDLAVASHILPGYYGLSPGGWSWWAEIWDRTPETSGDTSFADMYNRFELMSPEKYVRQSPTYEGSEDADSLPPNTAHGPNNPAENSMMFQNGLTVARWFESALDQEDRYQETPIYQPDQTKIAVFWGHSANSISEMEQMKEGMENLDLLVVVDVFPSVASVLPDYEDGPPVLLLPASSQYEHYRSLTNTNRSVQWSEPVRSPAHNSKPDLQIMQELAGYLGFGEHFDWGAGSELYNGKSSYEGVVREFNLGTNTIGYRQTPERLQQHLEYDYAFSNEDLKGAEGTPVAGEYWMLPWPCWGEDHPGTPIIWNDDLDPNNGGQDFRTRWGVSAPTPEDWADMPTDDDYPMQETLDAVGDRYESQEEALDLTRAPYNPAWADDDDTAADGMIHGIPEYPGWKVTPPQSLIDPNQEVQPDELTIPQQYALDNQESVYTAAQALNNPDTGSAVFDEYLETMIGEGVDPEFYEQYDFKQPDAPTGRGRARAVVWSFLDKVPVHREPIEGPDTELLNEWPANGQQRNFYRLDQNNLVEQEQATDIIHNQDDGPDLDTIMTSGRQVEHQGGGAETRNNIHTADLQPHMYAEITPNKAEELGIDGGDLVVISSTDRGSVLVKARVTDRPNDREVFLPYHWGGVFKGESLEDKYPDGHVPYAIGDSANAITSRGYDVETQMQETKVSMVAVNPATPEVLDQYNIDVDLDFDFPQDVNDVGTQKDFDVRDNSTVQ

SEQ ID NO: 30613 - protein, 344 aa, Haloarcula marismortui ATCC 43049
MLKEIHEQPRALRQCLRGRVDELAGTVDIGDLGDLSPTGVQFVACGTSYHAALHGAQLFREAGIPAQAFLASEYATATPPIGDALVVGVTQSGETADTLSALRAARRCGARTLAVTNVVGSTAARECDHALYIRAGPEIGVAATKTFASQLAALNLLALGTSSTGDARQVISALRDLPGHVQEVLDESAAQEIAELYQDADAYFFIGRGYQEPVALEGALKMKEITYKHAEGFASGELKHGPLALVTENTPVFAIVTGDDERAHKTIGNVKEVEARDAPVVAITDGQNDVERYADHVLEIPATHPRAAAVLANTHLQLVSYHTAALLGRNIDKPRNLAKSVTVE

SEQ ID NO: 30614 - protein, 250 aa, Haloarcula marismortui ATCC 43049
MSDPLLELDDVYKSYGEEQVLSGVSFEMDAGDVDVVIGPSGSGKSTMLRCVNRLTEINGGDIYLDGDCVTDADTDVNELRKQVGMVFQDFNLFAHLTALGNITLGLRKVRGMDKAAAQEKGYEHLEQVGLLDQADSYPAELSGGQKQRVGIARALAMDPKLLLFDEPTSALDPELVGEVVEVMRDLAAEGITMLVVSHEMGFARSAASDIIFLDDGRIVEHGPPEQLFENPQAARTGEFLSRLETAHEEE

SEQ ID NO: 30615 - protein, 323 aa, Haloarcula marismortui ATCC 43049
MSYKVVVSDTKVMHGETRAAVLDAVDATVETIAAKEPEAVARAVDGADALIVDAGTQVTAEVIEAADSLKVVGRAGIGMDNIAVRAAVAAGVTVVNVPDYSVEEVSTHTFALMLACLRRIPTFDRSVKRGEWKWAVGQPIRRLAGSTVGLVAFGKLASRFAAKLRGFDIDVIAYDPYAPEYRMGDLGVESVTLETLLGDSDIVSLHAPLTDETRGMIDADALDRMHDDALLVNTARGGLVDETALYDALISGDLGGAGLDVRKPEPPGDSPLHDLDSVVCSPHVAWYSEESRVELTQTVAEDVIRVLRGEQPENPIDPETGWF

SEQ ID NO: 30616 - protein, 293 aa, Haloarcula marismortui ATCC 43049
MGLERAFADEPAFVPYLAAGDPNYEASLEYVEALARGGADVIELGLPFSEPIAEGKTIQNAIVRSLEAGMTPDRFFQFVEDLDVDVPLVCMTYYNLIYQYGEGDSESRSDSENASGETASQGPRPFVEKAAAVGIEGLVVPDLPGEEAGPLRTACDEFDLDLVFIVAPTTKGDRLERMLEQVSGYVYVQARLGVTGAREDVDDATEDSLARLSDWDVPKAVGFGIKTGAHAERIVSAGADGIIVGSALVDIVAEGHENGDSTDAVADRLEAKARELKEGALRGAAERPQPERT

SEQ ID NO: 30617 - protein, 267 aa, Haloarcula marismortui ATCC 43049
MLPGAGADRGAADYAIVGAPLDASTSFRPGARFGPDRIRKFGQQFDDYDHRTDQHFTDCSVYDHGDIGPTADVAEYLTYLQGTLSDFSSDRAVPLVVGGEHTVSVAGVRALAPDVFVCLDAHLDLRESYAGDEYSHATVTNHALSVADEAVVLGARTGSEAEWDRASEADVTVVPPEDVADWSPAFDDERVYLSVDIDAADPGFAPGTGTPEPFGLDPREMHDVVRAVAPQAVGFDVVEVNDRDDGQAATLAAKLLRAFVFAHADQR

SEQ ID NO: 30618 - protein, 387 aa, Haloarcula marismortui ATCC 43049
MIDYLGLEGDLGEEERMVRDTARDFVENEVKPDVGQHWIDGTFPTDLITEMGELGFYAPNLDGYGLPGLSETAYGLLLQELEAGDSGLRSMASVQGALVMYPIHAYGSDAQKEEWLPALGSGERVGCFGLTEPEHGSNPSAMETTAERDADGYVLNGSKTWITNAPISDLAVVWAKVTSADGDPVRGFLVETDRDGVTTNKIDEKLSLRASITGEISLQNAHVPEENVLPGVEGMKGPLSCLTQARYGIAWGTVGAAMDCFETAHEYATDREQFGKPIAGYQLQQEKLAEMATQISLGQLLAHRLADLKERGDLRPEQVSMAKRNNARMAREQSRVAREMLGGNGITADYSPMRHLTNLETVYTYEGTHDIHSLIIGHDLTGIPAFE

SEQ ID NO: 30619 - protein, 489 aa, Haloarcula marismortui ATCC 43049
MSQPDSQTAWDRLYIDGEWRDAGTSETIPVTNPATGDEIAAVPAGTEGDVNDAYQAAEAAQSDWAALSREERNEYVQAMIGVMQERLDEIVELLATESGSVQAKATAEANFAMADFQSALEMVPPEEEVRDSMYHEDKDHHIVREPAGVVGIISPWNFPLHLTTRALGPALALGNTVVIKPATDTPITGGLLLADIAEEAGLPDGVVNVVTGHGSDIGDRMAGHPTARVMSFTGSTAVGRSVASQAGDALALPALELGGNGPFVVTEDADIEAAAKAGSVGAFGHQGQVCISINRHLVHEDVYDEYVEKLVEHAESLTIGNPLDEDVEFGPIINESQVEQLTSFIEQTVDAGATLETGGEVEDLFLEPTVLSECTNDMSAACNEHFGPVAPVIPFESDEEAVELANDTEYGLAAGVYSSDVEHGRSIADQIDAGMVHVNDHPIQDEPNAPFGGMKNSGLGRYNGEWIMDELTETKWISVQHEERDYQLL

SEQ ID NO: 30620 - protein, 320 aa, Haloarcula marismortui ATCC 43049
MERVVASDDPMIDVDRLRAELDADVVVAETDDEDAVRDAAAGAAGLVVDVNTPVTAGVLDALDDLKIVARAGVGIDNIDVSAAADNGVTVTNVPEYCTDEVATHTVTLLLDCVRTLTAYDRDVRDGGWGWERTRPVHRVRDQTLGLVSFGPIARRVRDQLRGFDLDVIAYDPYVDAEEMADADVEKVALETLYERADYVSLHAPLTGETAEMIDADALAAMREQAILVNTGRGGLVDEAALRTALEDGMIGAAGLDVLAEEPPTAEHPLVGLDNCIVTPHAAWYSEEARDDLNAAVAANVEAALAGETPPNRIDPDTDWL

SEQ ID NO: 30621 - protein, 313 aa, Haloarcula marismortui ATCC 43049
MTGWTIEDMPPLRDRTVVVTGANSGLGLEGSKAFARRGATVVMACRSVERGESAAAEIREAVPNATLDVRECDLADLSNVASFADGLRADYDAVDILCNNAGVMAIPRSETADGFETQFGVNHLGHFALTGHLLDLLGAADGESRIVTQSSGAHEMGEIDFDDLQRERSYGKWSAYGQSKLANLLFAYELQRRLGNHGWDDVLSVACHPGYADTDLQFRGPREMGSTLRTAAMGVANAVFAQSAEQGALPMLYAATAEDVIGGEYVGPGGLFDMRGSPEFQQSNDASQDEETAEQLWAVSTDLTGVEYDFERT

SEQ ID NO: 30622 - protein, 464 aa, Haloarcula marismortui ATCC 43049
MSDAEQPAESETHDHHDHDHEGPGYATPQAAIEAAEPEQTAYVMGLHVGQDVDAPDFLAVVDLDPDSDTYSEIINRVQMPNKGDELHHFGWNACSSSCHMDGLERRHLVIPGQRSSRIHIVDTKERRDPELTKVIEPEEVYEHDLSAPHTVHCIPDGEILISMLGDADGDLPGGFLELNDDFEVQGRWDPPGEIEMNYDYWYQPRQNVMLSTEWAAPKTYYPGFDLDDVEDGKYGQRLNFWDWEDGVIEQTIDLGEDGLIPLEARFLHTPESTHGYVGAALSSNIIHFHESDGRYHAEPVIEFDDREHEGWDMPVPALVTDILISMDDRYLFGSSWLHGEVWMYDISDPSNPRKADSISIGGYFGDIEQVQGRDIVAGPQMLQLSLDGERLYWTTSLFSSWDNQFFPEEAEKGSVMLKADVDPRTGTMSLDRDFLVDFGDLPEGPARAHEIRWPDGDCTSDVWQ

SEQ ID NO: 30623 - protein, 299 aa, Haloarcula marismortui ATCC 43049
MELGVIGLGRMGRIVVDRVLEAGHEVVVFDIDEESVADAADAGARPASSIADLAGKLGSEKRIWLMVPAGDPVDAALDELAPTLDSDDVVVDGGNSYFEDSVRRAESTDAAYLDCGTSGGPAGADLGFSLMVGGPEWAYDELVPVFDAVATGPDGHDRMGPAGSGHYVKMIHNGVEYALMQTYGEGFELLANGRYDLDLESVANTWNNGAVIRSWLLELCEEAFREEGNDLGDVADRVEGGSTGTWTVQEALEQEVPVPLIYQSLAERFGSRADDGRFARRLASRLRYGFGRHEVPRRE

SEQ ID NO: 30624 - protein, 400 aa, Haloarcula marismortui ATCC 43049
MTFQTLDDLDDGQRVLVRLDLNSPVEDGTVQDNRRFDRHAETVSELVDRGFEVAVLAHQGRPGRDDFVSLAQHAEILADHIDHDVDFVDETYGPQAIHDIADLDGGDVLVLENTRMCDDELPEEDPEVKSQTEFVQTLKDEFDAYINDAYSAAHRSHASLVGFPLVMDAYAGRVMETEYEANTAIAEKEFDGQVTMVVGGTKATDVIDVMTHLDEKVDDFLLGGIAGELFLRAAGYPVGYDIDDANLYDEQWEENSEKIESMLEDHRDQITLAVDLAYEDDGDRAEQAVDDIEEKSVSYLDVGSETVMEYSPVIRDSEAVFVKGALGMFEDERFSVGTAGVLEAIADTDCFSVVGGGDTSRAIEMYGMEEDEFGHVSIAGGAYIRALTGAELVGVEVLQR

SEQ ID NO: 30625 - protein, 308 aa, Haloarcula marismortui ATCC 43049
MDIARIAVHESVAKACPLEAMVAALQGPDVRVETVGDDASFDASDCVVTFSPREAFLDAAWVHGIRAGYDEFDVDAYEAAGTVLTNSTGIHGDTVPETVVGYLTAFARRLHVYRDRQRDNDWTQEPYDAPFTLTGEQVCVVGLGTIGQGVADRTDALGMDVVGVRRSGDPAENVERVYTPDELDAAVADARFVVLCCPLTEETEGMVDAALLAQMRADSYLVNVARGPVVVEDALLNALDTGTIAGAALDAHWAEPLPDDHPLWNHESAIVTPHVAAATSRYHEDIAALVRENVERATRGESLRNRVA

SEQ ID NO: 30626 - protein, 120 aa, Haloarcula marismortui ATCC 43049
MTDVDLAFDEQEYIPAVAQDADSGDVLMLAYVTEEALRKTRETGEAHYYSRSRDELWHKGGTSGHTQAVKEVRVDCDGDALLYIVDQTGGACHTGYESCFHRTVDGETVGEQVFDPDDVY

SEQ ID NO: 30627 - protein, 479 aa, Haloarcula marismortui ATCC 43049
MRRDFLSGGREPRDMDNDADVDAGAIAFGTDGWRATLDVFTKPRVRMVGQAVATTLAERGASGTVAIGYDARETSPGFADELAHVLRANGFDVLLPDRDTPTPILAWTVKDRGLAGALQITASHNPPEYNGVKFIPGDGSPALPDWTAAFEENLAVLDPLPEDEWGERTEEDLIGPFHDHALDFVDTDLDDLSVAYDALYGSGRGVTDALLEAAGADVTRLNCEQDPEFGGGSPEPSAENAEGLVGEVSEGDAALGIINDGDADRIGVVTPDRGYLDPNLFFAAMYDFLLEDGTGDVVRTVSTSSIVDRVAEAHGQNVHEVAVGFKWVAEAMAEHDALFGGEESGGFGLPDHLRNKDGVLVALAAAAAEREEPLDARVDRLLDEHGEIHQDRISVDCSDDRKEPVLEDLETALPETLAGVAVDGINTVDGFKIRLEDGTWVLVRPSGTEPKLRVYAEAGSDARVGELLDAGQELVEPLV

SEQ ID NO: 30628 - protein, 442 aa, Haloarcula marismortui ATCC 43049
MSYTALQVDPNVLAEGVNLLWVLTVSFLIFFMHAGFAMLEAGQVRSKNVANQLTKNLLTWSVGVVVFFLIGSGISSLVGTGSFAPAFGAEAANDYVGWLFGAVFAMTAATIVSGAVAGRAKLRAYITYTFLLAAVIYPVVTGLTWAGAHISLGGVVFKDFAGGMIVHGMGGIAGLTAAYVLGPRMGRYNEDGSANVIPGHSMTFAVLGTLILAFGWYGFNVGTAASVFVVEDGALALGAFATVGRVAMTTTVAMAMGAIGAALVAWLKTGKVDTLYVANGLLAGLVGITAIPDTTTWWGALIVGLLAGGQLPIVFSFMENRMKIDDVCAVFPVHGSAGVLGTIMYPLVATSGTVGSIGSALAVQVVGVAVIAGWTIVTTGLIWYGLKAAGQARVTPEHEQEGLDVSEHGVETYPEFGGGEGVVADGGKVNTNVRTDGGSKDD

SEQ ID NO: 30629 - protein, 440 aa, Haloarcula marismortui ATCC 43049
MGLIKMTKYRTLLLATIGFNFSFLIWFSFAPFTGPMAEEFGLSTAEIGILASSAIWMAPFGRMLTGWLSDKFGAPAIFAIVLAYVGVFSIGSAFAQDYSVFFVLRLIVATAGITFVIGIQHVAEWFEEENLGLAEGIYAGVGNAGAAGGALILPRVFGSGWNGPLFSTNWRAAFFYTGIVSILLAIAYYTLGEAAKTEAKRQATKENTNFKGWLHTATRYGTVVLAAAYIMSFGLELSMNGWLATYYREAFNQDNLVIASTFAATFSIAAGLLRPFGGYGSDLLARKEKNLLPFFKGQYREQWTFLGLCFIVVMMFAMTLAGLSGVLLNAVVIGFLVGTGCAWAEGAIFAQVPAMFPNDSGSVAGVVGGVGTVGGIVYPLFYSAPWLANLHLGYSVAAVTMIPIVLLSAWVFQPEIAKVANTAGFVGSTQEGTTVASGDD

SEQ ID NO: 30630 - protein, 445 aa, Haloarcula marismortui ATCC 43049
MNHEQSRALYDRALSVLSGGVNSSVRATRPYPFFVEKGDGGHVIDADGNRYIDFVMGYGPLLLGHSLPEQVQSAIQQHAAEGPMYGAPTEVEVELAEFVTRHVPSVEMLRFVNSGTEATVSAVRLARGYTGRDKIVVMQSGYHGAQESTLVEGEGDHTAPSSPGIPESFAEHTLTVPFNDEEAAHEVFEEHGDDIAAVLTEPILGNYGIVHPVEGYHDTLRQLCDDHGSLLIFDEVITGFRVGGLQCAQGAFDIDPDITTFGKIVGGGFPVGAIGGKSEIIEQFTPAGDVFQSGTFSGHPVTMAAGLETLRYAAEHDVYGHVNDLGERLRAGLQDILEDQAPEYTVVGRDSMFKVIFTRDGPDSLEGQCEAGCQQQESCPRFEYCPKTGHDVTQAETERWERLFWPAMKDQGVFLTANQFESQFICDAHTGEDIENALEAYKEAI

SEQ ID NO: 30631 - protein, 499 aa, Haloarcula marismortui ATCC 43049
MAQDSRPRYGIEGNWEELYINGDWCEPDSGDSLAVENPSTRETVAQVPRGNEADVDAAYEAAERAQEEWRQTPPAHREELTQDLLQAIEQRREEIVSLLAAEAGQVPPVGHTSVDLTTDQVAEAATMPRRMKGEHAVSNIPGKEHIVEREPQGVVTVISPWNFPLNLSVRALAPAIAAGNTVVLKPATNTPITGGLLFARLFEDVGFPDGVLNIVTGRGSEIGDAVAGHEHSDVVAFTGSSEVGRRVAATAGENLSEAAMELGGNNAHIVTADADIDAAVDAGLFGSFTHQGQVCISINRHIVEADVYDEYVEKLTARVADLPAGSAHDEVVVGPIIDESQRDEILTYIQQTIEAGATLETGGDVVELNGVDDSLVVAPTVLSDVTNEMAAACNEHFGPVVPIIQAADVDEAVALANDTPLGLSGSVHAGDVGAGKRIAQRMETGMVHVNDQPINDEAHVPFSGTGASGVGGYNSDDFLAEVTEKKWISLQHEAREFPF

SEQ ID NO: 30632 - protein, 375 aa, Haloarcula marismortui ATCC 43049
MSGFVFNEKPIQIERGDGAYVYDDSGTEYLDMGASYACVPLGHKHPAVHSAVSEQLEKITYVQASYPNAERTALYDLLAKTAPDPIDKTWLCNSGTEANEAALKFARSATGNSKIVATMQGFHGRTMGALATTWKNKYKKPYEPLIGDVEFVPYDDSEALEEAVDEDTAAFIVEPVQGEGGINPTSDGYLEDAREITEDAGAALIFDEVQTGMGRTGALWNSQRAAVAPDMITAAKGLGNGLPIGATLCRDWIAEDYGSHASTFSGGPVISAAAGATVSTIIEDSVPGNAAVIGDYLLTELEAAIGDDVRDIRGEGLMIGVEVGRGANAALKKLALNHQVLALPAGRTVIRLLPPLTIDKDHADAVVDAMAEVVE

SEQ ID NO: 30633 - protein, 331 aa, Haloarcula marismortui ATCC 43049
MERPIVALVLAGGTGTRLYPASRSDRPKQFLSFGEDESLLAETVSRVGFADETYVLTRDSFADGVREHVPNVAVLTEPEPKDTGPALAYAAHRIREQVGDCVLLCLPSDHRISGPFETVARTATRVAVETEGLVTVGIEPDRPATGYGYIKPGPSENGFAPVETFHEKPDRETATEYVREGFYWNAGLFAWAPTALLSAAASSPLAPMVERLDDGDHDDAFAAVDPVSIDYAVLEDAENAFVVPAALDWDDLGSWDAFERVLDGQDGNAVLGEAVSIDADGNVLASDGHISAVGVEDLVVASFDDRTLVVPKEEAQRVREVVGELRDDGRF

SEQ ID NO: 30634 - protein, 480 aa, Haloarcula marismortui ATCC 43049
MSKCRRKRRNLCANQQGFSSSTAPIGCPKMTSELSEAAQEVLDEIDEKNVDFLRLQFTDILGTIKNVSITADQAEKAFTEGIYFDGSSINGFVRIQESDMRLDPDPSTFSVLPWRENVEGGSSARLICDVIDTSTGEPFSGDPRGVLKRAIERANDMGYTVNAAPEPEFFLFEEDEEGRATTKTNDAGGYFDLAPKDLASDVRRDIIYGLEDMGFDIEASHHEVAQGQHEINFTYDDALSTADNVATFRSVVRAIAAEHDLHATFMPKPIPKINGSGMHTHLSLFTEDGENAFHDEDDEFNLSETAKSFTAGILKHAPAITAVSNPTVNSYKRLVPGYEAPVYVAWSDRNRSALIRKPAARTPAASRIEARFPDPSCNPYLAFAALIHAGLDGVEQDLECDDPVRENIYDFDEEKREEYGITTLPSNLGEAVEALEDDEVIQDALGEHVYENFVEAKTQEHKEYLVDVSDWELDRYLEKF

SEQ ID NO: 30635 - protein, 271 aa, Haloarcula marismortui ATCC 43049
MTTVTLGPEGTYSHRAAQAVTDDDISFSESVTAIVEAVANGEAERGVVPVENSIEGSVTESLDAFAEYDVAVVEEVITPIRHALLAQDDSFSLVASHAQALAQCRGWLDEHYPGVNVEAVASTARGVERARGDADIAAIGHPENATNGTELKVLAEDIQDRSSNATRFVVVASKSERSEAGGKTSFIVYPDVDYPGLLLELLEPFADRDINLTRVESRPSGERLGDYVFHIDISAGLYEQRTQEALADIEDIAGKGWVRRLGSYDSKTVVN

SEQ ID NO: 30636 - protein, 279 aa, Haloarcula marismortui ATCC 43049
MVTNESETFDIGGELTVHRLGFGAMRLTGDDVIGEPDNETDAHAVLKRAVELGVDFIDTADSYGPGVSERLIGEALDTEREDLVIATKGGLLRNTDADWLAHGDPDYLRNAQLCSRDRLQMDPIDLYQYHRPDPDTPFEDSIHALAEMKDEGLIRHIGVSNVSVEQLDRARDIVDIVTVQNQYNLSHRDDEDVLEACERYGIGFIPWFPLGAGDLGGVDGIDEIAQRHDATPYQIALAWLLGHSDVTLPIPGTSSLDHLEQNVAASAIDLTDEELARLS

SEQ ID NO: 30637 - protein, 472 aa, Haloarcula marismortui ATCC 43049
MVVGDVTTGTELLVIGGGPGGYVAAIRGAQLGLDTTLVERDAYGGTCLNHGCIPSKALISASDVAHDARQAESMGVFADPAVDMAGMTEWKDGVVTRLTRGVESLCKNAGVNLVEGTAEFVDDGTVRVAHGGEGQGSESLSFEHAIVATGSRPMAVPGFEFDGEHILSSKDALALESVPEKLLVVGAGYIGMELSTVFAKLGAEVTVVEMLDDVLPGYEDDIATVVRDRAEELGIDFNFGEAADNWEETDEGIRVQTVDEDEVVTEYNAEKCLVAVGREPVTDTLALDNIDLQTDENGVIPTDDQCRTAFESVFAVGDVAGEPMLAHKAMAEGEVAARAAAGEPAAFDHQAIPAAVFTDPEIATVGMTESEAEAAGFEPVIGQMPVRANGRALTVNEKEGFVRVVADADEEFLLGAQIVGPEASELIAELGLGIEMGARLEDIAGTIHTHPTLSEAVHEAAAAARGEAVHTR

SEQ ID NO: 30638 - protein, 348 aa, Haloarcula marismortui ATCC 43049
MTMQAVQFDSHGDRDVLEYGEFPDPEPGRDEVVIDVKAAALNHLDIWTRRGLPGIDLEMPHIPGSDAAGVVDEVGDGVSRFEPGDRVAVLAGKSGGGDEFSRKGDQTLAPDFHIIGEHVRGVHSEYAAVPAENLTPVPEGVDWETAAASPLVFQTAWRMLRDRGDLKAGESVLVLGASGGVGHAAVQIADHAGAEVFATASSQEKLDYAKELGADHTINYEETDFASEIRDLTDGRGVDMVVDHIGAQTWQDSLKSLVKGGRVVTCGATTGGNPETDINRIFWNQLQVIGSTMATPGQADEVLDLVWQGEMEPRVRETLPMSEIARAHEIIEDREGFGKVVVVPDSEL

SEQ ID NO: 30639 - protein, 481 aa, Haloarcula marismortui ATCC 43049
MTQTYENYIDGEWTGSGETQEVTNPADETDVVSTVPVASAADADEAVAAAAAATDEWGEMPGPERGAILRETGEILKSRKDELAETLTREEGKPLGEAEGEVQRAIDIFYYYAEKARDFGGTVKQPSGGRAGLQTKKEPMGVAALITPWNYPIAIPAWKIAPALAVGNTVVIKPAMQAPTVGAMIVEALDEAGIPDGAINLVCGPGSEVGEQLTTHDDVDVVSFTGSASVGEHVYEQATSNGKRAQAEMGGKNPTVVMPSADVDKAADIVGAGAFGGTGQACTATSRAIVHEDVYDEFLDAIVDYAESLEIGDGLDRAGMGPHVSEDELAGSLEYIDVAQSEGATLETGGEELTSGEYDGGNFISPAVFSDVEPDMRIAQEEVFGPVLAVMSVSDFDEGVEVANDIDYGLSASIVTDRIKEENEFIERSESGVVKVNEKTTGLELHVPFGGLKRSSTNTYREQGDAGLEFFSYIKTVYRNS

SEQ ID NO: 30640 - protein, 451 aa, Haloarcula marismortui ATCC 43049
MPSGSCLYPPIDTPSMHVDIGAALASAADPGVERATLDDLDEQVAVAHERIEQGRNKGEFGYASLNLLEATDAETIHDAVAPVADAESVITVGIGGSALGAKTITEALAEDPGSHVVLDNVDPEHVRRTLDGLSLADTAINVVSRSGTTAETLANFLVVREAYEDRGVDWTERIVVTTGESGPLRALADQHDLPTLPVPEGVPGRFSALSAVGLVPPAILGIDIEGLLAGGQQAADDLAPSLYDSPAYAYGAMAYALEEAGATVNAVMPYAERLESFGEWFAQLWAESLGKDGRGQTPARALGATDQHSQLQLYRAGHRDKVVTFVRPRERADVSIPDPDHEDLSYLAGTDLGGLIDAEYEATVASLPAADRPALEVEIDRLDAESVGELLYAMEAACVLVGELADVETFTQPAVEWGKNATRALIRGEATDETAVIDERERLRIGETESL

SEQ ID NO: 30641 - protein, 458 aa, Haloarcula marismortui ATCC 43049
MDTQQAIRETPEPVTPGDRPPRLGRVPFVDNTAAMLRDPLGFYDRAGAHEADMVGYSVAGTTGCFVCHPDLVEQVLVTDADVYEKGQLLQDTLGQFIGEGLFLLEGEEWQQQRTALQPAFYRERIAAYGDTMTEFADRAAAGWSDGQRIDVLPHMQSLTLNILGKTLLDVDIETTADALEPLLDALRTRLDPRSLSAYLPLWVPTATNRAVTNSLAEFQSTLDDVIAARQREDEHAREARDDVLSLLLSLDDETMDRERLGHQLLTFLVAGHDTTALTLTYAWFLLANNPKRQQRLHDELDATLGERQPTPEDLFELPYLDAVLNEVLRLYPPAFTVFRQPTEPVTLGGYELSTDAQLTLPQWLVHRDDRWYDAPDAFRPERWDDDLEASLPDYAYYPFGGGPRHCIGMRFARMEAKLALATIAQQYAVEAVTEPPLSLAMQITLSPTAPVEVRLRER

SEQ ID NO: 30642 - protein, 384 aa, Haloarcula marismortui ATCC 43049
MSQDFYEILGVSRDASEDEIQEAYREKAREYHPDVSDDPDAEEKFKQAKKAKEVLTDEEKRQMYDQMGHERFEQAEKRGGAGGGGGRGGMGGDPFGGGAGGFDMQDIFDQFFGGGGRGGRGGSRRRQGQDLQTRLEIDLEEAYNGATKQLNVTRPEACDDCDGAGHPPGADSETCPECNGQGQTTQVQQTPMGRVQQRTTCRRCDGEGTLYDETCSTCRGNGVVQNDASLEVEIPSGIADGQTLRMEREGAPGENGGPNGDLLIEVQVRDHPDFERDGDSLQHQQAISFPQAVFGDTITVPTLDGEVEVDVPSGTQSGEVFRLEGKGMPRLRRRGHGDLYVQVQVVTPDSLNAEQKEALEQFAEAGGEEVDVDEGFFEKLKNSL

SEQ ID NO: 30643 - protein, 216 aa, Haloarcula marismortui ATCC 43049
MSNPRILIVGPPGAGKGTQSANLAEAYGVEHITTGDALRANKDMDISDMDTEYDTPREYMEAGDLVPDAVVNAIVDEALSQADGFVLDGYPRNLEQAEELEGMTALDVILSLDVSREELVDRLTGRRVCDDCGTNYHVEFNQPEEDGVCDECGGDLIQRDDDNEESVRNRLDVFDDNTAPVIDHYGDHDGFVAIDGEQTPDEVWSEIQDAVDAHTA

SEQ ID NO: 30644 - protein, 416 aa, Haloarcula marismortui ATCC 43049
MSTSHVIIGDGIAGASAAETIREADPDASVTVLTDEGEALYNRILIKEFAKGKLPEAPISIHEPEWYDERDIDLQLNTHVTDIDPDAHEIQTHEGDTYEYDKLLVATGGTPAQVPVENSDADGIHHFWTFQDARGIREHADEADQGIIVGAGLLGIDLAAVCAAQEIDAKYLMRGNRWWRYALSEEGAEIIHEALEENGVEPVFESGVDHFEVDDDGHVTGAVDPDGNHYEGEWAGVAIGLDFNTEFLNGTGLELDDGVVVDEYMQTNVEDIYAAGDLTQFYDTILDSQAQNGAWGSAKEQGSVAGTNMVADAEEKEFRWVSSYSITHFDFPFLSFGHPTRGDDEAERKYSDSEWRRLAFEDGQLVGGVLIGDLSQQSAFKQLIREERQVADKKELLLEKEVDLEEVKAQTPAPAE

SEQ ID NO: 30645 - protein, 466 aa, Haloarcula marismortui ATCC 43049
MTHVVIIGAYGSAGAAVAGDLVEAEDIELTLIDNGEPGGGLCILRGCMPSKEVLSAGAHRFQARHDERLVGDVPEVDLEAVVERKDDHVLDWAGHRRDSVHEMAERDDVTFIHDTATFVDEHTVRAGGEEHEADYVVIATGSSVNVPETPGIDEVDFMTSDQVLDATEFPDSGIVMGFGYIGMEMVPYLAEAGGMELTVIEHDDRPIDEGDPEFGDEALDIYENNWDVTIPTNCYEKELEETEDGGVRLTVEYDDGSEETFEADQLFLFTGRRPTVEGLGLENTPVSVDGDWARDTMQTRDADHIYAVGDVNGKEPILHVAKEQGFTAAENIVRQEAGGSLEAYRNVHHHVIFSGLGVYPFARVGHNEETAKEAGYDIVTATRQASDDGVFKSKDVPEGLAKLVVDADDGTVLGWQGMHYHADSFAKTFQTIVELGLDVRDLPDRAYHPTLPENVDGLIRDCVDQL

SEQ ID NO: 30646 - protein, 506 aa, Haloarcula marismortui ATCC 43049
MTSHSEIDTLRIKARHAELAESLLPSGPLKHFVDGEWITGRGDDTFQSIDPTTGESLVGVYEGTKEEVNRAVDAAWEAYEQRWSETTPAERQQLLLTMADRLEARAEDFALIEVLDNGKPITEAREDIELAVDHFRYFAGAARNIEGKTVPHKELHIQTRREPYGVVGQVVPWNFPLLLATWKLAPALAAGNTVVLKPAEQTPISLLTYMREIADVLPDGVVNVVTGFGPETGAPLVSHERVPKVAFTGSTEVGQGVMKAAANTISDITLELGGKSPLIVAPDADPAEAADIAVDAMFFNGGECCSAGTRLFIHESIADEFVDAFLDAVGKLQMGDPLEESTDIGPQVSRAEVEKTLHYIGLARDSDASILRGGGTVEEGILAEGCFVEPTVIADVGADSTVATQEIFGPVEIMLEWDGYDEMVARANNVDYGLAAGVVTDDLSFAHRIAEDIMAGNIWVNTFNRLPAGQPFGGYKQSGIGREGAMETLREYTQTKSITMNLGDGQ

SEQ ID NO: 30647 - protein, 477 aa, Haloarcula marismortui ATCC 43049
MVVGDVTTSTDVLVIGAGPGGYVAAIRAAQLALDVTLVEKGEYGGACLNRGCIPSKALIHGSKLASEAGQAEELGIYADPTVALDEMINWKDGVVDQLTSGIEQLCTAAGVNLLKGTAEFADENKVRIIHQGEGQGSESLKFENCIIATGSRPIEIPGFGFEDERIVSSDGALNFDTVPDELVIVGAGYIGMELATVYSRLGSDVSVIEMLEQALPSYEEDIASIVRKRAERLGVDFHFGYTADSWAASDGKAVLTAVPADEAAHDSDIELTADRILVAVGRRPVTDTLSIDDAGVETNAQGFIPTDSTCRTNKEHIFAVGDVAGEPMLAHKGSKEGEVAAEVIAGEPAAVDYQALPAAVFTDPEIGTVGLTENEAANKGMTPVTGEFQFQASGRALTANRAEGFVRIIATKETERVIGAQIVGPEASELIAEIAAMIEMGAKLEDIGSTVHTHPTLSEAIMEAAQNAREKAIHRRN

SEQ ID NO: 30648 - protein, 453 aa, Haloarcula marismortui ATCC 43049
MDAVNPATGERLNVYDPDDDEAVERKLDRATSTFEDWREVPLRKREQLLVNAGEVLRENKQRYAELMTREMGKPITQAVAEVEKCAWACDHYAEYAHKYLSEEHHPSPPGTEVKTVHDPLGPVLAVMPWNYPFWQVIRFAAPYLTAGNVGLLKHASNVPGCALALEEVFAEAGYPDGAFQTLMVGSSNVDGILADDRVRAATLTGSGPAGRAVAETAGKHLKKTVLELGGSDPFIVLDDADLDAALETGVQARTLNGGQSCIAAKRFIVHTDVYDEYVDRLVAAFEDLTVGDPMSDETDVGPQADPDLMAELHDQVQASVDAGATLLTGGEPLDRTGAFYPPTVLTDVPSGCPADTEETFGPVATVYEVADAEEAIAVANDTRFGLGASLWTADRERGQRLARDISAGCVYINEMTKSDPRVPFGGIKDAGYGRELSEMGIKEFVNKKTVWVE

SEQ ID NO: 30649 - protein, 483 aa, Haloarcula marismortui ATCC 43049
MEYTGPTDLYIGGEWREATNGDSIETEDPATERTYASVQKAEASDIDAAVEAAQAAVAEGSEWATMDPGTRRAKLHAMADAIEAMKDELSMVESHDNGKTPFEAGLEIDMVIDTFRHYAGWTDKVRGDEIPVENGRLNYTTREPVGVTAHIAPWNYPFQLAGRGLAPALATGNSVILKPSAMTPLSALYYAKAAEEAGLPDGVVNVVPGKGSEAGDALTGHEGVDHVTFTGSTGVGKTVQRTAADAVADVTLELGGKGPAVVFPDADLDAAARGIQYGIFMNAGQMCWANSRIVVHEDVYEEMVSRMAEIAENIPLGGGIDDDGQMGPVVSAGQQQEILDYIETGKEEGATVAAGGGVPGDKETGHFVEPTVFADVDNEMTIAQEEIFGPVLTAIEVSDEEAAIDVANDSPFGLTACVWTNDLTRAHTVTDRLDYGMVMVNETPNTWPQTPFGGTKQSGHGRAQGEQAIESYTEVKNVHINLG

SEQ ID NO: 30650 - protein, 407 aa, Haloarcula marismortui ATCC 43049
MNRSHTVSVRLLTIIGTDSAYAEPAVNYVIRLPGGVTLFDSTTLNELPLDNRVGLAPMTRVSATDDGRATAEMAQYYQRFADGGFSFLITEGTYPDEAHSQGYLNQPGLATDTQAASWQQVTETVHEAGVPIFAQLMHAGAQSQGNPHVAGEQTIAPSAVQPDGQKAEAYGGSGDFPTPKAATVDELADIRDSFVTSAQNAIDAGFDGVEIHGANGYLLHEFLSADFNQRDDEYGGEPANRVRYPREVVAAVDEATPADFVVGIRVSQSTALDEDHRWPEGEDAAAVFFEELSAAGADYIHVTEPDATTPAFGDDGPTLAEAAAEYAADETVIIDNGGLGTPDAAREKIDAGADLVTLATSALANPDWPDKVEAGEELTAFDPAKFLAPSAALSEHEVQTGGASADD

SEQ ID NO: 30651 - protein, 500 aa, Mentha x piperita
MELQISSAIIILVVTYTISLLIIKQWRKPKPQENLPPGPPKLPLIGHLHLLWGKLPQHALASVAKQYGPVAHVQLGEVFSVVLSSREATKEAMKLVDPACADRFESIGTKIMWYDNDDIIFSPYSVHWRQMRKICVSELLSARNVRSFGFIRQDEVSRLLGHLRSSAAAGEAVDLTERIATLTCSIICRAAFGSVIRDHEELVELVKDALSMASGFELADMFPSSKLLNLLCWNKSKLWRMRRRVDAILEAIVEEHKLKKSGEFGGEDIIDVLFRMQKDSQIKVPITTNAIKAFIFDTFSAGTETSSTTTLWVMAELMRNPEVMAKAQAEVRAALKGKTDWDVDDVQELKYMKSVVKETMRMHPPIPLIPRSCREECEVNGYTIPNKARIMINVWSMGRNPLYWEKPETFWPERFDQVSRDFMGNDFEFIPFGAGRRICPGLNFGLANVEVPLAQLLYHFDWKLAEGMNPSDMDMSEAEGLTGIRKNNLLLVPTPYDPSS

SEQ ID NO: 30652 - protein, 498 aa, Mentha x piperita
MELLQLWSALIILVVTYTISLLINQWRKPKPQGKFPPGPPKLPLIGHLHLLWGKLPQHALASVAKEYGPVAHVQLGEVFSVVLSSREATKEAMKLVDPACANRFESIGTRIMWYDNEDIIFSPYSEHWRQMRKICVSELLSSRNVRSFGFIRQDEVSRLLRHLRSSAGAAVDMTERIETLTCSIICRAAFGSVIRDNAELVGLVKDALSMASGFELADMFPSSKLLNLLCWNKSKLWRMRRRVDTILEAIVDEHKFKKSGEFGGEDIIDVLFRMQKDTQIKVPITTNSIKAFIFDTFSAGTETSSTTTLWVLAELMRNPAVMAKAQAEVRAALKEKTNWDVDDVQELKYMKSVVKETMRMHPPIPLIPRSCREECVVNGYTIPNKARIMINVWSMGRNPLYWEKPDTFWPERFDQVSKDFMGNDFEFVPFGAGRRICPGLNFGLANVEVPLAQLLYHFDWKLAEGMKPSDMDMSEAEGLTGILKNNLLLVPTPYDPSS

SEQ ID NO: 30653 - protein, 497 aa, Streptomyces nodosus
MTPQPPPPKADNGQAGRTGPTSPAEHGSGLQAGLKNRHLSMIAIGGVIGAGLFVGSSSGIATAGPGILLSYALVGTLVVLVMRMLGEMSAANPTSGSFSAHADRALGSWAGFSIGWLYWFFWVVVLAVEATAGAAILSSWVPAVPQWGWALIVMIVLTATNLISVGSYGEFEFWFAGIKVVAISIFIVIGLLAVFGVLPGVHADKAGLGNLTDHGGFLPHGLSAIFTGVLLVVFSFMGSEIATLAAGESEDPQRAVTKATNSIIWRIGVFYLGSVFVVVTLLPWNDKAIAEKGSYVAALDSLGIAHAGEIMKFIVLTSVLSCLNSGLYTASRMAFSLGERGDAPKAFARTNSRGVPMAAILSSVVFGFVAVFFNYRFPDSVFLFLVNSSGAVALFVWLVICFSQLRLRRIIQSEAPEKLIVKMWLYPYLTWAAAFLIILVFGYMLTDTEHDGRETVLLSMLVAVIVLAVAFIKQRVEGGRAKATEPAAAEAEKVSAG

SEQ ID NO: 30654 - protein, 338 aa, Pantoea agglomerans
QITAKRFLIATGASSTAPNIPGLDEVDYLTSTSLLELKKVPNRLTVIGSGYIGMELGQLFHNLGSEVTLIQRSERLLKEYDPEISEAITKALTEQGINLVTGATYERVEQDGDIKKVHVEINGKKRIIEAEQLLIATGRKPNTESLNLHAAGVEVGSRGEIVIDDYLKTTNSRIYSAGDVTLGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCAG

SEQ ID NO: 30655 - protein, 259 aa, Oryza sativa (japonica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 30656 - protein, 353 aa, Oryza sativa (japonica cultivar-group)
MGEAVKGPVVVTGASGFVGSWLVMKLLQAGYTVRATKERLTLWKADLGEEGSFDAAIRGCTGVFHVATPMDFESEDPENEVVKPTVEGMLSIMRACRDAGTVKRIVFTSSAGTVNIEERQRPSYDHDDWSDIDFCRRVKMTGWMYFVSKSLAEKAAMEYAREHGLDLISVIPTLVVGPFISNGMPPSHVTALALLTGNEAHYSILKQVQFVHLDDLCDAEIFLFESPEARGRYVCSSHDATIHGLATMLADMFPEYDVPRSFPGIDADHLQPVHFSSWKLLAHGFRFRYTLEDMFEAAVRTCREKGLLPPLPPPPTTAVAGGDGSAGVAGEKEPILGRGTGTAVGAETEALVK

SEQ ID NO: 30657 - protein, 259 aa, Oryza sativa (japonica cultivar-group)
MPHYLRSLLCSIAEARYLNRTLVLDLSVCLAAAYAGGMPEEGKRLAFYIDIEHLQSVVGIVEHKRFWEDWDKWGAQGQLGVRIIEDSRVAPTKFSKSRDPLIVRKFGDVEPGNYWYNVCEGEAEHVLRPPQGAIRTAPSLMDIVDGIISRMQVDFDSVHVGGNDGNLRRRIEERLNGGGRQVYVAGEGINVVLLDALKAKYSSVHYLDAFEELWARDSKWFLEMKRLNGGVPVEFDGYMRELVDREVFLKGKKKVEVLV

SEQ ID NO: 30658 - protein, 378 aa, Oryza sativa (japonica cultivar-group)
MDLKQVATTLPHATNIRGGAHGNRRTSSGSPHWIRNSTSTEVVISLGSSHVVEGTGAPTSLRSLDGGAMVTSRERHVSRATRAALPSPFTLFVGEASRQWEVDLKTRETGLEGTYQEDPYCRHHWRGLGGGARANLDDGGAHRPKPFKRAAAVVWDGRQRQRGAPRRQQGGKWDAEAGAAAAWDAAAAAAAWGAEAAVAWEEPAAVQGRRRRRTGLSRRIPTPPGGGRVVPRPALPPPPRPAPPRPPHPASPPLPHSKPTSTPRTFTHHLVDLLHSPLYLPRRLTISDIAVHRWSKRTAVASALLSPLLLAAITARHHNNHPPVLLTISLAGVLLAAAAAATTDAASPPKSRSSRLPALWSYVLARELVSLLVSLLEK

SEQ ID NO: 30659 - protein, 446 aa, Oryza sativa (japonica cultivar-group)
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQHIANLAGNKTLVLPVPAFNVINGGSHAGNKLAMQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 30660 - protein, 353 aa, Oryza sativa (japonica cultivar-group)
MHPRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNGF

SEQ ID NO: 30661 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFSNYKPRTDLPNVVELYMKKELEVEKFITHSVPFAEINKAFDLMA

SEQ ID NO: 30662 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 30663 - protein, 316 aa, Streptomyces coelicolor A3(2)
MRYDSPLAAVGNTPLVRLPRLSPSDDVRIWAKLEDRNPTGSIKDRPALHMIEQAEKDGRLTQGCTILEPTSGNTGISLAMAARLKGYRIVCVMPENTSQERRDLLTMWGAEIISSPAAGGSNTAVRVAKELSAEHPDWVMLYQYGNPDNAGAHYAGTGPEILADLPSVTHFVAGLGTTGTLMGVGRYLREHKPDVKIVAAEPRYDDLVYGLRNLDEGFVPELYDASVLTTRFSVGSADAVTRTRELLQQEGIFAGVSTGAALHAAIGVGKKAVKAGESADIVFVVADGGWKYLSTGVYTAETTEAAIETLHGQLWA

SEQ ID NO: 30664 - protein, 475 aa, Streptomyces coelicolor A3(2)
MTSAQVDTDKAPEEGYERGLNSRQVQMIAIGGAIGVGLFLGAGANIAKAGPSIILMYALAGVIIFFIMRALGELLLYRPVSGSFAEYSREFLGPFFGYFTGWTYWLMWVVTGMAELTAAAIYIHYWFPDIPQWVSALVFLVLLFVANLISVKLFGEIEFWFSMVKVTAIIGMIVIGVGVLTLGFSQAGDTAAVSNLWEFDGFFPKGIGSSLMTLQGVMFAYLAVELVGVTAGESENPEKTLPKAINTLPWRIALFYVGALTVILAVVKWTEFAEGVSPFVEAFAVIGIPAGAGIVNFVVLTAALSSCNSGMYSTGRMLRTLADNGEAPRIFNKLSSTKTPAIGIAVSVVFMAIGVVLNYLVPEKAFGYVTSVATAAGIWTWLMILISHVRYRRKVVAGRLPASSFPAPGGSVCSYIAIAFLLFVTCLIAYDADARVCLYVMAGWAAALGIGWAVLKSRNPQITERPGEPEFEKIG

SEQ ID NO: 30665 - protein, 448 aa, Streptomyces coelicolor A3(2)
MDVADLGLPVDVPSTALFTDQYELTMLRAALKAGTAGRRSVFEVFTRRLPDGRRYGVVAGTGRVLDAVENFRFDADVLRFLREQDIVDEETLDWLAQYRFSGDIWGYPEGEVYFPGSPIMRVEGTFGECVLLETVILSILNHDSAIAAAASRMSSAAGPRPLIEMGARRTHELAAVAAARSAYVGGFATTSDLAAGFRYNIPTVGTSAHAFTLLHDNERDAFRAQVDALGRDTTLLVDTYDVAEAVRTAVEVAGPELGAVRIDSGDLLLVAHRVRQQLDELGATETKIVVTSDLDEYAIASLAAAPVDAYGVGTQLVTGSGHPTASMVYKLVARAESGAEGAPLVPVAKKSSGGKTSVGGRKWAARRLDADGHAEAEVVGTGPVPDALADRQLLVELVKGGEVVAREPLDAARDRHAAARANLPLSATQLSRGEPVIPTEYAHGGSGS

SEQ ID NO: 30666 - protein, 483 aa, Pseudomonas putida
MTMHTRLAESNSSTESHSVIDIFNAQKKASSARRGKFSLAERIAALNILKEIIQRRESEIIAALAADFRKPASEVKLTEIFPVLQEISHAKRNLKTWMMPRRVKAALSVLGTKARLSFEPKGVCLIIAPWNYPFNLSFGPLVSALAAGNSVIIKPSELTPHTASLIGSIIREAFSVDLVTVVEGDAAVSQELLTLPFDHIFFTGSPRVGKLVMEAAAKTLASVTLELGGKSPTIIGPTANLKKAARNIVWGKFSNNGQTCIAPDHVFVHRSIAHDFHKIIMEEVTRVYGKDFEAQKKSPDYCRIVNDQHLNRLYELIGDAKSKGAKILQGGEIDALDRFVAPTIISKVTPEMDISREEIFGPLLPIIEYDDIDHVIKQINDNAKPLALYIFSEDKEFAQDIVGRTSSGSVGINLSVVQFLHPNLPFGGVNNSGIGSAHGFYGFQAFSHEKPILLDRFSITHLLFPPYTGKVKRLISMTVRYLS

SEQ ID NO: 30667 - protein, 196 aa, Physcomitrella patens
MSTSRFIKCVTVGDGAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELRKAIGAASYIECSSKTQQNVKAVFDAAIKVVLQPPKQKKKKKKQKNCVIL

SEQ ID NO: 30668 - protein, 215 aa, Marinomonas mediterranea
AIVVADNTFATPLNQSPLTLGVDVVLHSATKFLSGHADAMGGVACGAESLMSQVRHYREINGASLDPFSAYLIIRGIKTLALRMRQQQASAMALAEYLQTEPLVEAVNYPGLPTHTGHEIAKAQMKGFGAIVSFVLKGGMETVTKLLPKLQFAHCAGNLGAVETIYGPARTTSHVENTLEERLALGISEGLVRISVGIEDTEDLVADLKQAFASL

SEQ ID NO: 30669 - protein, 345 aa, Marinomonas mediterranea
MRGFFVTATNSAVEMLIANSNTFFILLGAIMVFAMHAGFAFLEVGTVRSKNQVNALVKIMTDFAISALVYFFIGYQIAYGINFFESAATLAEQSGYALVKFFFLMTFAAAIPAIISGGVAERARFYPMLISAAVIVGVAYPFLEGLIWNGNYGFQDWLETQFGAPFHDFAGSIVVHGFGGWVALAAIILLGTRNGRFRGDKLVAFAPSNIPFLALGAWILCIGWFGFNVMSAQTLDGISGLVAVNSLMAMVGGIIAAMILGKNDPGFIHNGPLAGLVAVCAGSDIMHPIGALATGLVAGALFTWLFTLIQQKFQHIDDVLGVWPLHGICGAWGGIAAGIFGLESL

SEQ ID NO: 30670 - protein, 484 aa, Haloarcula marismortui ATCC 43049
MTHTSDYDLVILGGGAAAFAAITEASRRDLSTAMVNTGLPIGGTCVNVGCVPSKHLLAVAESGAAASENPFDAVRYPEEPTVDWAAALNDTDELVERFRQENYVDIAEHFEIDIYEGYGQLVDDTTIEVVDGADEGARITGEKALVATGSSPWAPPIDGLYDVDYYTSETILEERDLPESILMLGGGYIALEWGQILHRVGIDVTVLQRSDRVLSDMEGQLGREMQRAFEEEGIEVITGNDFQRVRTLAADGGAEAIQSGVAVETTIDGDERTVTGDALFVATGVQPNSEGIGLETVGIETNPDGTIRVDEYFQTTNPDIYAAGDVIGEPELETVAAKEGNHAVKNAFGNEGVSIDYDAVPAVVFTSPEVAAVGTTELEYMDEHGTCSCRTVQMADVPRAKAVENTDGLVQVVKHHETDEIVGVHMVGPRAADMIMEATLAVTFGLTVDDIIDTVHPFPTFSEAFKQACQAFRRDISMMSCCIE

SEQ ID NO: 30671 - protein, 459 aa, Haloarcula marismortui ATCC 43049
MSTATIRNVLRGDGDRFVYIVSALAALNGLLFGFDTGIISGAFLFIQDSFVMSPLVEGIIVSGAMAGAAAGAAVGGQLADRLGRRRLILIAAIVFFVGSFTMAVAPTVPVLVAGRLIDGVAIGFASIVGPLYISEIAPPEIRGGLTSLNQLMVTTGILLSYFVNYAFADAGAWRWMLGAGMVPAVVLAIGILKMPESPRWLFEHGRTDEARAVLKRTRSGGVEQELDEIQETVETQSETGIWDLLAPWLRPALVVGLGLAVFQQITGINAVIYYAPTILESTGLGNVASILATVGIGTINVVMTVVAIMLVDRVGRRRLLLVGVGGMVATLAVLGTVFYLPGLEGGLGIIATISLMLFVSFFAIGLGPVFWLLISEIYPLSVRGSAMGLVTVANWGANLLVSLTFPVLTDGVGTSATFWLFGLCSLAGLVFVYRYVPETKGRTLEAIEDDLRQNISLAD

SEQ ID NO: 30672 - protein, 476 aa, Haloarcula marismortui ATCC 43049
MAEQPVDVDPAGENIAGEAPAEEPEAVTDDTVVHDDDVELERTIGLVGGLAIGIGTMIGAGIFVFPGLAAANAGLAATLSFAIGGLIALLVALPTSELATAMPRSGGGYYFISRGMGTAYGAIVGLGLWLGLMFASAFYLVGLGHYASAVFAELGIGLPFSPVIGIGLLFGVALTALSIGGTENTAKLQNVVVGVLLVVLTGFLSYGVLDAVGVFGGGTVPEQFFSRGYFRVLTTAALVFTSYLGFAQVATVAGEIKQPSRNLPLAMVGSVLIVTVFYVVTIFVATSAFGAERLGEFGETAMVEVARDFLGLPGAVAILGAGLLATFSSANASILSASRAVYALSRDALLPRKASEVNLRYGTPHVALLSAGGPILVLVATGRVELLAEVASFLHLIMYGLMCIALLVLRRRNPEWYSPSYRVPGYPLVPVVGALASFGLIVFMQPASIGIGVVVMLASYLWYRYYAGDVTLKGDI

SEQ ID NO: 30673 - protein, 368 aa, Haloarcula marismortui ATCC 43049
MTDRNGDDIYGEKHKEANEPIFSGIPTFLKLPEVERDALDEENVDIGILGAPLDTATTIRPGTRYGPRAVRAASTVPSPPYEHFNIETGIDPFDTFSVADTGDAAVSPGDTRQSQLNIEDAVYEISEQATPIVIGGDHSISYPDIKGWAEANDYDDIGLIHFDCHADTGDEGLTGFEYDHGAWVKRVFDDDLMAGENYTLIGPRGFWPGPDTYEEMREAGMKWYTSMEVGGMDLDDIVTDAVQRATDGTDAVWVSFDVDVMEPAYAPGTGEPEPGGLIPREAIYMVREVVKALDPEDFGFDVVEVSPAYDTSDSSSYNGGVTSGLANRLIIEVMGSMALAEKGLESGDPIKPKEPLGPTEEAETPADD

SEQ ID NO: 30674 - protein, 309 aa, Haloarcula marismortui ATCC 43049
MAKRPAERAGVADIDCTGMQVLVTGSTSGIGREAALSLGRLGADVIVHGRDADAGAAVVSELSGLGVDAAFVQADFAAVDEVRSLAATVRDETDGLDILVNNAGGLFRQGRLTDIGVEYTFHVNHLAPYLLTTELLDHLNAGARVVTTASSAHRGTSLDLDRVTTVDSYTGTWAYSHSKLANVLFATELARRLETTGRDVVSNCLHPGAIPGSGFSRFLPGPIPQFVKLFDAVPGITSVEDGAAEILHLAVSSRIGDVSGRYFAGQRPATPSHAARDRAAASRLWRRSADLLGIDVPLGDVQSSAPTEN

SEQ ID NO: 30675 - protein, 369 aa, Haloarcula marismortui ATCC 43049
MNELRTGLSYGDVLLVPKRSPVDSRSDIDLSTPLTPTVELDTPLVSAAMDTVTEAELAIELGQSGGFGVLHRFLTPEEQAEQVEQVTEAGEQVGAAVGINEDYVARSAAVITAGVDALVVDVAHGHLNRALDAVETLADEFPDADIIAGNVATPAGVEDLAAAGADCVKVGIGPGSHCTTRKVAGAGVPQLTAVDDCATAAEDLDVTICADGGIRTSGDAVKALMAGADTVMLGSLFAGTEEAPGVVVEVDGTRYKRSRGMATTAAAEDRDDKQNNVSADEGVEALTPYKGSVAAVAEEFCAGIRSGLSYCGGHTIAAARDKAEFIRVAQSAKEREGFHTDHDWEGVNVESEATQVRDAGTEATVDSDD

SEQ ID NO: 30676 - protein, 277 aa, Haloarcula marismortui ATCC 43049
MLGMGLTLQPADFQRLIKEPVDIGIGAVTQWLVMPAAAYGLYVLLDLPDAVGIGLILVGAAPGGTASNVMAYLGRGDVALSVAITTLTTLAAPIVMPAWVVFTLGEQINVTFAEMFQSIIQIVIIPVFLGFTIRYLLDRYSPKAAEIGTDVFPVISVAAIVAIVAGVVGANVDNILTAGLLVLVAVVTHNAIGLGSGYGVGRATGMSTDRVRTCAFEVGLQNSGLAVALATTLFEPAAALIPALFSVWHNITGPALASFFSWQDSGQKSVEAVPSDD

SEQ ID NO: 30677 - protein, 338 aa, Haloarcula marismortui ATCC 43049
MSDTMQAAVVPEPGDDFEVVERDVPEPDPGEVRVSVDACGICHSDVFAKEGTNPVVSYPRVPGHEVAGHVDAVGDAVDAWDVGDRVGVGWHGGHCSTCDQCRQGNFLQCENGEITGLSYDGGYAEYMTAPSEALAKIPESLDAAAAAPLLCAGVTTFNALRNSDANVGDLVAVQGVGGLGHLGIQYAHAAGFETAAISRTPEKESLAKELGADHFINAAETDAGQRLQELGGADVVLATAPSSDAISSIVSGIGVDGSVVVVGVPGEPVAVSGQQLVQTRGAVEGWASGHARDSQDTLEFSSLRDIAPEIETYPLEEVNEAYGRMIDNEARFRAVLEL

SEQ ID NO: 30678 - protein, 1103 aa, Haloarcula marismortui ATCC 43049
MSTDKSIPRVPDLHDPQPETPVTHEFETGTANDPDVGTDTDDPTTLTVDGERVTVAPGSTIIDALQDLDDDIVSVDPGAEGVEDDADVPALCYYDRDGDCSDEVGPRSECRTCMVETEEHGLVPSCSFPAEDGLSVSTDTPDAEEARSVNLDLVLSNHNLRCTTCNGNGRCELQDAAISEGVDHPRYGVFDERDQYEPIDDTSSFIQIDRNKCILCNRCVDACNDVQVEGVLRIEGHGEDTRIGFQSDAETMHDSECVSCGHCATVCPTGSLTEKGIDGAATLPLPGFTQRNSIGKVIEHEDAETIDDTTAPNRGFEPGDPRAAKSKQGLAKFASQAKRRAGDIAKDYGKKAFLAGEHTAESIAANTMPEGRLFDIADIVSDYRLSKIDKEETTCGFCAVGCRFEMWGKDGDSLGVVPVDDPDDAPANNFSTCVKGKFGHEFANSEQRVTEPLIRNDDGELEPTTWDEALEYVAERFTEIQDAHGIDSLGCLASSKGSNEEAYLVQKFARQVLGTKNIDNCARLCHSSTVAALQQTLGYGAMTNRINEDIGEADAYLISGSNTTESHPVLATRIKQNVRDGADLVVFDPRKVGIAEHADQYTRTNPGYDVAWLNGLIRYIIEHDLHDEAFIERNTKNFEEVREKVQAFTPEKVKELAGVSPEELASAAETLAEADTVVFGWAMGMTQQSHGTENLIAMADLALVLGQVGKPGAGLSPFRGQNNVQGGGGDMGTLPGSLPGYQNPADDEVGEKFADAWGERPPKEPGLKVPEMLAEAHAGNLRGMYVVGENPALSEPDIQHAAEALEDLEFLVVQDIFMTETAEYADVVLPAATSPEKHGTFTNTERRIQRVRPTSEPPGKARQDWEITQALARRLGYDWDYDHPREVMDEINSLAPIYGGVTYDRLESGEEHGLQWPCWDEDHDGTPYLYDYDEGNFNFEDGKARFVPADGGHPGEIPDEEFPLTLTSGRVLYHWHTGQITRRVEGLMSHVGESFVEVHPETAEKLGIADGEYVRVESRRGDIVVKAQVTDRVGPGTLFIPMHFAAGAVNKLTGETFDPTAGIPEYKVSSVRVEVLGPETDETVLRTPDAGGKQIRKRGTGDD

SEQ ID NO: 30679 - protein, 378 aa, Haloarcula marismortui ATCC 43049
MSEIELQNLSKSFGELDAVTDVSLSVRDGELLCLLGPSGCGKSTTMRMISGLETPSSGTVYIGDADVTDEPAYDRDTSMVFQNWALFPYKTVLENVAFGLKMRGMGKQQRRDRASEMLDRVHMDGYESHSPTDLSGGQKQRVALARSLAVDPDVLLLDEPLSNLDKRLREEMEIELKDIREEFQKTFVHVTHNQDEAFTLADRIGIMNDGRLVQVGEPNEVYRDPKNKFVEEFLGDTNFVSGTVSDSDGQYSYLVTEFDSEIRVPVTSKIQPEASLTVSLRPEFMQIAPLTDESTRASHQTRADGNGGGGGVSGTVESTIYRGSSIRHVVDIGGEQLFVEQSVTDQSAIDEGDTVELSWDIDDILLFRPDGTRVRDRQ

SEQ ID NO: 30680 - protein, 503 aa, Haloarcula marismortui ATCC 43049
MPDSETRTAMRERHLQAHEDALADIVIEPWIGGTSVSGSEPIPTRDPVIDEPITAVPVCDDELVNQAVQVAWDGFETWSDRTPTDRSQRLSEWVDVLEEHLDELALLECLDTGKPLSEARGEVEGALRTLEYYAAVARTQQGSQIPAQGDLHMYTRMEPYGVVGQITPWNFPAWAAAWKFGPALAAGNCSVLKPSAYTPLTTVRMAQLSDGIFPDGVINVVTGGGSTTGATLTEHEDVRKLSFTGSGSVGQEVMQTAAARIAPVTLELGGKSPLLVFPDADMQTAVDAAAAGVYYSTGEICDALSRAIVHEDVHDEFVDRLVARAESYTLGDPLDDETTLGPLTNEDQFETVSDYVTIGRNEGATLATGGTAPDDRALADGHYVEPAVFTDVEPDMRIAREEIFGPVQTVQSFETYDEAIALANDTEFGLAGGVATESTDIAHQAAADIDAGVVYINAYGPIRPEGPYGGFKESGIGHDLGRAAVEQYQQPKTVYVNLDSPEI

SEQ ID NO: 30681 - protein, 322 aa, Nocardioides sp. JS614
MNLPDLPRLPLVLAPTPLVPAPRLSEILGLDVWFKRDDLTGRGLGGNKVRPLEYLLGDAKTKGCDALVTGAGPQSNWAMLAALTAHGAGIAPHLVFYGDPQHPTGNLLLAQLAGADIHYTGELDRGSVDPALFKAADELTDAGHLPYVVPRGGATPIGCLGYVRATAELLAQLAETGLSPASIWLATGSGGTQAGLVAGAQWSGWEIDVIGITTSRSPEEAASRVRDLASATLDLIGVGDTSIAAPQVRGGYLGEGYGKASPAGAAAAQLVAQTEGVFLDPAFGAKAMAALIDAARDGTVEGPVVFLVTGGAPTLFTPGAQL

SEQ ID NO: 30682 - protein, 455 aa, Nocardioides sp. JS614
MRRRLVVVGGGAAGMSAASAARRVDRELEVVVLESGAHAAYGLCGLPYFLSDVVTEVDSLRAYPPTFFQEQRDINLRFGAEVVRIDPERQLVNFRSEGQSEHLHYDKLILTAGATPSLPPIPGLDDDHVFTIRNVAESVRLRCLLDAGHIGHATVVGGGYIGLEVVESFAERGVSVTLIEALPGLMANLDPEFSRRVEEEVRLHAEVRLSSGLVSLVRTDEGLTLSLADGDTIETDVVVVATGVRPASGLGSSIGANTGPHGALLVDEQMRTSVPNVFAAGDCIAPNHIVTGRPTFIPLGPAANKTGRVAGTVAAGGTACFSGVAGTAIVKVFGLGIGRTGLTLAEALSAGYDAQATDAVGRSRAKYFPGSAPIDVRLVHNSDGRLLGAQFVGVGDEVAKRVDVAAVALHAGLSVEDLADLDLSYAPPFAPVYEPILLAANSAVASLKPMEDLAH

SEQ ID NO: 30683 - protein, 103 aa, Escherichia coli
AKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGG

SEQ ID NO: 30684 - protein, 240 aa, Saccharomyces cerevisiae
PKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAV

SEQ ID NO: 30685 - protein, 303 aa, Pyrobaculum aerophilum
  misc_feature (1)..(1): Xaa can be any naturally occurring amino acid
  misc_feature (48)..(48): Xaa can be any naturally occurring amino acid
  misc_feature (108)..(108): Xaa can be any naturally occurring amino acid
  misc_feature (200)..(200): Xaa can be any naturally occurring amino acid
  misc_feature (274)..(274): Xaa can be any naturally occurring amino acid
  misc_feature (276)..(276): Xaa can be any naturally occurring amino acid
XELYVNFELPPEAEEELRKYFKIVRGGDLGNVEAALVSRITAEELAKXPRLKFIQVVTAGLDHLPWESIPPHVTVAGNAGSNADAVAEFALALLLAPYKRIIQYGEKXKRGDYGRDVEIPLIQGEKVAVLGLGEIGTRVGKILAALGAQVRGFSRTPKEGPWRFTNSLEEALREARAAVCALPLNKHTRGLVKYQHLALXAEDAVFVNVGRAEVLDRDGVLRILKERPQFIFASDVWWGRNDFAKDAEFFSLPNVVATPWVAGGYGNERVWRQXVXEAVRNLITYATGGRPRNIAKREDYIGS

SEQ ID NO: 30686 - protein, 232 aa, Flavobacterium columnare
MISRKVNNVQEALEGIQDGMTIMLGGFGLCGIPENSITELVNKEVKDLTCISNNAGVDDFGLGLLLQKRQIKKMISSYVGENAEFERQMLSGELEVELTPQGTLAEKCRAAQAGIPAFFTPAGYGTEVAEGKEVREFNGKMHILEHAFKADFSIVKAWKGDEAGNLIFKGTARNFNAPMAGAAKITIAEVEELVPAGTLDPNEIHIPGIMINRIFQGEKFEKRIEQRTVRQK

SEQ ID NO: 30687 - protein, 145 aa, Populus alba x Populus tremula
VLTDPAKGMKGAVQKAEEIVRRTPNAYMLQQFDNPANPKIHYETTGPEIWEDTRGKVDIFVAGIGTGGTISGVGQFLKEKNPKIKVIGIEPSESNILSGGKPGPHKIQGIGAGFVPRNLDRDVVDEVIEISSDEAVETAKQVALQ

SEQ ID NO: 30688 - protein, 386 aa, Serratia sp.
MDFNLSNSQSDIYESAYRFACDVLDQDAQTRISQKILSTELWKKAAAYGFAHGPVSHQFGGSELGALDTALMIEALGKGSRDIGLSFSLCAHLCACVIPLYRFGSSELKDKYLESLVTGKLIAANAATEPDAGSDIYNMQATAQPCEGGYILNGKKIFITNAPIADVFIIYAKTNPDHGFLGVSAFLIEKGTPGLNVGEVIPKDCLSNCPWSEIVFNDIFIPQSQRIGMEGAGGAIFHDSMIWEKGCLSALFVGGLARLLETTLEYAKARQQFGKAIGQFQSVSNRIIDMKLRLEQCRLMLYRACWKHDQGQDAEADIAMSKLLISEYAVQSGLDAIQTFGGAAMDQELGLVRHLLNMIPSRIFSGTNDIQKEIIARKLGLRGTSS

SEQ ID NO: 30689 - protein, 385 aa, Serratia marcescens
MDFNLSSEQQALSESAQRFAREVLDQDAHARLSRQVLSLDLWQQAAAYGFTRAPVTTAFGGLGMNALDTALMIEALGKGSRDIGMSFSLCAHLCACVIPLSRFGSEALKARYLEALAAGKLIAANAATEPDAGSDIYAMKSTAQPCEGGYRLNGNKIFITNAPIADIFIVYAKTHPEHGFMGVSAFVLEKGMPGLNVGAVSPKDCLSNCPWSELTFNDVFIPETQRIGMPGAGGAIFHDSMIWEKGCLSALFIGAMERVFDSALDYAKQRRQFGKAIGQFQSVSNRIIDMKLRLEQCRLMLYRACWKHDRGQDAEIDIAMSKLLISEYAVQSALDAIQIFGGAGMDQELGLVRHLLNVIPSRIFSGTNEIQKEIVARKLGLRGGA

SEQ ID NO: 30690 - protein, 408 aa, Stenotrophomonas maltophilia
MSKADVVIVGAGHGGAQCAIALRQNGFEGTITVIGREPEYPYERPPLSKEYFAREKTFDRLYIRPPTFWAEKNIEFKLGTEVTKVDPKAHELTLSNGESYGYGKLVWATGGDPRRLSCQGADLTGIHAVRTREDCDTLMAEVDAGTKNIVVIGGGYIGLEAAAVLSKMGLKVTLLEALPRVLARVAGEDLSTFYQKEHVDHGVDLRTEVMVDSLVGENGKVTGVQLAGGEVIPAEGVIVGIGIVPAVGPLIAAGAAGANGVDVDEYCRTSLPDIYAIGDCAAFACDYAGGNVMRVESVQNANDMGTCVAKAICGDEKPYKAFPWFWSNQYDLKLQTAGINLGFDKTVIRGNPEERSFSVVYLKDGRVVALDCVNMVKDYVQGRKLVEAGATPDLEALADAGKPLKELL

SEQ ID NO: 30691 - protein, 409 aa, Stenotrophomonas maltophilia
MQRADVVIVGAGHGGAQCAIALRQNGFEGTITVIGREPEYPYERPPLSKEYFAREKTFDRLYIRPPTFWAEKNIEFKLGTEVTKVDPKAHELTLSNGESYGYGKLVWATGGDPRRLSCQGADLTGIHAVRTREDCDTLMAEVDAGTKNIVVIGGGYIGLEAAAVLSKMGLKVTLLEALPRVLARVAGEDLSTFYQKEHVDHGVDLRTEVMVDSLVGENGKVTGVQLAGGEVIPAEGVIVGIGIVPAIGPLIAAGAAGANGVDVDEYCRTSLPDIYAIGDCAAFACDYAGGNVMRVESVQNANDMGTCVAKAICGDEKPYKAFPWFWSNQYDLKLQTAGINLGFDKTVIRGNPEERSFSVVYLKDGRVVALDCVNMVKDYVQGRKLVEAGATPDLEALADAGKPLKELQY

SEQ ID NO: 30692 - protein, 265 aa, Mycobacterium tuberculosis
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRGGVPRGAAALEHHHHHH

SEQ ID NO: 30693 - protein, 340 aa, Irpex lacteus
AAGSVPATNQLVDYVVNVGVGSPATTYSLLVDTGSSNTWLGADKSYVKTSTSSATSDKVSVTYGSGSFSGTEYTDTVTLGSLTIPKQSIGVASRDSGFDGVDGILGVGPVDLTVGTLSPHTSTSIPTVTDNLFSQGTIPTNLLAVSFEPTTSESSTNGELTFGATDSSKYTGSITYTPITSTSPASAYWGINQSIRYGSSTSILSSTAGIVDTGTTLTLIASDAFAKYKKATGAVADNNTGLLRLTTAQYANLQSLFFTIGGQTFELTANAQIWPRNLNTAIGGSASSVYLIVGDLGSDSGEGLDFINGLTFLERFYSVYDTTNKRLGLATTSFTTATSN

SEQ ID NO: 30694 - protein, 495 aa, Escherichia coli
SYYHHHHHHLESTSLYKKAGLMQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVVNILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 30695 - protein, 305 aa, Deinococcus radiodurans
MSGPAHLPYGGIPTFARAPLVQPDGDWQADVAALGVPFDIALGFRPGARFAPRALREASLRSVPPFTGLDGKTRLQGVTFADAGDVILPSLEPQLAHDRITEAARQVRGRCRVPVFLGGDHSVSYPLLRAFADVPDLHVVQLDAHLDFTDTRNDTKWSNSSPFRRACEALPNLVHITTVGLRGLRFDPEAVAAARARGHTIIPMDDVTADLAGVLAQLPRGQNVYFSVDVDGFDPAVIPGTSSPEPDGLTYAQGMKILAAAAANNTVVGLDLVELAPNLDPTGRSELLMARLVMETLCEVFDHVL

SEQ ID NO: 30696 - protein, 334 aa, Arabidopsis thaliana
  misc_feature (26)..(26): Xaa can be any naturally occurring amino acid
  misc_feature (51)..(51): Xaa can be any naturally occurring amino acid
  misc_feature (54)..(54): Xaa can be any naturally occurring amino acid
  misc_feature (109)..(109): Xaa can be any naturally occurring amino acid
  misc_feature (149)..(149): Xaa can be any naturally occurring amino acid
  misc_feature (155)..(155): Xaa can be any naturally occurring amino acid
  misc_feature (242)..(242): Xaa can be any naturally occurring amino acid
  misc_feature (278)..(278): Xaa can be any naturally occurring amino acid
SDAKETSATDLKRPREEDDNGGAATXETENGDQKKEPACFSTVIPGWFSEXSPXWPGEAHSLKVEKVLFQGKSDYQDVIVFQSATYGKVLVLDGVIQLTERDECAYQEXITHLPLCSIPNPKKVLVIGGGDGGVLREVARHASIEQIDXCEIDKXVVDVSKQFFPDVAIGYEDPRVNLVIGDGVAFLKNAAEGSYDAVIVDSSDPIGPAKELFEKPFFQSVARALRPGGVVCTQAESLWLHXDIIEDIVSNCREIFKGSVNYAWTSVPTYPSGVIGFXLCSTEGPDVDFKHPLNPIDESSSKSNGPLKFYNAEIHSAAFCLPSFAKKVIESKAN

SEQ ID NO: 30697 - protein, 509 aa, Cynara cardunculus
MGTAIKASVLALFLFFLLSPTAFSVSNGGLLRVGLKKRKVDQINQLSGHGVSMEAKARKDFGFGGALRDSGSDIIALKNYMDAQYYGEIGIGSPPQKFTVIFDTGSSNLWVPSAKCYFSVACLFHSKYKSSHSSTYKKNGTSAAIQYGTGSISGFVSQDSVKLGDLVVKEQDFIEATKEPGITFLAAKFDGILGLGFQEISVGKSVPLWYNMVNQGLVQEPVFSFWFNRNADEEEGGELVFGGVDPNHFKGKHTYVPVTEKGYWQFDMGDVLIEDKTTGFCSDGCAAIADSGTSLLAGPTAIITEINHAIGAKGVMSQQCKTLVSQYGKTMIEMLLSEAQPDKICSQMKLCTFDGARDASSIIESVVDENNGKSSSGVHDEMCTFCEMAVVWMQNQIKRNETEDNIINYVNELCDRLPSPMGESAVDCNSLSSMPNIAFTIGGKVFELCPEQYILKIGEGEAAQCISGFTAMDVAPPRGPLWILGDVFMGRYHTVFDYGKLRVGFAEAA

SEQ ID NO: 30698 - protein, 410 aa, Pseudomonas sp.
MATHVAIIGNGVAGFTTAQALRAEGFEGRISLIGNEPHLPYDRPSLSKAVLGGSLEHPPVLAEADWYGEARIDMLSGRSVTNLNVDARTISLDDGSTFAADAIVIATGSRARTLALPGSQLTGVVTLRTYDDVRPLCRGWTPATRLVIAGGGLIGCEVATTARKLGLAVTILESADELLVRVLGRRIGAWLRGLLTELGVRFELGTGVAGFSGDDRLEEVLASDGRRFAADNALVCIGAEPEDQLARQAGLSCDRGVIVDDHGATHAEGVFAVGDAASWPLRDGGRRSLETYMNAQRQAAAVAAAILGKHGSAPQVPVSWTEIAGHRMQMAGDIEGPGEFVLRGTLGDGAALLFRLRDGRIQAVVAVDAPRDFAMAPRLVEARAAIEPARLADFSNSMRDLVRAQQGDSA

SEQ ID NO: 30699 - protein, 46 aa, Lemna aequinoctialis
VTDIPATTGATFGHEIVCYESPRPTMGIHRFAFILYEQLGRQTVYA

SEQ ID NO: 30700 - protein, 46 aa, Perilla frutescens var. crispa
VTDIPATTGATFGQEIVCYESPRPSMGIHRFVFVLFRQLGRQTVYA

SEQ ID NO: 30701 - protein, 437 aa, Physcomitrella patens
MEPSGFLRGVTKLQLIRCAWISFSFVLLVFALTTSDNFTRKFPDIVARAAGKDTSRTDDTRSVPCVKEVDEAEGEHQSQMDFGSHSETVLGSRVDYTAWDTRVGCGNFKKKYSYGNRTSSTLRSLQNPTVDNCTILRKQHVSVLVKKWTWIPDTLNNLYSCDCGLTCLWTNSDVLLDRPDAHLYESATPPSRRRKGEPWRIYMDLEPGRNRAPSQDLFVSYHANDDLQVTYAGAAFHTIRNYYISPVKHDDVLVYWSSSRCVESRQRIASEVLGFLPHHSFGKCLNNVGGMDVILEMYPKCSSGSGAGNVWNQNLHCAMSHYKFVLAIENSQIESYATEKLYYALDAGAVPIYFGAPNVEDFVPPHSIIQGRNFATIQGLAEYVKKVAADPVLYAEYHAWRRCGVLGVYGRTRAVSLDSLPCRLCAAVSSRGGRNSV

SEQ ID NO: 30702 - protein, 214 aa, Oryza sativa (japonica cultivar-group)
MSGATKFIKCVTVGDGAVGKTCMLICYTSNKFPTDYIPTVFDNFSANVSVDGNIVNLGLWDTAGQEDYSRLRPLSYRGADIFVLAFSLISRASYENVLKKWMPELRRFAPNVPIVLVGTKLDLRDHRSYLADHPAASAITTAQGEELRKQIGAAAYIECSSKTQQNIKAVFDTAIKVVLQPPRRRGETTMARKKTRRSTGCSLKNLMCGSACVV

SEQ ID NO: 30703 - protein, 338 aa, Variovorax paradoxus
MNLKKFPRHVLTFGPTPIQPLKRLSAHLGGKVDLYAKREDCNSGLAFGGNKTRKLEYLIPEALEGGYDTLVSIGGIQSNQTRQVAAVAAHLGLKCVLVQENWVNYSDAVYDRVGNIEMSRIMGADVRLDAAGFDIGIRQSWEQAMADVRAAGGKPFPIPAGCSEHPRGGLGSVGFAEEVRQQEAELGFKFDYLVVCSVTGSTQAGMVVGFAADGRADRVIGIDASAKPQQTFEQILRIAKNTAELVELGRDITEKDVVLDRRFGGPEYGLPNEGTLEAIRLSARFEGMLTDPVYEGKSMHGMIEKVRLGEFPAGSKVLYAHLGGVPALNAYSFLFRNG

SEQ ID NO: 30704 - protein, 274 aa, Oryza sativa (japonica cultivar-group)
MAGGGGEYLRQFVEETAWYNEIFLSHVVPGDWWRALPHPLQSWLRNGLGGYLIYFACGFLWCFVIYYWKRHAYIPKDSIPTIEAMKKQIIVASKAMPLYCALPTLSEYMVENGWTQCYVNISEVGWPMYLVYLALYLIFVEFGIYWMHRELHDIKPLYKYLHTYHHIYNKENTLSPFAGLAFHPLDGILQAIPHVFALYLIPTHFRTHIALLFIEAVWTTNIHDCIHGKVWPVMGAGYHTIHHTTYRHNYGHYTVWMDWMFGTLREPEDILKKD

SEQ ID NO: 30705 - protein, 324 aa, Oryza sativa (japonica cultivar-group)
MPRYDDRDRYDDRYGGNTRLYVGRLSSRTRTRDLEDLFGRYGRVRYVDMKHEFAFVEFSDARDADEARYNLDGRDFDGSRMIVEFAKGVPRGPGGSREYMGRGPPPGSGRCFNCGIDGHWARDCKAGDWKNRCYRCGDRGHIERDCRNSPKNLKRGRSYSRSPSPRRGRSRGRSYSRSRSRSYSRSQSPRRDSRNERRSRSPRDSRSPRGSPRDSRSPRGSPRDSRSPKGSPRDTQSPRGSPRDSRSPRRSASPPNGRNRSPTPNASRSPAPRDSRSPMRADSRSPADHERRDMSTAANGRSPSPRDYEDNGNHRASPRGSASP

SEQ ID NO: 30706 - protein, 244 aa, Oryza sativa (japonica cultivar-group)
MGASPSREEAHSNSSFSGNGKAMAVASSASSSGSNQAQSKRAPALHMFQEIVAEKDFTASSLEDQIYTGIFLAGKTKKYWVDERTRNNCFMLFPRGLSITWSEDPRFWTWKPLKEGSSDADTDTQIEVPSLQNVCWLEIHGKLERSYLTPGVTYEVLFEVMLIDPAYGWSVPVNLQLKFPDGTVQQRKENLEEKIRMKWLELKVGEVKTQQGQKGEIEISMFEYDGGLWKRGLLIKGIKILPKQ

SEQ ID NO: 30707 - protein, 307 aa, Oryza sativa (japonica cultivar-group)
MKASSSSQGQSPRTPSPRATSATAEHTRSSSEPWLVAAAVASTCDDSCVNDVENFARTVAAAKSRQLVGSSAASRPDMLASVLSHYAAKWLPDVVAASSSSSSPATSASGRFLPPESPTATWLKKRLLLESLVAALPPDPPAPAGGGGAADDGITCDFLLKLLRAGSMVGADAALLQELESRAARRLDQATLGAVMIPAFGHGYACGTLLDVPLVLRLVRGFLKDAGAGGGGAAKAGGGGGAAAARVARLVDAYLAEAALEAGLRPAEFEELARAVPAHARPADDALYRAVDTYLKVTHTYSSFHLH

SEQ ID NO: 30708 - protein, 288 aa, Oryza sativa (japonica cultivar-group)
MAGGEDISFLFGDDEAAAVAAPVELQGKRGWEEVDQGEGSGAVAAKRQRSPTSSRENSSGSNEGGQEEVSEAAAAMAAAVGRGGGRRLWVKERDSEWWDMVSSPDYPDSEFRKAFRMSKATFEVVCDELAAAVAKEDTMLRAAIPVRKRVAVCVWRLATGEPLRLVSKRFGLGISTCHKLVLEVCAALKAMVMPKVVRWPEAGDAAAIAAHFEAISGISGVVGAIYTTHIPIIAPKSNVASYYNRRRAGPRRHRPQPPPQRRRRILLLIKHHRRSWSDQQRYQTNQQK

SEQ ID NO: 30709 - protein, 439 aa, Oryza sativa (japonica cultivar-group)
MAGGEDISFLFGDDEAAAVAAPVELQGKRGWEEVDQGEGSGAVAAKRQRSPTSSRENSSGSNEGGQEEVSEAAAAMAAAVGRGGGRRLWVKERDSEWWDMVSSPDYPDSEFRKAFRMSKATFEVVCDELAAAVAKEDTMLRAAIPVRKRVAVCVWRLATGEPLRLVSKRFGLGISTCHKLVLEVCAALKAMVMPKVVRWPEAGDAAAIAAHFEAISGISGVVGAIYTTHIPIIAPKSNVASYYNRRHTERNQKTSYSMTVQCVVDSTGAFTDVCIGWPGSNSDEEVLEKSALYLHRGVPGLIQGQWVVGGGSFPLMDWMLVPYTHQNLTWAQHMLNEKVAAVRGVARDAFERLKRRWGCLQKRTEVKLLDLPTVLGACCVLHNICERSGDAVVDADDCAFDLFDDDMVAENAVRSSAAAQARDAIAHNLLHSGGGASFF

SEQ ID NO: 30710 - protein, 129 aa, Oryza sativa (japonica cultivar-group)
MPSAAAVAGYVVLSVMSTIVVPRLYTELKCHHVAVACIVALVLAFCNTYVTSVIDVNIATTFGKVVVLAFGSWVGLKDSGVVTGLAAYGVIVATVSTGSDLTQAFRTGYLTLTSLRATFLSQAAGMALG

SEQ ID NO: 30711 - protein, 457 aa, Oryza sativa (japonica cultivar-group)
MAAAVRDGAAVAGYMAEDDPDGAASEDGDMDVEVGGEESQARDGDRRDGGDGDDEYALLTRITDTSAAEARAGKDIQGIPWERLQITRSDYRKARLVQYKNYENFPQSGELMDKICKQVDKISKYYEFHYNTRLVKPSILHFQLRNLLWATSKHDVYFMSNSTVGHWSSLSHNLSEVLDFSGHVAPAQKHPGSLLEGFSGVQVSTLSVNEGLLVAGGFQGELICKVVGDRDVKFCTRTTLSDNAITNAIDIHRSASGSLRVTVSNNDCGVREFDMETFQLLNHFSYNWPVNHTSVSPDRKLLAVVGDDRDALLVDSRNGKVTSTLVGHLDYSFASAWHPDGRTFATGNQDKTCRVWDVRNLSTSLSVLRGNIGAIRCIRYSSDGQFMLFSEPADFVHVYSAAADYKKRQEIDFFGEISGISLSPDDESLFVGVCDRVYASLLHYRMVHSFGYLDSFM

SEQ ID NO: 30712 - protein, 241 aa, Oryza sativa (japonica cultivar-group)
MASTTTTTAAAAARFTCLAPATRPASASASAGRFLLPARQWGAATTHGSAAVPVVAAPSRRWAPGVAYATAATGKSVHDFTVKVVAFRALDIDGKDVALSKFKGRALLIVNVASQCGLTTANYTELSHLYEKYKTQGFEILAFPCNQFGAQEPGSNPQIKQFACTRFKAEFPIFDKVDVNGPNTAPIYKFLKSSAGGFLGDLVKWNFEKFLVDKTGKVVERYPPTTSPFQIEKDIQKLLAA

SEQ ID NO: 30713 - protein, 226 aa, Oryza sativa (japonica cultivar-group)
MLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVRDRIYGYPT

SEQ ID NO: 30714 - protein, 406 aa, Oryza sativa (japonica cultivar-group)
MLVKAGAPVDQTIATLAAHLEQGDCIIDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLISEAYDVLKSVGKLTNSELQQVFSEWNKGELLSFLIEITADIFSIKDDQGSGHLVDKVLDKTGMKGTGKWTVQQAAELSVAAPTIEASLDSRFLSGLKDERVEAAKVFQGDFSSNLPVDKAQLIEDVRQALYASKICSYAQGMNIIKAKSMEKGWSLNLGELARIWKGGCIIRAIFLDRIKKAYDRNSDLANLLVDPEFAQEIMDRQAAWRRVVCLAINNGVSTPGMSASLAYFDSYRRDRLPANLVQAQRDYFGAHTYERVDMPGSFHTEWFKIARAAKM

SEQ ID NO: 30715 - protein, 165 aa, Oryza sativa (japonica cultivar-group)
MAAAAAAAARRLLSRRAPTEMAPLFPGCDYEHWLIVMDKPGGEGATKQQMIDCYIQTLAKVLGSEEEAKKKIYNVSCERYFGFGCEIDEETSNKLEGLPGVLFVLPDSYVDPEYKDYGAELFVNGEIVQRSPERQRRVEPVPQRASDRPRYNDRTRYARRRENQR

SEQ ID NO: 30716 - protein, 1375 aa, Saccharomyces cerevisiae
MDSSPNKKTYRYPRRSLSLHARDRVSEARKLEELNLNDGLVAAGLQLVGVALEKQGTGSHIYMKQKNFSANDVSSSPMVSEEVNGSEMDFNPKCMPQDASLVERMFDELLKDGTFFWGAAYKNLQNISLRRKWLLICKIRSSNHWGKKKVTSSTTYSTHLATNELAENAHFLDGLVRNLSTGGMKLSKALYKLEKFLRKQSFLQLFLKDEIYLTTLIEKTLPLISKELQFVYLRCFKILMNNPLARIRALHSEPLIRWFTELLTDQNSNLKCQLLSMELLLLLTYVEGSTGCELIWDQLSILFTDWLEWFDKILADDIAIHSSLYLNWNQLKIDYSTTFLLLINSILQGFNNKTALEILNFLKKNNIHNTITFLELAYKDDPNSVVIMEQIKQFKSKESAIFDSMIKTTNDTNSLHPTKDIARIESEPLCLENCLLLKAKDSPVEAPINEIIQSLWKILDSQKPYSESIKLLKLINSLLFYLIDSFQVSTNPSFDETLESAENVDYVFQDSVNKLLDSLQSDEIARRAVTEIDDLNAKISHLNEKLNLVENHDKDHLIAKLDESESLISLKTKEIENLKLQLKATKKRLDQITTHQRLYDQPPSLASSNLSIAGSIIKNNSHGNIIFQNLAKKQQQQQKISLPKRSTSLLKSKRVTSLSSYLTDANNENESQNESEDKSKDSLFQRSTSTINFNIPSMKNITNMQNVSLNSILSELEFSNSLGTQPNYQSSPVLSSVSSSPKLFPRLSSDSLDNGIQLVPEVVKLPQLPPPPPPPPPPPLPQSLLTEAEAKPDGVSCIAAPAPPPLPDLFKTKTCGAVPPPPPPPPLPESLSMNKGPSNHDLVTPPAPPLPNGLLSSSSVSINPTTTDLKPPPTEKRLKQIHWDKVEDIKDTLWEDTFQRQETIKELQTDGIFSQIEDIFKMKSPTKIANKRNAESSIALSSNNGKSSNELKKISFLSRDLAQQFGINLHMFSQLSDMEFVMKVLNCDNDIVQNVNILKFFCKEELVNIPKSMLNKYEPYSQGKDGKAVSDLQRADRIFLELCINLRFYWNARSKSLLTLSTYERDYYDLIFKLQKIDDAISHLNRSPKFKSLMFIITEIGNHMNKRIVKGIKLKSLTKLAFVRSSIDQNVSFLHFIEKVIRIKYPDIYGFVDDLKNIEDLGKISLEHVESECHEFHKKIEDLVTQFQVGKLSKEENLDPRDQIIKKVKFKINRAKTKSELLIGQCKLTLIDLNKLMKYYGEDPKDKESKNEFFQPFIEFLAMFKKCAKENIEKEEMERVYEQRKSLLDMRTSSNKKSNGSDENDGEKVNRDAVDLLISKLREVKKDPEPLRRRKSTKLNEIAINVHEGDVKTRKDEDHVLLERTHAMLNDIQNI

SEQ ID NO: 30717 - protein, 393 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHMRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVLKKFPVVQHFWFGTGFFPWVNIQNGTDLPVFEEKEEESIEQANAGSPGREQTSTRFPTSTSMPPPGVPPSGNNINYLLSHQNQSHRNQTSFSRDRLRR

SEQ ID NO: 30718 - protein, 163 aa, Saccharomyces cerevisiae
MSEFYKLAPVDKKGQPFPFDQLKGKVVLIVNVASKCGFTPQYKELEALYKRYKDEGFTIIGFPCNQFGHQEPGSDEEIAQFCQLNYGVTFPIMKKIDVNGGNEDPVYKFLKSQKSGMLGLRGIKWNFEKFLVDKKGKVYERYSSLTKPSSLSETIEELLKEVE

SEQ ID NO: 30719 - protein, 432 aa, Saccharomyces cerevisiae
MVVDTEYYDLLGVSTTASSIEIKKAYRKKSIQEHPDKNPNDPTATERFQAISEAYQVLGDDDLRAKYDKYGRKEAIPQGGFEDAAEQFSVIFGGDAFASYIGELMLLKNLQKTEELNAEDEAEKEKENVETMEESPADGKTNGTTNAVDAALGNTNEKDDKNKARTTSGNLTVHDGNKKNEQVGAEAKKKKTKLEQFEEEQEVEKQKRVDQLSKTLIERLSILTESVYDDACKDSFKKKFEEEANLLKMESFGLDILHTIGDVYYEKAEIFLASQNLFGMGGIFHSMKAKGGVFMDTLRTVSAAIDAQNTMKELEKMKEASTNNEPLFDKDGNEQIKPTTEELAQQEQLLMGKVLSAAWHGSKYEITSTLRGVCKKVLEDDSVSKKTLIRRAEAMKLLGEVFKKTFRTKVEQEEAQIFEELVAEATKKKRHT

SEQ ID NO: 30720 - protein, 475 aa, Grimmia pulvinata
  misc_feature (252)..(252): Xaa can be any naturally occurring amino acid
MSPQTETKAGVGFKAGVKDYRLTYYTPDYQTKETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTCEEMLXRAQFARELGAPIVMHDYLTGGFTANTTLAHYCRDNGLLPHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLASEGNEVIREATKWSPELAAACEVWKEIKFEFETIDTV

SEQ ID NO: 30721 - protein, 475 aa, Venturiella sinensis
MSPQTETKAGVGFKAGVKDYRLTYYTPDYETKETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTCEEMLKRAQCARELGMPIVMHDYLTGGFTANTTLAHYCRDNGLLLHIHRAMHAVIDRQKIHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPELAAACEVWKEIKFEFETIDTV

SEQ ID NO: 30722 - protein, 475 aa, Dozya japonica
MSPQTETKAGAGFKAGVKDYRLTYYTPNYQTTETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQCARELGMPIVMHDYLTGGFTANTSLAHYCRDNGLLLHIHRAMHAVIDRQKNHGMHFRVLAKALRLSGGDHIHAGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNDVIREATKWSPELAAACEVWKEIKFEFDTIDTL

SEQ ID NO: 30723 - protein, 499 aa, Sphingomonas sp.
MATQLKSGTNEYGIKSEYGHFIGGEWISSDSGKTIDLINPATGAVLTKIQAGNAKDIQRAVAAAKAAFPKWADSSAAERQEILIEVARRLKARHQHYATLETLNNGKPIRESMHFDMPQAIGQFELFAGAAYGLHGQTMDYPDAVGIVHREPLGVCAQIIPWNVPMLMMACKIAPALASGNTVVLKPAETVCLSVIEFFVEMADLLPPGVINVVTGYGADVGEALVTHEDVRKVAFTGSVGTARRIMQYASTNIIPQTLELGGKSAHIVCADADIDAAVESATMSTVLNKGEVCLAGSRLFLHESIQDEFLAKFKVALEGIRQGDPLDFATQLGAQASQMQMDKVISYLELATEEGANVLTGGSANDKLADGNFIRPTVFTNVNNSMRIAREEIFGPVTSVISWKDEDDMMKVANDTNYGLAGGIWTRDIARAHRMARKLETGTVWINRYYNLKANMPLGGYKQSGFGREFSHEVLNHYTQTKSVVVNLQEGRTGMFDQ

SEQ ID NO: 30724 - protein, 409 aa, Sphingomonas sp.
MRSVAIVGANLAGGRAAEALRQVGFDGRITLIGEEPWRPYERPPLSKEFLWNPAEMSDNFFLQDENWYSDNRIDMLLSTRAEAIDLNAGGVRLSGGQLVAADKVLLATGGHARKLNLAGADCVNVHYLRTRDDAARMALDLRQGARVVIVGMGVIGAEVAASAIKLGCEVTAVEPLAGPMERALGKRFGQWLGEEHRKRGVKTHFNRGVTGFKFADGRVSAVEIDDGTVIPCDAVVVGVGIIPATSLAVDAGLTVNNGIVVDRRCQTSNKAIFAAGDVAEQDGFFGGRFRQETYQNASDQAQAAASAMLGHEVDYCKPMWYWSDQFDLNIQFCGQIPAQAEVVLRGDIESNAFVALFLSGNTIDGLLTVNRAPDMGIGKRLVERRTKASADRLADADVSLRELLMQSAR

SEQ ID NO: 30725 - protein, 486 aa, Streptomyces coelicolor A3(2)
MSGRTPAADRSLETGVAHMHGGRDVANDASTVFDLVILGGGSGGYAAALRGAQLGLDVALIEKNKLGGTCLHNGCIPTKALLHAGEVADQSRESEQFGVKTSFEGVDMAGVHKYKDEVIAGLYKGLQGLVASRKITYIEGEGRLSSPTSVDVNGQRVQGRHVLLATGSVPKTLPGLEIDGNRIISSDHALTLDRVPKSAIVLGGGVIGVEFASAWKSFGSEVTVIEGLKHLVPVEDENSSKLLERAFRKRGIKFNLGTFFQKAEYTQDGVKVTLADGKEFEAEVLLVAIGRGPVSQGLGYEENGVATDRGFVLVDEYMRTNVPTISAVGDLVPTLQLAHVGFAEGILVAERLAGLKTVPVDYDGVPRVTYCHPEVASVGLTEARAKEVYGADKVVSIKFPLGGNGKSRILKTAGEIKLVQVKDGAVVGVHMVGDRMGEQVGEAQLIYNWEALPAEVAQLIHAHPTQNEALGEAHLALAGKPLHMHD

SEQ ID NO: 30726 - protein, 230 aa, Streptococcus pneumoniae
MVKLVFARHGESEWNKANLFTGWADVDLSEKGTQQAIDAGKLIKEAGIKFDQAYTSVLKRAIKTTNLALEASDQLWVPVEKSWRLNERHYGGLTGKNKAEAAEQFGDEQVHIWRRSYDVLPPNMDRDDEHSAHTDRRYASLDDSVIPDAENLKVTLERALPFWEDKIAPALKDGKNVFVGAHGNSIRALVKHIKGLSDDEIMDVEIPNFPPLVFEFDEKLNVVSEYYLGK

SEQ ID NO: 30727 - protein, 378 aa, Schizosaccharomyces pombe
MSFEGKTITCKAAVAWGAKEPLSIEDIQVAPPKAHEVRVKVDWSAVCHTDAYTLSGVDPEGAFPIVLGHEGAGIVESIGEGVINVRPGDHVILLYTPECKECKFCRSGKTNLCSKIRETQGRGLMPDGTSRFSCRDKTLLHYMGCSSFSQYTVVADISLVAISHSAPLRSICLLGCGVTTGFGAVTHSAKVESGSTVAVVGCGCVGLAAMQGAVAAGASRIIAIDINADKEVYAKKFGATDFIDSSKVKDLVQYVIDVTDGGVDYAFDCTGNVTVMQQELQFCHKGWGKLCVIGVAAAGKTLDFRPFLVVTGRQVLGSAFGGVKGRSELPNFVDEYMQGHFKVDEYITNEEPLKNINKAFDHMHEGKCIRCVVDMNKP

SEQ ID NO: 30728 - protein, 115 aa, Prototheca wickerhamii
LDRDVTEAQLYEIFAQIGPVASIRVCRDAVTRRSLGYAYVNYNSGVDAGAAERALEQLNYVPLGRTPHAADVEPPRPSYRKSGVGNIFIKNLGRLPLTTRPWFDTFSTFGNILSC

SEQ ID NO: 30729 - protein, 187 aa, Prototheca wickerhamii
EAVQIILKLAAGNGLQKVVVGRNGITATPAMSAIIRRRGLYGGLIMSASHNPAGPNEDWGIKFNYSSGEPAPEKITDKIYGFTQSIKELQVADIPDVDLSVLGTTTFGDFEVEVIDYTVDYFNQLKEVFDFEALRTLLASPDFSFVYDALHAVTGAYAEPLFVDELGASPDSLKNCVPLEDFGGGHP

SEQ ID NO: 30730 - protein, 209 aa, Prototheca wickerhamii
HGTHAGLRVRPSPSAGRRVATAAGTGTFFVGGNWKANGSTAVVEKLVQELNAGILPKDVEVVVAPSFLYLDQVQGSLKSSYQVAAQNCWKGKSGAFTGEVTAEMLADKQIPWVILGHSERRALMGDTDEVVGEKVAYALSKGVKVIACIGETLEERESGRMFDVLDTQAKAIAEDVTDWSSVVLAYEPVWAIGTGKWPPPSKPRSARLA

SEQ ID NO: 30731 - protein, 231 aa, Prototheca wickerhamii
KRPGNVGSHFASQVLGTSGTCMGGRAATAPFRTVTVRRASRGMRASTLVRAAIGTNGRPTVLVAEKLGAGGVDMLKEVADVRTVLNMSKEQLLENISSVDAIVIRSATKVTREVIEASKGRLRVVGRAGVGIDNVDLTAASESGCLVVNAPTANTIAAAEHGISLLTALARNVAQADASMKAGGWDRTTYVGVSVVGKTLAIIGFGKVGGEVARRAKGLGMTVIAFDPYAS

SEQ ID NO: 30732 - protein, 507 aa, Prototheca wickerhamii
ADPPSGKPTHHLSTGDLPARTPMAPCLATVVPTSVGTLQGARALPKGAFGPRPSALATRQAQRAPRNPAGPAPRSLSHRTAAVAPGTAQAPNSSMASPTAQSEVGLIGLAVMGQVNPGSEAASRVHQGAGNPWMQLWGGPALRKRLCSDRVYRDVMSDSGRDPHAFPQNLALNVAEKGFHISVYNRSGEKTDAAVSRAVKEGVGERLHGVQGAKDFVLSLKRPRRIIILVKAGAPVDSTSKQLTEFVVEPRDIIIDGGNEWYENTERRQAELATKGSHHIGMGVSGGEEGARNGPAMMPGGDKGAYSHLRPVVEKVAAQTDDGACVTYIGPGGAGNYVKMVHNGIEYGDMQLIAEAYDVLKTVGGLTNAELASVFSEWNGGELESFLIMITAIIFAVKDEGGEGELVDKILDKTGMKGTGKWTIQEAAELSVAAPTMAAALDARFVSGLKDQRVAAEAVYAGLGLGPPTPPPASYKAALVADVRDALYAAQDLSYAQGVQHHPCQVG

SEQ ID NO: 30733 - protein, 149 aa, Prototheca wickerhamii
RKAVATGTSRGLAANPSSSNPAPFPVGMSTILRSTLTAANAEAGPSSMLQMSTGFRPISRVAYQGAPGAYSEMAALKALPNWEPMPCEQFEVAFQALSQWLAERAVLPVENSLGGSIHDVYDLLLHYRLHIVGEVSVVVNHCLLALPGV

SEQ ID NO: 30734 - protein, 242 aa, Prototheca wickerhamii
GGICRSGPSHESHPAKEAVVTMGGSHSKKSGATTDPLVTVLENKPSRSQATPPADTAPPPAKKNIVSSNITQVIGNTPLVRLNHLAETEGAKATILLKMESLEPNSSVKDRIGLAMIEDAEQSGKITPGKTTLVEPTSGNTGIALAFVAAARGYKLVLTMPATMSLERRIVLRAFGAQLVLTDPAKGMKGALLKAEEIAAATPDSYILQQFENPANPAIHYTTTGPEIWNDAGGDVDVFIAG

SEQ ID NO: 30735 - protein, 197 aa, Prototheca wickerhamii
PKMGISATVIDPADLAGLEAALEAHPVALFFSESPTNPYLRCVDIPRIKALCEPRGAAVVIDSTFATPINQRALALGADLVLHSATKYLSGHNDVLAGAIAGRSDLVASVRAMHNVLGGVMDPHAAYLLLRGMKTLDLRVGRANATAQLLAERLSEHPRVARVHYPGLPSHPDHHIALRQMDGYGGVVSFEVAGDLW

SEQ ID NO: 30736 - protein, 393 aa, Prototheca wickerhamii
CHMTGVAAQVVASPSRCLFASSQRTSKTASTSRCPSSRRWASLTTPSAMSQTSPAAAAPTKVPKGDKGQVLVSVSDKAELIPFVQGLVELGYDIISTGGSATSLDAAGVPVERVENVTGFPEMLDGRVKTLHPAVHGGILARRELPSHMAALAEHDIDLINIVVVNLYPFRQTVTAAVKPAYEVAVENIDIGGPSMIRAAAKNHAHVLVVVDPADYAMVLERLRAGTADAALRRQLAWKAFQHTATYDATVAEWLWGEVGTGPAPERCVPMQLCSTLRYGENPHQAAAFYTDLSLGEAGRGGVATAVQHHGKELSYNNYLDADAAYGAVCDIAAPACAIVKHTNPCGVAARDDLREAYRLAVRADPTSAFGGIVAFNREVDADLARELREFRS

SEQ ID NO: 30737 - protein, 259 aa, Prototheca wickerhamii
EFEIRMSTMASPCSSLRPTRLLGPSGSQLAYWPDHTPDCMHRDPPPSRSNGKTDSSRPRASTSTPALPGYAKGVSLSSSNAKMMAEDPASEASSLDIPTRKTKTVCTIGPTSCDREAFFRLADAGMNVVRLNMSHGDHASHQQVIDLVREYNALGRRNLAIMLDTKGPEVRSGDLTQPLDLEKGDLITFTIVAGADGTNNRIGVNYDGFIDDVEVGDMLLVDGGIMTMLVKSKSDTEVLVEVLGLGHEISRHLTFGEVR

SEQ ID NO: 30738 - protein, 465 aa, Bischofia javanica
  misc_feature (121)..(121): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALXALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 30739 - protein, 465 aa, Heywoodia lucens
VGFKAGVKEYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 30740 - protein, 465 aa, Pseudolachnostylis maprouneifolia
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHGGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 30741 - protein, 307 aa, Porphyra yezoensis
MAFITSGAAAVSGASLTARRAFTGAAVCPVPSGRTSPAAATWSMSAGGLRTFLVGGNWKCNLSKDAITSLCKELAAAPDLETDKVEVVLAPPTPYLDHTRSVLRQDFEVAAQNIWVGGPGAYTGETAAEMIKDVGCTWVILGHSERRNLLQIRESDDFIAQKTKTALSHGLKVMFCIGETLEEREEGRTLDVCVRQLHALAETIGADDWKDVVIAYEPVWAIGTGKIATPDQVEEVHEKIRHYLAGDVNDKVAQETRILYGGSVSPGNCNELAQLPDVDGFLVGGASLKASFLEVIESFKSDLAATV

SEQ ID NO: 30742 - protein, 282 aa, Chlamydomonas reinhardtii
MQLCKVQRASAARSSRASRSQRVEVVCASSAKFFVGGNWKCNGSVANVAKLVDELNAGTIPRGVDVVVAPPFIYIDYVMQHLDRDKYQLSAQNAWIGGNGAFTGEVSAEQLTDFGVPWVILGHSERRSLFGESNEVVAKKTSHALAAGLGVIACIGETLEQRNSGSVFKVLDAQMDALVDEVKDWTKVVLAYEPVWAIGTGVVASPEQAQEVHAYLRQYCAKKLGAAVADKLRIIYGGSVSDTNCKDLSKQEDIDGFLVGGASLKGAAFVTICNAAGPKAKP

SEQ ID NO: 30743 - protein, 255 aa, Euglena longa
MPRKFFVGGNWKRNGTRDTISKIVEEFNKGPSVADADVEVVIGVPFVYADFTQEKLRKDWKLSVQNCWIGKGGAFTGEVSAEMIKDAGIPWVILGHSERRHLPELKESDETVAIKVAYALANGLKVMACIGELLEEREKGQTQAVNERQLKAIAAKLKEEDWKNVVIAYEPVWAIGTGKVATPEQAQEVHEQVRAWVASNVSPSVAAEVRILYGGSVTAKNSVELAGKPDVDGFLVGGASLKPEFLDIVAAYKHK

SEQ ID NO: 30744 - protein, 356 aa, Euglena longa
MGYYTVTTQVQENYVQSWYKGKLAPFVGGCLLATCLSLSFSGETAQQNYAVSAKPAVHAIPLTAMGVGTRSGVPQTAAQKRFPSRSSALQMAAAVWAPSAKMPRKFIVGGNWKCNGDRPSINALVQALNTGESAIGSGVEVVVAPPMLYGDYARGLLRPDFGVAFQNCWTGGNGAFTGEVSANMIKDAGFDWVILGHSERRSLPEIMETDATVATKTAYALKAGLKVILCIGETLDARQSGKTDEVNARQLAAVAEKVSDWSNIVIAYEPVWAIGTGVVATPEQAQETHAQIRKWLAENLSPQVAQQMRIMYGGSANAANADSLAKQPDVDGFLVGGASLKPEFLKIAESWKSKVE

SEQ ID NO: 30745 - protein, 200 aa, Prototheca wickerhamii
YYALSFVRTADVIYELKDWLARQGATGTSAIGVLAKIESADSVANLEAILDAVDGAMVARGDLGAELPVEEVPYWQSKIVKGCRKRGKPVIVATNMLESMIKCPTPTRAEVSDIAIAVREGADAVMLSGETAHGSFPFKALDVMTTVAKRTELSMLRYEGARRYGSEESDAIDWILPPARRMNSLADVGISEMFAYHAVT

SEQ ID NO: 30746 - protein, 441 aa, Streptomyces netropsis
MSHSVTLPSTKDIIELERRHRLPGGQSMTDLAGIVVDRAVNAEVWDRDGKRYIDFFTGVGVSNIGHSHPAFLEELTTQLSRCAVGTFYTDVRSRYFALLAAQLPEQLGEIHMFSTGSEAVEAAVKLARAATGKHEIVSFWGGFHGKTQGALSLHGGPRKHRSGPFPPGSHQVPYADCHHCPLQLEHPECGQRCVDLAEQSIENGSVGDLAAVIVEPVQGTNGNIIPPEGYLRTLRQLADRHGALLILDEVITGFGRTGALFAFEHDPGIAPDVVVLGKAMASGVPASAIVSRSGLVEGTSFAVPSAAASTFGGNPLASAASLATLRVLLDERLPERSHELGKSVSDRLSAWREEFPFVGNADNIGLMIGVELVDPATRLPLPKGITRRLFQELMARGVLAMAYDSRIRLYPPLSIPTHHLEEGLAAFEGAFRAMAPAISRL

SEQ ID NO: 30747 - protein, 174 aa, Borrelia hermsii
MDEEISTLFTEEKIKSKIKELAQKIRNYYKDKSNVVFISLLKGSFMFFADITREMGLNVKIDFLQVSSYKNKTHSSLNVLIKKDIDIDIKDSYVIIFDDIIDTGLTYDKIITYLKTKNPKEIKICTLFNKPSRRLIELKIDYAGFEIENDFIVGYGIDFNEKHRTLKDVAKINK

SEQ ID NO: 30748 - protein, 226 aa, Hordeum vulgare
MATSKKVVTRDEWEGRLRDAKIRKEDMNRLVMNFLVTEGLVDAAHRFRLESGTQPEIDLATITDRMEVKKAVQSGNIQEAVERINDLNPTILDTNPELYFHLQQQKLIELIRAGKIPEALEFAQEELAPRGEENEAFLEEIEKTVALLVFEDVKNCPYGELLDVSQRLKTASEVNAAILTSQSHEKDPKLPSLLKMLIWTQNQLSEKAAYPRINNLSTADLEDPAI

SEQ ID NO: 30749 - protein, 317 aa, Eucalyptus botryoides
MGSLEKERTTTGWAARDPSGVLSPYTYSLRHEVVGEVLEVGSEVTKYRVGDRVGTGIVVGCCRSCGPCNSDQEQYCNKKIWNYNDVYTDGKPTQGGFAGEIVVGQRFVVKIPDGLESEQDAVMCAGVTVYSPLVRFGLKQSGLRGGILGLGGVGHMGVKIAKAMGHHVTVISSSDKKRTEALEHLGADAYLVSSDENGMKEATDSLDYIFDTIPVVHPLEPYLALLKLDGKLILTGVINAPLQFISPMVMLGRKSITGSFIGSMKETEEMLEFCKEKGLTSQIEVIKMDYVNTALERLEKNDVRYRFVVDVAGSKLD

SEQ ID NO: 30750 - protein, 287 aa, Phaseolus vulgaris
MAATAAGIASLFSSSINSVKCLRSKHCSMMDPLMTAMLSNRIFAPVSHLVVEPLSIGGTTSHRLWGPRISAAVAQEEVVVVDDAGLVEEEKVEENEGEEVVAEQDSDESFASTKLYFGNLPYSVDSAKLAGLIQDYGSAELIEVLYDRDTGKSRGFAFVTMSCIEDCNAVIENLDGKEYLGRTLRVNFSNKPKAKEPLYPETEHKLFVGNLSWSVTNEILTQAFQEYGTVVGARVLYDGETGRSRGYGFVCFSTKEEMEAALGALNDVELEGRAMRVSLAEGKRAQG

SEQ ID NO: 30751 - protein, 138 aa, Oryza sativa (japonica cultivar-group)
MRSSAQQHQMNGIRAVASPERERPARGSNIINNNGGPPTSPDDKKGSSSGSEGSIWPKFAVALTNKEKEEDFWVFKGSKLPQRPKKRAKVIQRTVNLVCPGTWLCDLTLERYEVREKKVSKKRPRGLKAMHNMDSDSE

SEQ ID NO: 30752 - protein, 501 aa, Chorispora bungeana
MAIPMPTRQLFIDGEWREPILKKRIPIVNPATEEVIGDIPAATTEDVEVAVNAARRAFSRNKGKDWAKAPGALRAKHLRAIAAKVTERKSDLAKLEALDCGKPLDEAVWDMEDVAGCFEFYADLAEGLDAKQKAPVSLPMENFKSYVLKQPIGVVGLITPWNYPLLMAVWKVAPSLAAGCTAILKPSELASVTCLELADICREVGLPPGVLNVLTGYGAEAGGPLASHPGVDKIAFTGSFATGSKVMTAAAQLVKPVSMELGGKSPLIVFDDVDLDKAAEWALFGCFWTNGQICSATSRLLVHENIAPQFIEKLVKWSKNIKISDPMEEGCRLGPVVSQGQYEKILKFISTAKSEGATILHGGSRPEHQEKGFFIEPTIITDVTTSMQIWREEVFGPVLCVKTFGSEDEAIELANDSHYGLGAAVISNDTERCDRVSQAFEAGIVWINCSQPCFTQAPWGGVKRSGFGRELGEWGLDNYLSVKQVTLYTSNEPWGWYKSPN

SEQ ID NO: 30753 - protein, 484 aa, Ajellomyces capsulatus
MEAVRDILFFNSNRLYNLKQSPDSPDFDLNYLQTRGLSPVVFQTATTPTPEDILKKFLHKKSVDFIWMQWVDYTATVRVRMFPIRQFKKIVSSKHKVGICLAVMIMLQNDHLASPEPLSTGEFILTPDVTTLCRNIGLSSRSATVMTFWKNQDGGELEGCPRTILQNTVNKCQSEYGIKTLVGFEIEVVFMKISKEGSSTSYSPWFTNHSWSNITTENVQALPMIEKIVDKLADIDIHLQQFHTESGPSQFEFILPPSTPLAACDTLIQARQTITDVAAQYGVRATLHPRPIPNAAGTASHTHLSITPTTFKDNFLAGLLQNLPSVSPFTLPQDASYERIAEGIWSGGVWVAWGYQNRETPIREVSSGHWEFKPMDGLANPYLAVAAIIGSGYLGIKNRMPLTIKGCNVNTAALSPSQRAALSITTRIPSSLEESLKALESNVELQTLLGPGFVRRYVCVRRGEQKMLNAMDKEQRRNWLIERY

SEQ ID NO: 30754 - protein, 472 aa, Acinetobacter calcoaceticus
MTTKILPVIMAGGSGTRLWPLSRTQYPKQFLKLSPDGYTLLQATLFALKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSAMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 30755 - protein, 271 aa, Streptomyces coelicolor A3(2)
MSGNVQLLNDTLAAAKSEGRAALIAYLPAGFPTVTGGIEAVKAALDGGADVVEVGLPHSDPVLDGPVIQTADDIALRGGVRIADVMRTVREAHEATGKPILVMTYWNPIDRYGVERFTAELAEAGGAGCILPDLPVQESALWREHADKHGLATVFVVAPSSRDARLAEITAVGSGFVYAASLMGVTGTRASVGAQAEDLVRRTRATTDTPVCVGLGVSNAAQAAEVAGFADGVIVGSAFVKRMLDAPDDAAGLEGVRALAADLAKGVRGQA

SEQ ID NO: 30756 - protein, 128 aa, Streptomyces coelicolor A3(2)
MTSSSPTGGGPGRPSALAPEIADRLKRSADGLLPAIAQQYDTGEVLMLGWMDDEALHRTLTTGRCTYWSRSRGEYWVKGDTSGHFQWVKSVALDCDADTVLVKVDQVGAACHTGTRTCFDTDVLLADQ

SEQ ID NO: 30757 - protein, 445 aa, Phalaenopsis cv. 'True Lady'
MARGIGLGAPLSKIAVSKAHGEDSPYFAGWKAYDEDPYDPVANPTGVIQMGLAENQVSFDLLEDYLEQHPETASWSSGISGFKENALFQDYHGLQSFRKAMASLMEQIRGKRVKFNPDRMVLTAGATAANELLTFILADPGDAVLVPTPYYPGFDRDLQWRTGVKIFPVHCHSSNGFQLTLPSLQSAYSIAEASNLRVKALLITNPSNPLGTTMPRSLLEDILNFISQKNIHLISDEIYSGSVFSSPEFISVAEVVEASQHKNCDGVHIVYSLSKDLGLPGFRVGTIYSYNDRVVTTARRMSSFSLVSSQTQKMLASMLSDEEFTVKYIKTNRERLRRRHGYIVEGLKDAGIECLEGNAGLFCWMNLTQMLEEKSMEGELRLWKMILSEVKLNVSPGSSCYCAEPGWFRVCFANMTKETLEVALRRTKDFVEKIKGRKSNVIFRS

SEQ ID NO: 30758 - protein, 37 aa, Brassica oleracea
ELEALLITDNQIQARIDSHNKILYARHADQRNATFQK

SEQ ID NO: 30759 - protein, 331 aa, Leuconostoc mesenteroides
MKIFAYGIRDDEKPSLEEWKAANPEIEVDYTQELLTPETAKLAEGSDSAVVYQQLDYTRETLTALANVGVTNLSLRNVGTDNIDFDAAREFNFNISNVPVYSPNAIAEHSMIQLSRLLRRTKALDAKIAKHDLRWAPTIGREMRMQTVGVIGTGHIGRVAINILKGFGAKVIAYDKYPNAELQAEGLYVDTLDELYAQADAISLYVPGVPENHHLINADAIAKMKDGVVIMNAARGNLMDIDAIIDGLNSGKISDFGMDVYENEVGLFNEDWSGKEFPDAKIADLIARENVLVTPHTAFYTTKAVLEMVHQSFDAAVAFAKGEKPAIAVEY

SEQ ID NO: 30760 - protein, 473 aa, Leuconostoc mesenteroides
MKKTKIVSTLGPSSSDVETIVKLIQAGANVFRFNFSHGDHEEHLGRMNAVHEAEKITGKTVGILLDTKGAEIRTTKQADGKIEFHTGDTLRIAMDENLEGTKEKIAVTYAGLFDDVKEGGQVLFDDGLLGTTVIEKDSATRELVVRVDNDGILGSRKGVNAPGVSINLPGITEKDADDIRFGLDHEINYIAASFVRKPEDVLEIRGLLKEKNMEHVQIIPKIESQEGIDNLDAILEVSDALTVARGDMGVEIPAENVPLVQKDMIRKMNKAGLPVITATQMLDSMEENPRPTRAEASDVANAVFDGTDATMLSGESANGDYPVESVATMAAIDEKAETSLRENGRHEDIFFDETDSTEAVAASVARIARNVNAKAVVVSTNSGYTARMVSKHRPDVNILAVTYSERVQRGLTLNYGVVPVVYDAPKTIDEMVDLAKKAVKDQGLANSGDTIVIAAGVPMSQSGTTNMLTVQTV

SEQ ID NO: 30761 - protein, 296 aa, Ostreococcus tauri
MENYEKVAKIGEGTYGVVYKAKSLRDDAMVALKRIRLDQDDEGVPSTAIREISLLKELRHENVVSLLEVIHEETKLYLVFEYLDLDLKKHMDSSPHISNDRMVIKGYVYQICAGIAFCHSHRVLHRDLKPQNLLIDTTNNVLKLADFGLARAFGIPVRAYTHEVVTLWYRAPEILLGVRTYSTPVDVWSIGCIMAEMVNHAPLFPGDSEIDELFKIFKTLGTPGETLWPEAKQLPDYQEGFPKWKAKPWESLCPALDEAGVDLLRSLLQYSPEKRISAKYATQHRWFDDYREHIGR

SEQ ID NO: 30762 - protein, 329 aa, Ostreococcus tauri
MGGHSINDAYEKLEKIGQGTYGKVYKARDRATGRLVALKKTRLEMEEEGVPSTALREVSLLQMLSESPYIVRLLRVEHVEEDGKAMLYLVFEFLDQDLKQFMDLTGRGPSNPLPTTTVQNYMYQLCLGCAHLHKHGVMHRDLKPQNMLVDKAKNLLKIADLGLGRAFSVPVKSYTHEIVTLWYRAPEVLLGGSHYSTPVDMWSVGCMFAEMARKQPLFPGDSELQQLLHIFKLLGTPSEQVWPGVSNLRDWHEFPQWKPQDLAKLIPQLDAHGIDLLQKLLVFDPAKRIHATDALEHPYFDSLDKTQFEKIEREFEIEFLREKENRMAQ

SEQ ID NO: 30763 - protein, 389 aa, Ostreococcus tauri
MERYERGRTLGEGTYGVVHEARVKETNEVVAIKKIRLGKLKEGVNFTAIREIKLLQEIKHEHVIELVDVFAHKKNLNLVFEYCGGDLEMVIKDKATPLSAGEVKSYARMTLRAVAHCHENWVLHRDLKPNNLLIAPNGCLKLADFGLARIFGSPDRRFTHQVFARWYRAPELLLGSKTYGPGVDVWAVGCILAELMLRKPFFAGSSDIDQLGKVYAALGTPTETNWPGVSALPDFIEFIYVPPPNLHDTFPNETNESLDLLKRMLEYDPNKRITAAQALEHPYFHTKPAPIPFEELPKRFATKNFTQHASGGTSPSREAKTGEKRRLEDADEAPDSTDPNFRPKPRRRRTGEGVAAVAKGAFGTPPFARRSRGDELKTRRFSPTPLAGN

SEQ ID NO: 30764 - protein, 473 aa, Neotyphodium uncinatum
MTVDTITSTSNGNQDVPKEFLPIEFETQLLHLGRFPDILGSCAVPVYSSAAFEFNSVAHGARLLNLTQFGNIYSRFTNPTVNVLQNRLAGLEGGVAACGVASGSAAVVVTVMALTGVGDNFVSSFHVHAGTFHQFDSLAKQMGIECRFVKSRDPADFAAAIDDKTKFVWLETISNPGNVILDLEAVSTVCHTKGIPLICDNTFGCAGYFCRPIDHGVDIVVHSATKWIGGHGTTVGGIIVDGGTFDWGQHPDRFPQFHDPRTRLWERFSRRAFAVRCQFEILRDTGSTLSAPAAQQLLVGLESLAVRCERHAQNAAKIADWLREYPLVAWVSYVGHPNHPDHQGALKYLKRGFGSVICFGLRGGFEAGALFCDALKMVITTTNLGDAKTLILHPASTTHEHFSSEHRAEAGVTDDMIRLSVGIEQIKDIKADFEQAFKQVLRGKKSLRKPCIGKILMQDEINEDLFGPSACRT

SEQ ID NO: 30765 - protein, 369 aa, Chorispora bungeana
MNAGGQFTDFPAVQTHGGQFISYDIFGSLFEITSKYRPPIIPIGRGAYGIVCSVLDSETNELVAMKKIANAFDNHMDAKRTLREIKLLRHLDHENIIAIRDVVPPPLRRQFSDVYIATELMDTDLHQIIRSNQSLSEEHCQYFLYQLLRGLKYIHSANVIHRDLKPSNLLLNANCDLKICDFGLARPTSENEFMTEYVVTRWYRAPELLLNSSEYTAAIDVWSVGCIFMELMNRKPLFPGKDHVHQMRLLTELLGTPTESDLGFTHNEDAKRYIRQLPSFPRQPLAKLFSHVNPLAIDLVDRMLTFDPNRRITVEEALNHQYLAKLHDPNDEPICQKPFSFEFEQQPMDVEQIKEMIYKEAIALNPTYG

SEQ ID NO: 30766 - protein, 419 aa, Pseudomonas syringae pv. phaseolicola
MRAISNTPRLYWPPYTPMKMDDCRPSIVRGEGVYLYDDTGRRYIDGISGSYNHCLGHSHFGLIEAVKEQVDTLVHACNISSNTVLPEALAERISGKLVKARLVHTFLVMSGSEGVEAALKMAWQYQINRGCPQRTKVVAIDGAYHGCTLGAMIATRREFINEGAAPLLAAHAIAMPIPSGLEDISHWRALLAEQETTIAAIVIEPVMAMAGTRQFPDGFLRELSALAKKYDIPFICDEVYCGVGRTGAFCESINQGASPDIVILSKCLGGGFPITAVVTTADMTDSFAAQSMPLFRHGHTQSGNLLGCRAALFILDYLDSHRSYEVVAAGGSRLLQGIRENLQTTNSIVSVQGKGLMLSITFETSQACTRAQLAVRRQGVIVGAADRHLKLAPSFLISEPEADELTDRLVSSIRSVSQQ

SEQ ID NO: 30767 - protein, 433 aa, Burkholderia cepacia
MSLNDDATFWRNARQHLVRYGGTFEPMIIERAKGSFVYDADGRAILDFTSGQMSAVLGHCHPEIVSVIGEYAGKLDHLFSGMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 30768 - protein, 511 aa, Cylindrotheca fusiformis
MAEFDNTFILDFCSGGNESSSDVQALCQVAGLANGTSASAAGLVEGINTFFLLFAGALVFLMQAGFAMLCAGSVRQKNVKNIMLKNMLDACGGAIGFWTIGYAFAYADNSSGDKTFIGGKNFFVNQLDESGGAWIGFFFQFAFAATAATIVAGTVAERCKMSAYLCYSVFLTGFVYPVVVHSIWSADGWLTAFRDDPWKGVGVIDFAGSGVVHMTGGATALVAAIVLGPRKGRFYDEDGNALETPASFPAHSVALQVLGTFLLWFGWYGFNPGSALVIDNAASASTSALCAVTTTLAAASGCVCAMFTDTIIEMMATGEASYDLTMAMNGALGGLVAITAGCSVVTPWASIIIGIIAGWVYIAFSKLLVKLKIDDAVDAVPVHFANGMWGVLAVGFFAEPDAMVTAGYNDVPGVFYKGDGKLLLCQFVAIIWICAWIFFLMTPFFVVLNILGMFRVDPLEEEVGLDISHHRGAAYDMTSAKKEDVEELMEHRSSKHGKVEVPKEVQKEDTA

SEQ ID NO: 30769 - protein, 511 aa, Cylindrotheca fusiformis
MAEFDNTFILEFCSGGNESSSDVQVLCQVASLANGTSASAGGLTEGINTFFLLFAGALVFIMQAGFAMLCAGSVRQKNVKNIMLKNMLDACGGAIGFWTIGYAFAYADNSSGNKTFIGGKNFFVNQLDESGGAWIGFFFQFAFAATAATIVAGTVAERCKMSAYLCYSIFLTGFVYPVVVHSIWSADGWLTAFRDDPWQGVGVIDFAGSGVVHMCGGATALVAAIVLGPRKGRFYDEDGNALETPASFPAHSVALQVLGTFLLWFGWYGFNPGSALVIDNAASASTSALCAVTTTLAAASGCVTAMFTDTLIEMMATGEASYDLTMAMNGALAGLVAITAGCSVVTPWASLIIGIIGGWVYLGLSKLLIKLKIDDAVDAVPVHFGNGMWGVLAVGFFAEPDAMVTAGYNDVPGVFYKGDGSLLLCQFVAIVWVCAWVFFLMTPFFVVLNILGMFRVDPLEEEVGLDISHHRGSAYDMTTAKKEDVEELMEHRSSKHGKVEIPKEVQKEDTA

SEQ ID NO: 30770 - protein, 344 aa, Sesuvium portulacastrum
MREGWRKYKLLSSLSSSPQLHFLTRAMASDDKPEVAERVTRGKDHEEEKEEDKGGFIDKVKDFIQDIGEKIEGAIGFGKPTADVSGVHFPHIDLHKAEVIVDVLVKNPNPVLIPLIDINYLIESDGRKLVSGLIRDAGTIRAHGSETVKIPVNVIYDYIKSTYEDIKPGSIIPYNVKVDLIIDVPVIGRITIPLQKTGEIPVPYKPDIDVEKIHFERFSFEETIATLKLKLENKNDFDLGLNALDYEVWLGDENIGGAELQKSAKIEKNGITHMDLPISFRPKDFGSALWDMIRGSGTGYTMKGNIDVDTPFGVMKLPISKEGGTTRLKKKKDDGSYDDDDDED

SEQ ID NO: 30771 - protein, 336 aa, Lotus corniculatus
MGSVPETVCVTGAAGFIGSWLVMRLMERGYMVRATVRDPANMKKVKHLLELPEAKTKLTLWKADLAEEGSFDEAIKGCTGVFHVATPMDFESKDPENEVIKPTINGVLDIMKACQKAKTVRRLVFTSSAGTLNVIEHQKQMFDESCWSDVEFCRRVKMTGWMYFVSKTLAEQEAWKFAKEHGIDFITIIPPLVVGSFLMPTMPPSLITALSPITGNEAHYSIIKQGQYVHLDDLCLAHIFLFEHPESEGRYICSASEATIHDIAKLINSKYPEYNIPTKFKNIPDELELVRFSSKKIKDMGFEFKYSLEDMYTGAIDTCKEKGLLPKAAENPSNGK

SEQ ID NO: 30772 - protein, 338 aa, Pseudomonas putida
MNLNRFERYPLTFGPSPITPLKRLSEHLGGKVELYAKREDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVERGGKPFPIPAGCSEHPYGGLGFVGFAEEVRQQEKELGFKFDYIVVCSVTGSTQAGMVVGFAADGRSKNVIGVDASAKPEQTKAQILRIARHTAELVELGREITEEDVVLDTRFAYPEYGLPNEGTLEAIRLCGSLEGVLTDPVYEGKSMHGMIEMVRRGEFPDGSKVLYAHLGGAPALNAYSFLFRNG

SEQ ID NO: 30773 - protein, 322 aa, Arabidopsis thaliana
MADGGKMVCVTGASGYVASWIVKLLLLRGYTVRATVRDPSDEKKTEHLLALDGAKEKLKLFKADLLEEGSFEQAIEGCDAVFHTASPVSLTVTDPQIELIDPAVKGTLNVLKTCAKVSSVKRVIVTSSMAAVLFREPTLGPNDLVDESCFSDPNFCTEKKLWYALSKTLAEDEAWRFAKEKGLDLVVINPGLVLGPLLKPSLTFSVNVIVELITGKDNFINKDFRLVDVRDVALAHIKAFETPSANGRYIIEGPVVTINDIEKILREFFPDLNLGNKGEASEIIPVIYKLCVEKVKSLGIEFTPTEATLRDTILSLKEKCLV

SEQ ID NO: 30774 - protein, 315 aa, Manihot esculenta
  misc_feature (303)..(303): Xaa can be any naturally occurring amino acid
MASASLLKSSPVLDKSEFVKGQSLRQPSASIIRCHPTAPSALTIRAGSYADELVKTAKTIASPGRGILAMDESNATCGKRLASIGLENTEANRQAYRTLLVTAPGLGQYISGSILFEETLYQSTTDGKKMVDVLVEQNIVPGIKVDKGLVPLPGSNNESWCQGLDGLASRTAAYYQQGARFAKWRTVVSIPNGPSALAVKEAAWGLARYAAVSQDNGLVPIVEPEILLDGEHGIDRTFEVAQKVWAEVFFYLAENNVMFEGILLKPSMVTPGAECKDRATPQQVADYTLNLLKRRIPPAVPGXMFLSGGQSEVEA

SEQ ID NO: 30775 - protein, 224 aa, Aegilops bicornis
  misc_feature (8)..(8): Xaa can be any naturally occurring amino acid
AIMSFHQXGGNVGDVVNIPIPQWVRDVGATDPDIFYTNHGGARNIEYLTLGVDDQPLFHGRTAVQMYADYMANFRENMKKFLDAGTIVDIEVGLGPAGEMRYPSYPQSQGWVFPGIGEFVCYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAAE

SEQ ID NO: 30776 - protein, 214 aa, Aegilops markgrafii
NVGDIVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYPTEKGKFFLSWYSNKLIKHGDKILDEANKVFLGCRVQLAIKISGIHWWYRVPNHAAE

SEQ ID NO: 30777 - protein, 222 aa, Aegilops markgrafii
AIMSFHQCGGNVGDIVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHA

SEQ ID NO: 30778 - protein, 221 aa, Aegilops markgrafii
  misc_feature (1)..(1): Xaa can be any naturally occurring amino acid
XMSFHQCGGNVGDVVNIPIPQWVRDVGATDPDIFYTNRGGTRNIEYLTLGVDDQPLFHGRTAVQMYADYIASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHA

SEQ ID NO: 30779 - protein, 224 aa, Aegilops comosa
AIMSFHQCGGNVGDVVNIPIPQWVRDVGATDPDIFYTNRSGTRNIEYLTPGVDDQPLFRGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAAR

SEQ ID NO: 30780 - protein, 220 aa, Aegilops uniaristata
MSFHQCGGNVGDVVNIPIPQWVRDVGATDPDIFYTNRSGTRNIEYLTLGVDDQPLFRGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHA

SEQ ID NO: 30781 - protein, 221 aa, Australopyrum retrofractum
IMSFHQCGGNVGDVVNIPIPQWVRDVGATNPDIFYTNRKGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVQLAIKISGIHWWYRVPNHA

SEQ ID NO: 30782 - protein, 219 aa, Australopyrum velutinum
MSFHQCGGNVGDVVNIPIPQWVRDVGATNPDIFYTNRKGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILEEANKVFLGCRVQLAIKISGIHWWYRVPNH

SEQ ID NO: 30783 - protein, 221 aa, Crithopsis delileana
  misc_feature (214)..(214): Xaa can be any naturally occurring amino acid
IMSFHQCGGNVGDVVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGTFFLSWYSNKLIKHGDKILDEANKVFLECRVQLAIKISGIHWXYRVPNHA

SEQ ID NO: 30784 - protein, 222 aa, Aegilops tauschii
AIMSFHQCGGNVGDVVNIPIPQWVRDVGATDPDIFYTNRGGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHA

SEQ ID NO: 30785 - protein, 202 aa, Aegilops comosa
DVVNIPIPQWVRDVGATDPDIFYTNRGGTRNIEYLTLGVDDQPLFHGRTAVQMYADYMTSFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWW

SEQ ID NO: 30786 - protein, 204 aa, Agropyron cristatum
  misc_feature (51)..(52): Xaa can be any naturally occurring amino acid
VGDVVNIPIPQWVRDVGATDPDIFYTNRSGTRNIEYLTLGVDDQPLFNGRXXIQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWG

SEQ ID NO: 30787 - protein, 205 aa, Haynaldia villosa
GNVGDVVNIPIPQWVRDVGATDPDIFYTNRSGTRNIEYLTLGVDDQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHW

SEQ ID NO: 30788 - protein, 224 aa, Haynaldia villosa
AIMSFHQCGGNVGDVVNIPIPQWVRDVGATDPDIFYTNRSGTRNIEYLTLGVDDQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAAE

SEQ ID NO: 30789 - protein, 224 aa, Eremopyrum bonaepartis
AIMSFHQCGGNVGDVVNIPIPQWVRDVGATDPDIFYTNRSGTRNIEYLTLGVDDQPLFRGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWLYRVPNHAAR

SEQ ID NO: 30790 - protein, 221 aa, Eremopyrum distans
IMSFHQCGGNVGDVVNIPIPQWVRDVGATDPDIFCTNRRGARNIEYLTLGVDDQPLFNGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWLYRVPNHA

SEQ ID NO: 30791 - protein, 220 aa, Eremopyrum orientale
  misc_feature (214)..(214): Xaa can be any naturally occurring amino acid
MSFHQCGGNVGDVVNIPIPQWVRDVGATDPDIFCTNRRGTRNIEYLTLGVDDQPLFNGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWLXRVPNHA

SEQ ID NO: 30792 - protein, 213 aa, Henrardia persica
SMSFHQCGGNVGDVVNIPIPQWVRDVGATDPDIFYTNRSGTRNIEYLTLGVGDQPLFRGRTAVQMYADYMTSFRENMKKFLDAGTIVDIEVGLGPAGEMRYPSYPQSQGWVFPGIGEFICYDKYLEADFKAAAAKAGHPEWELPDDTGEYNDTPEKTQFFKDNGTYLTEKGKFFLSWYSNKLLKHGDKILDEANKVFLGCRVQLAIKISGIHW

SEQ ID NO: 30793 - protein, 223 aa, Heteranthelium piliferum
AIMSFHQCGGNVGDVVNIPIPQWVRDVGATDPDIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHAA

SEQ ID NO: 30794 - protein, 224 aa, Hordeum brevisubulatum
PIMSFHQCGGNVGGVVNIPIPQWVRDVGATDPDIFYTNRSGTRNIEYLTLGVDDQPLFHGRTAIQMYADYMTSFRENMKKFLDAGTIVDIEVGLGPAGEMRYPSYPQSQGWVFPGIGEFICYDKYLEADFKAAVAKAGHPEWELPDDAGEYNDTPEKTQFFKENGTYLTEKGKFFLSWYSNKLIKHGDKILDEANKVFLGCRVQLAIKISGIHWWYRVPNHAAE

SEQ ID NO: 30795 - protein, 223 aa, Hordeum bulbosum
  misc_feature (222)..(222): Xaa can be any naturally occurring amino acid
IMSFHQCGGNVGDVVNIPIPQWVRDVGATNPDIFYTNRRGTRNVEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVQLAIKISGIHWWYRVPNHAXR

SEQ ID NO: 30796 - protein, 213 aa, Hordeum brachyantherum subsp. californicum
MSFHQCGGNIGDVVNIPIPQWVRDIGAGDPDIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKVAAAKAGHPEWELPDDAGEYNDTPEKTQFFKENGTYLTEKGKFSLSWYSNKLIKHGDKILNEANKVFLGCRVQLAIKISGIHWW

SEQ ID NO: 30797 - protein, 221 aa, Hordeum jubatum
  misc_feature (9)..(9): Xaa can be any naturally occurring amino acid
  misc_feature (13)..(13): Xaa can be any naturally occurring amino acid
IMSFHQCGXNVGXVVNIPIPQWVRDIGAGDPDIFYTNRSGTRNIEYLTLGVDDQPLFHGRTAIQMYADYMASFRENMKKFLDAGTIVDIEVGLGPAGEVRYPSYPQSQGWVFPGIGEFICYDEYLEADFKAAAAKAGHPEWELPDDAGEYNDTPEKTQFFKENGTYLTEKGKFFLSWYSNKLIKHGDKILNEANKVFLGCRVQLAIKISGIHWWYRVPNHA

SEQ ID NO: 30798 - protein, 224 aa, Hordeum jubatum
AIMSFHQCGGNVGDVVNIPIPQWVRDVGATDPNIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKAAVAKAGHPEWELPDDAGEYNDTPEKTQFFKENGTYLTKKGKFFLSWYSNKLIKHGDKILDEANKVFLGCRVQLAIKISGIHWWYRVPNHATE

SEQ ID NO: 30799 - protein, 219 aa, Hordeum jubatum
  misc_feature (12)..(12): Xaa can be any naturally occurring amino acid
SFHQCGGNVGDXVNIPIPQWVRDVGATDPNIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILNEANKVFLGCRVQLAIKISGIHWWYRVPNHA

SEQ ID NO: 30800 - protein, 224 aa, Hordeum jubatum
AIMSFHQCGGNVGDVVNIPIPQWVRDIGAGDPDIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILNEANKVFLGCRVQLAIKISGIHWWYRVPNHAAR

SEQ ID NO: 30801 - protein, 224 aa, Hordeum brevisubulatum
AIMSFHQCGGNVGDVVNIPIPQWVRDVGATDPDIFYTNRSGTRNIEYLTLGVDDQPLFHGRTAIQMYADYMTSFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVQLAIKISGIHWWYRVPNHAAE

SEQ ID NO: 30802 - protein, 207 aa, Hordeum brevisubulatum subsp. violaceum
VNIPIPQWVRDIGAGDPDIFYTNRSGTRNIEYLTLGVDDQPLFHGRTAIQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVQLAIKISGIHWWYRVPNHA

SEQ ID NO: 30803 - protein, 206 aa, Peridictyon sanctum
GNVGDVVNIPIPQWVRDVGASDPDIFYTNRSGTRNIEYLTLGVDDQPLFQGRTAVQMYADYMTSFRENMKKFLDAGTIVDIEVGLGPAGEMRYPSYPQSQGWVFPGVGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWW

SEQ ID NO: 30804 - protein, 206 aa, Psathyrostachys fragilis
GGNVGDVVNIPIPQWVRDVGATDPDIFYTNRSRTRNIEYLTLGVDDQPLFHGRTAVQMYADYMTSFRENMKKFLDAGTIVDIEVGLGPAGEMRYPSYPQSQGWVFPGIGEFICYDKYLEADFKAAAAKAGHPEWKLPDDAGEYNDTPEKTQFFKDNGTYLTEKGKFFLSWYSNKLIKHGDKILDEANKVFLGCRVQLAIKISGIHW

SEQ ID NO: 30805 - protein, 224 aa, Psathyrostachys juncea
AIMSFHQCGGNVGDVVNIPIPKWVRDVGAIVPDIFYTNRSGTRNIEYLTLGVDDQPLFHGRTAVQMYADYMKSFRENMKKFLDAGTIVDIEVGLGPAGEMRYPSYPQSQGWVFPGIGEFICYDKYLEADFKAAAAKAGHPEWKLPDDAGAYNDTPEKTQFFKDNGTYLTEKGKFFLSWYSNKLIKHGDKILDEANKVFLGCRVQLAIKISGIHWWYRVPNHAAE

SEQ ID NO: 30806 - protein, 191 aa, Pseudoroegneria spicata
IPIPQWVRDVGATDPDIFYTNRGGTRNIEYLTLGVDDQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIK

SEQ ID NO: 30807 - protein, 207 aa, Pseudoroegneria spicata
  misc_feature (202)..(202): Xaa can be any naturally occurring amino acid
GGNVGDVVNIPIPQWVRDVGATDPDIFYTNRGGTRNIEYLTLGVDDQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKIXGIHWW

SEQ ID NO: 30808 - protein, 222 aa, Pseudoroegneria spicata
AIMSFHQCGGNVGDVVNIPIPQWVRDVGATDPDIFYTNRGGTRNIEYLTLGVDHQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHWWYRVPNHA

SEQ ID NO: 30809 - protein, 205 aa, Pseudoroegneria spicata
GNVGDVVNIPIPQWVRDVGATDPDIFYTNRGGTRNIEYLTLGVDDQPLFQGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKISGIHW

SEQ ID NO: 30810 - protein, 216 aa, Pseudoroegneria stipifolia
  misc_feature (55)..(55): Xaa can be any naturally occurring amino acid
  misc_feature (206)..(206): Xaa can be any naturally occurring amino acid
FHQCHGNVGDVVNIPIPQWVRDVGATDPDIFYTNRGGTRNIEYLTLGVDDQPLFXGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTEKGKFFLSWYSNKLIKHGDKILDEANKVFLGCRVQLAIKIXGIHWWYRVPN

SEQ ID NO: 30811 - protein, 221 aa, Secale strictum subsp. anatolicum
  misc_feature (8)..(9): Xaa can be any naturally occurring amino acid
  misc_feature (34)..(34): Xaa can be any naturally occurring amino acid
  misc_feature (111)..(111): Xaa can be any naturally occurring amino acid
  misc_feature (125)..(125): Xaa can be any naturally occurring amino acid
  misc_feature (209)..(209): Xaa can be any naturally occurring amino acid
IMSFHQCXXNVADVVNIPIPQWVRDVGATDPDIXYTNRSGTRNIEYLTLGVDDQPLFHGRTAVQMYADYMASFRENMKKFLDAGTIVDIEVGLGPAGEMRYPSYPQSQGWXFPGIGEFICYDKYXEADFKAAAAKAGHPEWELPDDAGEYNDTPEKTQFFKENGTYLTEKGKFFLSWYSNKLIKHGDKILDEANKVFLGCRVQLAIKVXGIHWWYRVPNHA

SEQ ID NO: 30812 - protein, 224 aa, Secale cereale
AIMSFHQCGGNVGDVVNIPIPQWVRDVGATDPDIFYTNRSGTRNIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLSWYSNKLIKHGDKILDEANKVFLGCRVQLAIKVSGIHWWYRVPNHAAE

SEQ ID NO: 30813 - protein, 220 aa, Secale cereale
MSFHQCGGNVGDVVNIPIPQWVRDVGATDPDIFYTNRSGTRNIEYLTLGVDDHSLFHGRTAVQMYADYMASFRENMKKFLDAGTIVDIEVGLGPAGEMRYPSYPQSQGWVFPGIGEFICYDKYLEADFKEAAAKAGHPEWELPDDAGEYNDTPEKTQFFKENGTYLTEKGKFFLSWYSNKLIKHGDKILDEANKVFLGCRVQLAIKVSGIHWWYRVPNHA

SEQ ID NO: 30814 - protein, 204 aa, Secale montanum
VGDVVNIPIPQWVRGVGATDPDIFYTNRSGTRDIEYLTLGVDDQPLFHGRTAVQMYADYMASFRENMKKFLDAGTIVDIEVGLGPAGEMRYPSYPQSQGWVFPGIGEFICYDKYLEADFKAAAAKAGHPEWELPDDAGEYNDTPEKTQFFKENGTYLTEKGKFFLPWYSNKLIKHGDKILDEANKVFLGCRVQLAIKVSGIHWW

SEQ ID NO: 30815 - protein, 224 aa, Taeniatherum caput-medusae
AIMSFHQCGGNVGDVVNIPIPQWVRDVGATDPDIFYTNRSRTRNIEYLTHGVDDQPLFHGRTAVQMYVDYMTSFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTGKGKFFLSWYSNKLIKHGDKILDEANKVFLGCRVQLAIKISGIHWWYSVPNHAAR

SEQ ID NO: 30816 - protein, 211 aa, Taeniatherum caput-medusae
  misc_feature (211)..(211): Xaa can be any naturally occurring amino acid
FHQCGGNIGDVVNIPIPQWVRDVGATDPDIFYTNRSGTRNIEYLTLGVDDQPLFHGRTAVQMYADYMTSFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTRKGKFFLSWYSNKLIKHGDKILDEANKVFLGCRVQLAIKISGIHWX

SEQ ID NO: 30817 - protein, 212 aa, Taeniatherum caput-medusae
  misc_feature (7)..(7): Xaa can be any naturally occurring amino acid
IMSFHQXGGSIGDVVNIPIPQWVRDVGATDPDIFYTNRSGTRNIEYLTLGVDDQPLFHGRTAVQMYADYMTSFRENMKKFLDAGTIVDIEVGLGPAGEMRYPSYPQSQGWVFPGIGEFICYDKYLEADFKAAAAKAGHPEWELPDDAGEYNDTPEKTQFFKDNGTYLTRKGKFFLSWYSNKLIKHGDKILDEANKVFLGCRVQLAIKISGIH

SEQ ID NO: 30818 - protein, 221 aa, Taeniatherum caput-medusae
  misc_feature (7)..(7): Xaa can be any naturally occurring amino acid
  misc_feature (10)..(10): Xaa can be any naturally occurring amino acid
IMSFHQXGGXVGDVVNIPIPQWVRDVGATDPDIFYTNRSGTRNIEYLTLGVDDQPLFHGRTAVQMYADYMTSFRENMKKFLDAGTIVDIEVGLGPAGEMRYPSYLQSQGWVFPGIGEFICYDKYLEADFKAAAAKAGHPEWELPDDAGEYNDTPEKTQFFKDNGTYLTRKGKFFLSWYSNKLIKHGDKILDEANKVFLGCRVQLAIKISGIHWWYRVPNHA

SEQ ID NO: 30819 - protein, 207 aa, Thinopyrum bessarabicum
GGNVGDVVNIPIPQWVRDVGATDPDIFYTNRGGTRNIEYLTLGVDDQPLFRGRTAVQMYADYMASFRENMKKFLDAGTIVDIEVGLGPAGEMRYPSYPQNQGWVFPGIGEFICYDKYLEADFKAAAARAGHPEWELPDDAGEYNDTPEKTQFFKDNGTYLTEKGKFFLSWYSNKLIKHGDKILDEANKVFLGCRVQLAIKISGIHWW

SEQ ID NO: 30820 - protein, 224 aa, Thinopyrum elongatum
AIMSFHQCGGNVGDVVNIPIPQWVRDIGATDPDIFYTNHGGTRNIEYLTLGVDDQPLFRGRTAVQMYADYMASFRENMKKFLDAGTIVDIEVGLGPAGEMRYPSYPQSQGWVFPGIGEFICYDKYLEADFKAAAAKAGHPEWELPDNAGEYNDTPEKTQFFKDNGTYLTEKGKFFLSWYSNKLIKHGDKILDEANKVFLGCRVQLAIKISGIHWWYRVPNHAAR

SEQ ID NO: 30821 - protein, 221 aa, Triticum baeoticum
IMSFHQCGGNVADIVNIPIPQWVRDVGATDPDIFYTNRGGTRNIEYLTLGVDDQPLFHGRTAVQMYADYMTSFRENMKKFLDAGTIVDIEVGLGPAGEMRYPSYPQSQGWVFPGVGEFICYDKYLEADFKAAAAKAGHPEWELPDDAGEYNDTPEKTQFFKDNGTYLTEKGKFFLSWYSNKLIKHGDKVLDEANKVFLGCRVQLAIKISGIHWWYRVPNHA

SEQ ID NO: 30822 - protein, 205 aa, Triticum monococcum
IPIPQWVRDVGATDPDIFYTNRGGTRNIEYLTLGVDDQPLFHGRTAVQMYADYMTSFRENMKKFLDAGTIVDIEVGLGPAGEMRYPSYPQSQGWVFPGVGEFICYDKYLEADFKAAAAKAGHPEWELPDDAGEYNDTPEKTQFFKDNGTYLTEKGKFFLSWYSNKLIKHGDKVLDEANKVFLGCRVQLAIKISGIHWWYRVPNHA

SEQ ID NO: 30823 - protein, 224 aa, Bromus tectorum
AIMSFHQCGGNVGDVVNIPIPQWVRDVGVSDPNIFYTNRSGTRNIEYLTLGVDDQPLFGGRTAIQMYADYMTSFRDNMKKFLDAGTIVDIEVGLGPAGEMRYPSYPQSQGWVFPGIGEFICYDKYLEADFKAAAAKAGHPEWELPDDAGEYNDTPEKTQFFKENGTYGTEKGEFFLTWYSNKLIKHGDKILDEANKVFLGCRVQLAIKISGIHWWYRVPNHAAR

SEQ ID NO: 30824 - protein, 385 aa, Brassica rapa subsp. pekinensis
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGIMKACDKAKTVRRIVFTSSAGTVNVEEHQKNVYDENDWSDLDFIMSKKMTGWMYFMSKTLAEKAAWDYAKEKGIDFISIIPTLVIGPFITTSMPPSLITALSPITRNEAHYSIIRQGQYVHLDDLCNAHIFLYEQAGAKGRYVCSSHDATILTISEFLRQKYPEYNVPSTFEGVDENLKSIMFSSKKLIDMGFNFKYSLEDMLVESIETCRQKGFLPVTLPEHLKSEDKVPGSDDNKEIKNGSAGLTDGMVACKKTEPGMAGEKADSHMSAQQICA

SEQ ID NO: 30825 - protein, 288 aa, Aegiceras corniculatum
  misc_feature (135)..(135): Xaa can be any naturally occurring amino acid
MEGKEEDVRLGANKFAERQPIGTAAQGAGDKDYKEPPAAPLFEPGELSSWSFYRAGIAEFMATFLFLYITVLTVMGVSRSGSKCASVGIQGIAWAFGGMIFALVYCTAGISGGHINPAVTFGLLLARKLSLTRAXFYMIMQCLGAICGAGVVKGFEGSSRFTIAGGGANVVQPGHTKGDGLGAEIVGTFVLVYTVFSATDAKRNARDSHVPILAPLPIGFAVFLVHLATIPITGTGINPARSLGAAIIYNKDQAWDEHWIFWVGPFIGAALAALYHQVVIRAIPFKSK

SEQ ID NO: 30826 - protein, 284 aa, Aegiceras corniculatum
MAKDIEVGPGANAPKDYQDPPPAPLIDAEELTKWSLYRAVIAEFIATLLFLYITVLTVIGYSSQTDPDKNPDDCGGVGILGIAWAFGGMIFVLVYCTAGISGGHINPAVTLGLFLAQKVSLVRAMLYMMAQCLGAICGCGLVKAFQKSYYTKYGGGANYLHDGYNKGTGLGAEIIGTFVLVYTVFSATDPKRSARDSHVPVLAPLPIGFAVFMVHLATIPITGTGINPARSLGAAVIYGKKKTWDDQWIFWGGPFIGAPIAAFYHQFILRAGAIKALGSYRSNA

SEQ ID NO: 30827 - protein, 353 aa, Acinetobacter baumannii
MSIQVKNIEKHFGAFHALKNISLDFPEGELVALLGPSGCGKTTLLRIIAGLESADGGQVLLEGEDATNVHVRERQVGFVFQHYALFRHMTVFDNIAFGLRVRPRATRPSEAEIKKRVTRLLDLVQLGFLADRYPAQLSGGQRQRIALARALAVEPRVLLLDEPFGALDAKVRKELRRWLRNLHDELHITSIFVTHDQEEALEVADQIIVMNKGNVEQIGSPREVYEKPATPFVFDFLGQANRFEGEHASGIIRIGNDRIELPTTVQAPQGKVIAFARPDELHIHAQPQANTIEATFVREVWIAGKVVAELQDRNGRLIEIALSSEAAKQHAFKPNQTVWVSASQLHLFADQVA

SEQ ID NO: 30828 - protein, 407 aa, Sporothrix schenckii
MSFSSMLSRLHGQPDSYDKKSKYHFGRMLGAGTYGIVREADGPTGKVAIKVILKKNVKGNEQMVYDELNLLQNLKHSHIVRFVDWFESRDKYYIVTELATGGELFDRICEQGKFTEKDASQTIKQVLSAVDYLHKNNVVHRDLKPENLLYLTKQSDSDLVLADFGIAKMLDSKDEVLTTMAGSFGYAAPEVMLKKGHGKPVDMWSMGVITYTLLCGYSPFRSENLPDLIEECTSARVIFHERYWKDVSEDAKDFIIGLLQPNPDDRWSSGDALKHKWLSGESATEHNLLPEIKAYMAKARLRRGIELVKLTNRIEALKMQEDDPENSDMQTDTAAPLQKAAAAAAAQDDGASGSVGAESGPTDKTKQTIQKVKGAIFREVVMAKVREMRQQEEVRKEVEEASKQGSP

SEQ ID NO: 30829 - protein, 417 aa, Pisum sativum
MEFDTIPQEAMWQMNLRSSETMESGPYPEHPGEPDCSYYIRTGLCRFGATCRFNHPPNRKLAIATARMKGEFPERLGQPECQYYLKTGTCKFGATCRFHHPKDKAGVAGRVALNILGYPLRPNESERAYYLRTGQCKFGNTCKFHHPQPSNMVLSMRGSTVYPTVQSPTTPGQQSYAAGITNWSSSSYVPSPRWQGPSSYAPLILPQGVVSVPGWSTYGGQMGSESPQQTMRNDQTYGTSHQGELENAGLQGAYSQYRSGSVPVGFYALQRDNIFPERPDQPECQFYMKTGDCKFGAVCRFHHPRERQIPAPDCVLSPIGLPLRPGEPLCVFYSRYGICKFGPSCKFDHPMGIFTYNVASPLADTPGRRLLGSSSGTAALSLSSEGLVESGTAKPRRLSLSETRPIPPGDDNIDDEG

SEQ ID NO: 30830 - protein, 107 aa, Erysimum cheiri
LGLWDTAGQEDYSRLRPLSYRGADIFVLAFSLISKASYENVLKKWMPELRRFAPNVPIVLVGTKLDLRDDKGYLADHTNVITSNQGEELRKQIGAAAYIECSSKTQQ

SEQ ID NO: 30831 - protein, 387 aa, Fagopyrum esculentum
  misc_feature (97)..(97): Xaa can be any naturally occurring amino acid
  misc_feature (131)..(131): Xaa can be any naturally occurring amino acid
DTGSSNLWVPSGKCYLSIACFFHSKYKSSKSSTYVKNGKSAEIHYGTGAISGYFSQDNVKVGDLVVENQEFIEATREPSLTFVAAKFDGILGLGFQXISVGKAVPVWYNMVNQGLVNEPVFSFWLNRNADXEIGGEIVFGGIDPAHHKGEHTYLPVTQKGYWQFDLDDVLVGGESTGFCSGGCSAIADSGTSLLAGPTPVVAQINHAIGASGVVSQECKTVVSQYGKQILDLLVSQTQPRKICSQIGLCTFDGTRGVSMGIESVVDKNVDKSSGNLKDATCSACEMAVVWMQNQLKQNQTEDRILDYANQLCERLPSPMGESAVDCGSLSTLPTVSFTLGGKTFALAPEQYILQVGEGPATQCISGFIALDVPPPRGPLWILGDIFM

SEQ ID NO: 30832 - protein, 387 aa, Fagopyrum esculentum
  misc_feature (270)..(270): Xaa can be any naturally occurring amino acid
  misc_feature (279)..(279): Xaa can be any naturally occurring amino acid
DTGSSNLWVPSAKCYFSIACFFHSKYKSSKSITHVKNGTSAAIRYGTGAISGFFSRDNVKIGDLVVENQEFIEATREPSITFIAAKFDGILGLGFQEISVGKAVPVWYNMIDQGLISEPVFSFWFNRNAEEEEGGELVFGGIDPDHFRGQHTYVPVTQKGYWQFDMDDVLIDGMSTGFCAGGCAAIADSGTSLLAGPMAVVAQINHAIGATGIVSQECKTVVAEYGKEIIEMLLSEAQPLKICSQVGLCTFDGTRGVSMGIESVVDKNVXKSSGSLKEXKCVACEMAVVWIQNRLIQNQTEELILDYANQLCERLPSPMGESAVDCSSLSTLPDVSFTIGGKTFDLAPEQYVLQVGEGPAAQCISGFIALDVPPPRGPLWILGDVFM

SEQ ID NO: 30833 - protein, 511 aa, Oryza sativa (japonica cultivar-group)
MARMGISKGGSGKEAKKPPLLLGRFEVGKLLGQGNFAKVYHARNVATGEEVAIKVMEKEKIFKSGLTAHIKREIAVLRRVRHPHIVQLYEVMATKLRIYFVMEYVRGGELFARVARGRLPEADARRYFQQLVSAVAFCHARGVFHRDIKPENLLVDDAGDLKVSDFGLSAVADGMRRDGLFHTFCGTPAYVAPEVLSRRGYDAAGADLWSCGVVLFVLMAGYLPFQDRNLAGMYRKIHKGDFRCPKWFSPELIRLLRGVLVTNPQRRATAEGIMENEWFKIGFRRFSFRVEDDRTFTCFELDDDAAVDAPTSPPDTPRTVDSGDVGAAPTRPRKAGSLTSCDSAPSLLEGRFGLGGSSRRRSSLNAFDIISFSPGFDLSGLFDQDDGGGAGAGSIPEQQKHTARFVSAAPVEVIVATLEAAAAAAGMAVREREDGSISMEGTREGEHGALAVAAEIYELTPELVVVEVRRKAGGAAEYEEFFRARLKPSLRELVCDDRPCPEDSGELSRSL

SEQ ID NO: 30834 - protein, 323 aa, Oryza sativa (japonica cultivar-group)
MHLAAADHPHRGGGGRAALGLGLGHLAAAALRREHRRRALAGGAVLASALLLVATPRLRHSPALHLFADMRNLLGVPNTLNVLTAYPLLLAGVPGLVLCLCGSGCFGISEGRAVIKAGIEGMMLKEIFLFCYPYLTEKQISSLRWEALGWFLFYAGNVAAAFGSAYYHLKPDDDRLIWDRLPMMISASSMLSILVIERVDERAGLSCLLSLLSLILVSSACERVLDDMRLWVVLNSAPCIAIPAMLFLFPPKYTHSRFWFLATGFYLLARFEGLADRKVYSVNRYFISGHSLEHLCFAMVTLILTVMLSFRNVKIVRSSNSRT

SEQ ID NO: 30835 - protein, 246 aa, Oryza sativa (japonica cultivar-group)
MDSEHWISSLAAAKRFYAAQLGHVDDMAGIGMEEVEMEMEDDGEGMELELEMQLEEATWPDVACPYCYEDHDIASLCAHLEEDHPYEPHTSPCPICFEKITRDMLNHITMQHGYLFKSGRRMRRFDIPESQALSLLSRDLRDAQLQALLGGGHRQRRSNTTATNISADPLLSSFGLGFSTLDSEERSKAPVPIPDDTSIHKDTPAQPWESRIDSSLTSEEREQKRKQATDRATFVQGLVLSTLFED

SEQ ID NO: 30836 - protein, 343 aa, Oryza sativa (japonica cultivar-group)
MEPPQLDGQCGGEPPASVEGVVFMPYATADSSLRVMADDGDGSLREGCRRREPLWIVFDVSGTIHLSTGLRVSSYKTIDGRGQRVTLSGKGLQLRECEHVIVCNLEVEGCRGHDADAVAVKPGSRHVWIDRCGLRGCGDGLLDVTRGSTDVTVSRCRFSAHDKAVLIGGSAGHVEDRAIRVTIHHCLFDGTRQRHPRVRFGRVHLYNNYTRGWGIYAVCASVESQIVSQCNIYEAGEKKKVFKYMIEQAADRDQSSTGFIRSEGDLFLNGAEECTAQDSEAAADELWDFKIQELDFYQSCSVQPASMALKELLECFTGWQPVPLPEDTCLEEETDSAPADTTA

SEQ ID NO: 30837 - protein, 336 aa, Oryza sativa (japonica cultivar-group)
MSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 30838 - protein, 352 aa, Oryza sativa (japonica cultivar-group)
MAATGDSSGALVCVTGGSGFIGSWLVRLLLDRGYTVHATVKNLQDDGETRHLQALDGADTRLRLFQMDLLDPASITPAVDGAHGVFHLASPLTLHPTQDPEATNSPFTIAQLQLQYCLHTCTNAVLSGELLKPAVSGTLNVLRAAKDCGVARVMLMASQVAIVPNPEWPADKVIDDDSWADVELLKKHQHWYNVSKTLAEKAAWDFAAKEGLQLVALNPGLVLGPMLMPSPTSSLHMLLQILGGQRFDIDDFYIGCVDVRDVAQSAVVIYENTSAQGRHLCIESIERLIDFHDKLAELYPEFPIHRIQEDKQGWVVRSKAASKKLIDLGVHFIPFEKTIRDSVDCLRSKGYI

SEQ ID NO: 30839 - protein, 315 aa, Setosphaeria turcica
TNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIAQAANQGQGDEDEQGRGRHVTTTAAANAGTAAGTKRGPV

SEQ ID NO: 30840 - protein, 509 aa, Solanum tuberosum
MTLRISELFAAAIIYIIVHIIISKLIATVRERGRRLPPGPTGWPVIGALSLLGSMPHVALAKMAKNYGPIMYLKVGTCGMVVASTPNAAKAFLKTLDINFSNRPPNAGATHLAYNAQDMVFAPYGPRWKLLRKLSNLQMLGGKALENWANVRANELGHMIKSMFDASHVGECVVIADMLTFAMANMIGQVMLSKRVFVEKGAEVNEFKNMVVELMTVAGYFNIGDFIPKLAWMDLQGIEKGMKSLHKKFDDLLTKMFDEHEATTYERKENPDFLDVVMANKDNSEGERLSTTNIKALLLNLFTAGTDTSSSVIEWALAEMMKNPKIFKKAQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFGAGRRICAGTRMGIVMVEYILGTLVHSFDWKLPNDVIDINMEESFGLALQKAVPLEAMVTPRLSLDVYCC

SEQ ID NO: 30841 - protein, 509 aa, Solanum tuberosum
MTLRISELFAAALIYIIVHIIISKLIATVRERGRRLPPGPTGWPVIGALSLLGSMPHVALAKMAKKYGPIMYLKVGTCGMVVASTPNAAKAFLKTLDINFSNRPPNAGATHLAYNAQDMVFAPYGPRWKLLRKLSNSHMLGGKALENWANVRANELGHMLKSMFDASHVGECVVIADMLTFAMANMIGQVMLSKRVFVEKGVEVNEFKNMVVELMTVAGYFNIGDFIPKLAWMDLQGIEKGMKSLHKKFDDLLTKMFNEHEATTYERKENPDFLDVVMANKDNSEGERLSTTNIKALLLNLFTAGTDTSSSVIEWALAEMMKNPQIFKKVQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFWAGRRICAGTRMGIVMVEYILGTLVHSFDWKLPNDVIDINMEESFGLALQKAVPLEAMVTPRLSLDVYCC

SEQ ID NO: 30842 - protein, 423 aa, uncultured archaeon
MLNRNAVLQRGLVNEAKKFPDTPAEHYQRALSIMNSARLDDLPALYDVISLCREAVRLNPDYAEAYCLLGAALAGMGQSGDAIQALEKAITLQPGYAEAHYYLGKAVLATGNPDQALNLFTASKQLGMNESMACCGIGSALAEKGLYRESIVELSRAIAVDPGNVEAYVRLGMACCETGSYAEAMAWLKKAVELNPGNIEAHLCLARAYLRGQMYDAALAEYDVVLGLRPRCLDAINGKGTVYHYKGLIDQAIQEYRHAIDLYPGDYRAHNNLALAYVDKGMYERAIPEYRLAICASPKLPELHADYGMLLLLTGDTYGATLAFREALRLAPDSYSGHVNLAVALYQSGQCSDALAELAEAVRLSPSEPEAFFHLGTIHDRCGDPVKAATAYESFIRFSASGDKRVKSVRARLLEIKGGKKRK

SEQ ID NO: 30843 - protein, 257 aa, uncultured archaeon
MVIKVAITGINGRMGTMISDAALAQPDMEIVAGFDLVAGKKIGNITVSSVSDIDRVLKATKPDVLIDFTVAAACVNNVKAAAANGVSVVVGTTGFDEAQNAEMKNAIEAGKIRAIISPNYSFGVQVFLKLLREAAKNLGDCDIEIIEAHHNKKKDAPSGTALKAADVISSALAEKPEYVYGREGTAPRTAGEIGIHAVRGGDIVGDHTALFACDGERIEIKHQLHSRQALASGAVKAARWIVSREPGIYSMDDVFKD

SEQ ID NO: 30844 - protein, 286 aa, uncultured archaeon
MSMEEYLCRIAEADVAVVSHFKLPARSFDSSTLKLVALTRTGYDDVDLDAATLKGVAVANAPGYSNEAVAEHVFAMLLSFIRRISEADFWIREEKFDCTAFEGRELRGKTMGIIGTGQIGLRVAEIARCFGMDVIAYDVRRNPAVAEKLRYVGLDRLCAESDFITVHLPLTSDTRGLIDEESFRLMKPGAVIINTARGPVVDQAALLRALDEGRIAGACLDVFDQEPLPPDSPLLAMSNTLLTPHIAYNTREAKEQSIAIAAENVALYLSGKPRNIVNPAVLGVKP

SEQ ID NO: 30845 - protein, 255 aa, Azoarcus sp. EbN1
MTRSSRIAEYWALAWVCLLFAGLAFVAPIAQPQDYHRFADSRALSLGPIALPHAADVLTSLAFVAAGLAGLPRCSRSMPAQYLPLTVFFTGLVLTGIGSVWYHLSPTDVSLVWDRLAMTIAFAGAVGSLGAERLGPAAGRRWFLGWQMTGLVAVVLWRLSGDLRLYLVTQFGGLGVLLLWFRLPVAAGMVRLPWGWLLFAYGVAKAFELLDRLIWTLTDGLFSGHPVKHLIAALGVLPMLRVLSERRAGARERRS

SEQ ID NO: 30846 - protein, 337 aa, Azoarcus sp. EbN1
MTMQAAILESPGIENVRVRAIPMPTAGPGTALVRMRAASLNYRDLVVVNGGFGSRQKQSGLVLLSDGAGEIVELGEGVCEFNIGDRVASCFYEDWAGGRPTAARLATALAAGRDGIACEYRALAATGIMRVPDHLSWIEAATLPCSALTAWSAVVAHGATKAGETIVTQGSGGVSLFAAQFALACGARLISTSSSEAKLARLKEIGAHELINYRAEPEWGRRARALSGEGADLVIDIGGRATLKQSMLALRPGGTVALIGAVSGQRASLNLGAAVANSIRLQGIAVGHRESYAEMMRAVSFHKIRPVTDEVFPLADIQAALRFLASGQHVGKVCIEI

SEQ ID NO: 30847 - protein, 336 aa, Azoarcus sp. EbN1
MRYLTLGKTNIQTSEMGFGCMGMSEFYGEADDAESLKTLERAFDLGVTLYDTSNVYGRGHNEKLVGQFARGKRDKLVICSKFGVVRDPSGPSGSTYDRGIDNSPLYMRRCCEESLTRLGIEAIDLYYVHRVDPNVPIEETAAALAELIREGKIKSYGLSEVTAEQLRRAHAVHPVTALQSEYSLWNREPELDVLPACKELGITFIAYSPLGRGFLTGAIKQAGELKSDDFRLSLPRFQGENFDRNQVLVGQIKQFATAKNCTPGQIALTWLYYRGQDIVPIPGTKRIKYLEENVGAKGVKLTQSDLDQLEEILPLGAPAGSRYDAKFGGNPQTPKS

SEQ ID NO: 30848 - protein, 437 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNDEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSYLIKFNQIGSLTETLAAIKMAKDAGYTAVISHRSGETEDATIADLAVGTAAGQIKTGSMSRSDRVAKYNQLIRIEEALGEKARTTVVKRSKARHKTDFI

SEQ ID NO: 30849 - protein, 346 aa, Chlamydomonas reinhardtii
MTRGLDYYEVMGLTRSANDIDIRRAYRRLALKYHPDINKDGAAGDEFLRICEAYEVLCDPKTKGFYDLYGEDALKDGISDGNGGLKGPMYRFNPEESPKAVFERFFGTANPYEALEALSNQFESMTSEEAPARGKNKVYPLELTLEEIFHGCLKKVAHKRKVLLFSGEYVEEERQLTVDVKPGLPTGTRFVFEGEGNKTPKKEPGPVVFVLKPKPHPRFVRRGSDLVHKVTLPLHHALIGTTLDIRTLDDRDLKVPISDIMRPGSSLTVPGEGMPLPATPSARGNLVIEIDLLFPTHLTETQKMLLRSAFFLPPPTEQNEETKKALRDYEAAFKHDLKGWAPVFKR

SEQ ID NO: 30850 - protein, 159 aa, Pasteurella multocida subsp. septica
GASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30851 - protein, 159 aa, Pasteurella multocida subsp. septica
VASGEAGGITQHIGAYHVETDGKMITFLDTPGHAAFTSMRARGAKATDIVVLVVAADDGVMPQTIEAIQHAKAAGVPIVVAPNKIDKPEANPERVETELLQHEVVAEKFGGDTQFVYVSAKKGTGVDELLEAILLQSEVLELTAVKDGMATGVVIESYL

SEQ ID NO: 30852 - protein, 158 aa, Pasteurella multocida subsp. septica
ASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30853 - protein, 160 aa, Pasteurella multocida subsp. septica
KVASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30854 - protein, 155 aa, Pasteurella multocida subsp. multocida
EAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30855 - protein, 148 aa, Pasteurella multocida subsp. multocida
GITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVI

SEQ ID NO: 30856 - protein, 156 aa, Pasteurella multocida subsp. multocida
GEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30857 - protein, 153 aa, Pasteurella multocida subsp. multocida
GWDTQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30858 - protein, 159 aa, Pasteurella multocida subsp. septica
VASGEAGGITQHIGAYHVETDGKMITFLDTPGHAAFTSMRARGAKATDIVVLVVAADDGVMPQPIEAIQHAKAAGVPIVVAANKIDNPEANPERVETELLQHEVVAEKFGGDTQFVYVSAKKGTGVDELLEAILLQSEVLELTAVKDGMATGVVIESYL

SEQ ID NO: 30859 - protein, 159 aa, Pasteurella multocida subsp. septica
VASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30860 - protein, 149 aa, Pasteurella multocida subsp. septica
KVAFGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDG

SEQ ID NO: 30861 - protein, 160 aa, Pasteurella multocida subsp. septica
KGASGEAGGITQHIGAYHVETDGKMITFLDTPGHAAFTSMRARGAKATDIVVLVVAADDGVMPQTIEAIQHAKAAGVPIVVAVNKIDKPEANPERVETELLQHEVVAEKFGGDTQFVYVSAKKGTGVDELLEAILLQSEVLELTAVKDGMATGVVIESYL

SEQ ID NO: 30862 - protein, 248 aa, Ipomoea batatas
MQTNYGDIEFGFYPRVAPRTVEHIFKLVRLGCYNTNHFFRVDKGFVAQVADVVGGRTVPMNEEQRVEAEKTVKGEFSDVKHVRGILSMGRYSDPDSASSSFSMLLGDAPHLDGQYAVFGKVTKGDETLRKLEQLPTRREGIFVMPTERITILSSYYYDTEMESCEQERSLLKRRLAASVVEIERQMSGDFQILKLETSIDFEIVFDGAKCFCNQEFYAFLLILYLIIDIPEKRNSRQEEREQGEINSS

SEQ ID NO: 30863 - protein, 354 aa, Camellia sinensis
MTTVAAPRVQSLATSGIESIPKEYVRPKEELTGIGNIFEEEKNEEGPQVPTIDLKDIDSEVEEVRERCREALKKAAVDWGVMHLVNHGIADDVRERVKVAGEGFFEQPVEEKEKYANDPDNGNLQGYGSKLANNACGQFEWEDYFFHLAYPEDKCDMSIWPKTPTDYIPATVEYAKQLRALATKTLSILSLGLGLEENKLEKEVGGKEELLLQMKINYYPKCPQPELALGVEAHTDLSAVSFILPSMVPGLQLFYEGKWITAKCVPNSIIMLIGDTVEILSNGKYKSILHRGLVNKEKVRISWAVFCEPPKEKIILKPLPETVSEAEPPLFPPRTFAQHIQHKLFRKSQELGSK

SEQ ID NO: 30864 - protein, 176 aa, Pennisetum glaucum
MASEHEEPKQKQSLMDKAKEFVADKIAHIPKPEASLDSVSFKSMSRECITLHSNVNITNPYDHRLPICEVTYTLKCAGKVVASGTMPDPGWIAASDSTKLEIPAKVPYDFLISIVKDVGRDLGHRLRAPGGAHHRLPIVGNFTIPSTTSGEFKLPTSRDMLFGSSTTSESEGEITL

SEQ ID NO: 30865 - protein, 133 aa, Pennisetum glaucum
MEHQGQHGHATNQANEYGTPVTAGVGAAGEQQVQPMRDDHKTDGLLRRSGSSSSSSSEDDGMGGRRKKGIKEKIKEKLPGGNKDGNQQHTTTGDAIGQQEHAGAAGAGAPGVESTGEKKGLMDKIKEKLPGQH

SEQ ID NO: 30866 - protein, 147 aa, Escherichia coli
KPMFGDNGSGMHCHMSLSKNGVNLFAGDKYAGLSEQALYYIGGVIKHAKAINALANPTTNSYKRLVPGYEAPVMLAYSARNRSASIRIPVVSSPKARRIEVRFPDPAANPYLCFAALLMAGLDGIKNKIHPGEAMDKNLYDLPPEEA

SEQ ID NO: 30867 - protein, 182 aa, Escherichia coli
AYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGK

SEQ ID NO: 30868 - protein, 182 aa, Escherichia coli
AYELVAPILEQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGK

SEQ ID NO: 30869 - protein, 182 aa, Escherichia coli
AYKLVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGK

SEQ ID NO: 30870 - protein, 182 aa, Escherichia coli
AYDLVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQVQPAGDKAEFIEKVRRALYLGK

SEQ ID NO: 30871 - protein, 182 aa, Escherichia coli
AYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGK

SEQ ID NO: 30872 - protein, 182 aa, Escherichia coli
AYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGK

SEQ ID NO: 30873 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGK

SEQ ID NO: 30874 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDMILDEAANKGTGKWTSQSALDLGEPLSLITESVFARYISSLKEQRVAASKVLYGPQAQPAGDKGEFIEKVRRALYLGK

SEQ ID NO: 30875 - protein, 182 aa, Escherichia coli
AYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQRAGDKAEFIEKVRRALYLGK

SEQ ID NO: 30876 - protein, 182 aa, Escherichia coli
AYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGK

SEQ ID NO: 30877 - protein, 179 aa, Escherichia coli
TQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKY

SEQ ID NO: 30878 - protein, 161 aa, Escherichia coli
PQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAE

SEQ ID NO: 30879 - protein, 151 aa, Escherichia coli
PQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAP

SEQ ID NO: 30880 - protein, 172 aa, Escherichia coli
TQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEA

SEQ ID NO: 30881 - protein, 160 aa, Escherichia coli
PQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEA

SEQ ID NO: 30882 - protein, 314 aa, Azoarcus sp. EbN1
MPLSSQAKALLDMVYRVGAPRFHELSVDQARHSFRKLQWAFGLPSPAVAATVEVAMTRVDGSTLNARLYRPLESSRDDELPLLIYFHGGGWCVGDLESYDVLCRQLANGSGCAVLSIDYRLAPENPFPAAVEDAIFSIEWAAEQAQRLGIDRGCIALGGDSAGGNLSIVGALLAHERASVAIRFMFLVYPSTEIASDRPSRQLFGQGYLLDGESLEWFYGHYLPAGNDEDWRASPMRAPSLAGLPPILLVTAECDPLADDCMAFAERVRAEGGEIEHVAVDGVVHGFITLGQFFPEATHAVDRITAGLRRAVRP

SEQ ID NO: 30883 - protein, 335 aa, Azoarcus sp. EbN1
MKAITLRSPGGLDRLELVELPDPGQPGPGEIRVRIHASSLNFHDLGVVSGAMPVADNRIPMSDGAGVVEAIGEGVDEFAVGDAVVSTFFPHWLDGEAPIADFSTTPGDGVDGYACELVVRPATAFTHSPRGYSHAQAATLTTAGLTAWRALIYNGGLKAGDSVLVLGTGGVSIFALQFAKAMGATVIATSSSDEKLEHARALGASHTINYCSQAQWASRVLDFTGGCGVDHVIEVGGPGTLAQSIQACRIGGHIALIGVLTGGAGVVPTAALMKRQQRLQGLIVGNRRQQNELVRAIEATGIFPVIDRSFTLETIADAFRLQKAGGHFGKISLEF

SEQ ID NO: 30884 - protein, 1273 aa, Azoarcus sp. EbN1
MREAVQPCKNLVHPSHARRARSRAQVTAGCVRERQPQSPIALSGVLLAMKPEIPDPATAALPAAARSELRRRIDTAWRTPEPECVPPLIRAARIDAALQARIRAQARELVAGLRATRTHSSGVDALMKEFSLSSQEGVALMCLAEALLRVPDSATADRLIRDKLAHRDWHAHLGHSPSLFVNAATWGLLVTGRLVGTSSAQGLSSALTRMLARGGEPLIRRGMDLAMRLLGEQFVTGRNIAEALERSAAARRRGYRYSFDMLGEAAMTAADAQRYLAGYEQAIHAIGKASAGRGVVDGDGISVKLSALHPRYVWSQRGRVLAELLPRLKSLCMLARHYDLGLNIDAEEADRLELSLDLLEALALDDELAGWQGLGFVVQAYQKRAPRVVDWIIELARRSGRRLMVRLVKGAYWDAEIKRAQVEGLAGYPVFTRKLYTDVAYLACARQLLAARDVLYPQFATHNAHTLSAVFQLAGDDYAAGDYEFQCLHGMGEPLYDQVVGDTGSRRRVRIYAPVGSHETLLAYLVRRLLENGANSSFVNRIVDENVSIDALVADPVEEALPLAGAPHPRIPLPADLYGSERRNSAGHDLASEPVRQRIGAALQLSRSVVRRAGPLLANGPASPASRDNVLPVRNPADHSDVVGMVVHADEIDVERALAAASGAAPGWAMRAAAARAACLERAAELIERDTDELVALAVREAGKSWANVLAEVREAVDFCRYYAARVRDFDNASHAALGPVLCISPWNFPLAIFTGQIAAALAAGNPVLAKPAEQTPLIATAAVALFREAGVPAAVLQLLPGRGDIVGAALVADPRVRGVLFTGSVEVATRINRALARRGGDVPLIAETGGQNAMIVDSTALAEQVVADAIASAFDSAGQRCSALRVLCLQDDVADAVLAMLRGALDEMRLGDSSDVRNDIGPVIDADAQAALERHVAAMQASGARITRLALPQRCSRGTFVAPTIIEVGDIRDVGDEHFGPILHVLRYRAEELDRLLDAINATGYGLTMGVHSRIDETIDAVIAHARVGNLYVNRNMIGAVVGVQPFGGEGLSGTGPKAGGPLYVHRLLRRSPGPALEGRDRLPDGEAFGCLVTWLDGAGRTLIDDAGRAFLHERIAACRATRLAGLRLALPGPTGEDNSLRFVPRGLVAGVATTTVGRLHQLLAALASGNRIVFTDDAAHRALFDALPGPARKAVTLDTDWPGHPFGALLLDGTAAEADAWRVRLAERDGPIVPLLQPEPDYDAARLVHERTVSINTAAAGGNASLMALGA

SEQ ID NO: 30885 - protein, 308 aa, Azoarcus sp. EbN1
MTTTAFITHRECWLHDMGTFHPECSDRLAAINDRLIAAGLDLYLSFYDAPQATPEQITRAHPAAYLEELMNSVPEHGIRHLDPDTAMNPETMKAALRSAGAGVLATDLVLKGEIENAFCAVRPPGHHAERARAMGFCFLNNVAIAARHALEAHGLERVAIVDFDVHHGNGTEDIFREDPRVMMASIFQHPFYPYSGVDCTAAHMVNVPVPAGARGDTFRQIVSDLWIPALRNHNPQMIFISAGFDGHYEDDMGSLGLVESDYVWATQQVKALAADCGHKNIVSVLEGGYALSSLARSVVAHIKALADL

SEQ ID NO: 30886 - protein, 296 aa, Azoarcus sp. EbN1
MDYKTLEDYVGHTPLVRLKRIGAGRNNVILAKLEGNNPAGSVKDRPALSMIVQAEARGEIRPGDTLIEATSGNTGIALAMAAAMRGYQMILVMPENQSVERRQTMRAFGAELVLTPRDGGMEMARDVAERMRDEGRGIILDQFANPDNPLSHYEATGPEIWEQTDGRITHFVSSMGTTGTIMGCSRFLKERNPAVRIIGCQPDEGSQIPGIRKWPEAYLPKIYEKPRVDALENVSQADAEEMTRRLAREEGIFAGISSGGAMHVAVRIAAELENAVIVSIICDRGDRYLSTGVFPG

SEQ ID NO: 30887 - protein, 354 aa, Azoarcus sp. EbN1
MSDELLNLRKNIDRLDEEILVRLAERARHAQRVGEIKQGNVYRPEREAQVLRRLGAANPGPLPDLAVQRIFREIMSACLALERPLRVAYLGPAGTFSESASRKHFGSAPNFVPTSTIEEVFRAVEAGNVDYGVVPVENSTEGVVGGTLDLLLENPLQICGEVKLRIHQHLLSKAAGIGALKRLYSHAQSLAQCHEWLNRKLPSLSRVPVASNAEAARLASEDAESCAIAGEAAADLYGLGVLAANIEDDPNNTTCFLVIAHHDADRSGQDKTSLVCSAPNRPGAVHALLEPLAKHGVSMSKLQSRPARGGLWEYVFYMDIEGHRDDPEVAAALKELNERAGFVKVLGSYPGAVI

SEQ ID NO: 30888 - protein, 176 aa, Azoarcus sp. EbN1
MLDREGYRPNVGIILVNTRNEVFWGKRIREHSWQFPQGGIKHGESPEQAMFRELFEEVGLRPEHVKILGRTRGWLRYDVPKHWIKREWRNTYRGQKQIWFLLRLVGRDSDVCLRASTHPEFDAWRWSDYWVPLEAVIEFKRQVYQQALFELSKTLFRTRPCDPPEAYKALAEVREP

SEQ ID NO: 30889 - protein, 249 aa, Azoarcus sp. EbN1
MYKIVLLRHGESTWNKDNRFTGWTDVDLTEKGVEEARGAGHLLKREGYTFDLAYTSVLKRANKTLNIVLEELDSLWLPVEHSWRLNERHYGDLQGLNKAETAAKFGDDQVLVWRRSYDTPPPPLPEGDERLTSGDPRYASLPRAQFPRTECLKDTVARFVPYWETVIVPNILAGRRILIAAHGNSLRALIKYLDNISDSEIVGLNIPTAQPLVYELDANLRPIRSYYLADADTIRAAEAAVAGQGKAKG

SEQ ID NO: 30890 - protein, 394 aa, Azoarcus sp. EbN1
MNVKKLADLDVAGKRVFIRADLNVPQDEAGNIVEDTRIRASLPSIRYCLERSATVMVTSHLGRPTEGECRAEDTLAPIAVRLGELLGKPVRLIRDWVEGGFEVRAGEVVLLENCRCNKGEKKDNEELAKKMAALCDIYVNDAFGTAHRAEATTHGIARFAPVACAGMLMGAEIDALTKATENPARPLVAIVGGAKVSTKLTILKTLAEKVDQLIVGGGIANTFLLASGKRIGESLAEPELVKEAQAIMDMMKARGAEVPLPVDVVVADEVSALARANRIPVDEVGPHDRILDVGPKSSAKLAEIIAHAGTIVWNGPVGVFEHNQFAGGTKMMASAIAHSEAFCIAGGGDTLAAIAKFHIAQDIGYISTGGGAFLEFLEGKKLPAIAALEARFAD

SEQ ID NO: 30891 - protein, 482 aa, Azoarcus sp. EbN1
MPRHTKIVATLGPASSDPQVLERMVHAGVDVVRMNFSHGKAEDHVARAEAIREAASLAGRPVGILADLQGPKIRVGKFAEGQVELQRDAGFILDARCELGNAERVGLDYKDLPKDVKAGDVLLLDDGRLKLTVTRVIGHEIHTVVKVGGTLSNNKGINRQGGGLTAPALTAKDMDDIKTAAKIGVDFVAVSFPKSAADMYMARQLMRASGVDALLIAKIERTEAVANLDEILDASDGIMVARGDLAVEVGDAAVPALQKKMIRAARDRNKLTITATQMMESMITSPVPTRAEVSDVANAVLDGTDAVMLSAETASGRFPVEVVEAMSRVCLEAEKSSDVALDRDVLNRVFTRIDQSIAMAAIWTAWHLKVKAIASLTQTGSTALWMSRLNSGVPIYALTPEASARNQMTLYREVFPLLMSQTHQDRDVLLWEAEQILIDQGVAERGDLIVLTIGEPIGASGGTNTLKIVRVGEHPPPHVTDQ

SEQ ID NO: 30892 - protein, 133 aa, Azoarcus sp. EbN1
MSRPNSVRWLNEVQWDDQGLVPVIAQEAASGDVLMFAWMNREALQRTAETGEAIYWSRSRRRLWHKGEESGHIQKVLEIRLDCDSDVVLLKIEQIGGIACHTGRHSCFFQRYLADGSWETVDPVVKDPKDIYK

SEQ ID NO: 30893 - protein, 275 aa, Azoarcus sp. EbN1
MPRLSSNSSATLVQLQDVRFAYGERVILRGIDLDIPRGKVVAIMGGSGCGKTTLLRLVGGQLRASGGTVNVAGQDLARLSTRELYALRRRMGMLFQFGALFTDMSVFDNVAFPLREHTDLQPELIRDLVLMKLNAVGLRGAATLKPAELSGGMARRVALARAIALDPMLIMYDEPFAGLDPISLGVIGQLIRRLNDALGASTIMVTHDILESLQIVDYVYFISEGRIVAHGTPDEIRASTDPFVQQFIHAEADGPVPFHYPAEPLAHSLLGRGAA

SEQ ID NO: 30894 - protein, 148 aa, Azoarcus sp. EbN1
MSKLHVIRTLLLDVKKIVTRLKAEGHTLTDTHRKVHRPWGWYDSIDAGDRFQVKRIVVKPGASLSLQRHHHRAEHWVVVSGTAEITNGDKVLLLSENESTYIPLGHVHRLSNPGKMPLEIIEVQSGSYLGEDDIVRFEDTYGRAPAGG

SEQ ID NO: 30895 - protein, 427 aa, Azoarcus sp. EbN1
MTSRNETLFQRAQKSIPGGVNSPVRAFRSVGGTPRFISRAEGARVWDADGKAYVDYVGSWGPAIAGHAHPAIVEAVREAALAGLSFGAPSEAEVDIAELICELMPSIEMVRLVSSGTEATMSAIRLARGFTGRDAIVKFEGCYHGHADSLLVKAGSGLLTFGNPSSGGVPADFAKHTIVLDYNDLQQVEDAFRARGGEIAAVIVEAIAGNMNLVKPLPGFLEGLRRLCTEYGVVLIFDEVMTGFRVGPQGVQGLYGIMPDLTTLGKVIGGGMPVGAFGGRRDIMEKIAPLGSVYQAGTLSGSPVAVAAGLASLKLLREPGFYENLGARTTQLVTGLAAAANDAGVTFSADSVGGMFGVYFSAAVPKSFADVMASDRDAFNRFFHAMLDAGHYFAPSAFEAGFVSAAHTAADIDETIAAAREVFARLG

SEQ ID NO: 30896 - protein, 510 aa, Azoarcus sp. EbN1
MELSEWIDRHAGLEPGKTAIRFPERDLSYAQLAGLVERLASALKASGVAHRSCVAYLGYNSPEMLATLFACARLGALFMPLNWRLAGPEHRQLLADCPPSVLFVEPRFVAQIDAFRDALADVTLVAFDAPPQGWISYEALLERSGDAVPRDPQVGPQTPLLICYTSGTTGKPKGALLSQGALAWNAVNSIDLHELSADDRILTTLPLFHVGGLNNQTTPALSAGATVVLHPKFDADATFDAIEQERITLTVLVPAQLEMMIARPRWQSADLSSLRMITTGSTIVPERLIREVHRRGVPLVQIYGSTETCPIAAYVKPADAQRKAGSAGRAAPHCSLRIVGDDGHDVKPGATGEILVRGPNVMNAYWNDLQASAAVLKDGWFRTGDMGHQDGEGYLWVDGRKKEMIISGGENIYPAEIENLLGESPDIAEVAVVGRLDERWGEVVVAVVVPLEGRTLDAGHVLQLLEGRIARYKLPKEVVFLDELPRTALGKVRKDDVRQLVARKTFMEQT

SEQ ID NO: 30897 - protein, 506 aa, Azoarcus sp. EbN1
MLYELPGQPAAKVRFKSRYDNFIGGKWVAPVRGEYFDNVTPITGKPFCQVARSTEEDITLALDAAHAAADRWGRTSAADRANLLLKIADRLEGNLELLAYAETVDNGKAIRETLNADIPLTIDHFRYFAGCLRAQEGSISEIDEHTVAYHFHEPLGVVGQIIPWNFPILMAAWKLAPAIGAGNCVVLKPAESTPVSILVLVELIADLLPPGVLNVVNGFGREAGMPLATSKRIAKIAFTGSTATGRVIAQAAATNLIPATLELGGKSPNIFFSDIAAADDAFFDKAVEGMVLFAFNQGEVCTCPSRALIQESIYDRFMERVLARVRAIRQGSPLDTDCMMGAQASAEQMNKILSYMDVGREEGAQLLIGGERAHLGGELAEGFYVQPTLFRGHNKMRIFQEEIFGPVLAVTTFKDEAEALEIANDTPYGLGAGVWSRDGSVAYRMGRAIKAGRVWTNCYHAYPAHATFGGYKESGIGRETHKMMLDHYQQTKNLLVSYSPNALGFF

SEQ ID NO: 30898 - protein, 487 aa, Azoarcus sp. EbN1
MGKPTGFLEYQRLSEAYEPVAERVKKYKEFVLRLSDEQAAVQGARCMDCGIPFCNTGCPVNNIIPDWNDLVYRNQWRQAIEVLHSTNNFPEFTGRICPAPCEAACTLNINADPVGIKSIEHAIIDKAWEEGWVQPRPPKSKTGRKIAVVGSGPAGLAAAQQLARAGHDVTVFEKSDRIGGLLRYGIPDFKMEKSLIDRRIEQMQAEGVTFRTGIVVGSADLPAGIASDAKEVVSAEALKNEFDAVILAAGSEVPRDLPVPGRELDGVHFALEFLIPQNKAVAGGAPNPISAEGKNVVVIGGGDTGSDCVGTSNRHGAASVTQFELMPMPPEQENKALTWPYWPIKFRTSSSHEEGCERDFAVATKAFYGTNGKVEGLKAVRLEWKDGRMAEVPGSEFDVRADLVLFAMGFTNPVGSLLEAFGVDRDGRGNAKATTDGEGCYATTSPKVFAAGDVRRGQSLVVWAIREGRQCAREVDQFLMGQSVLPR

SEQ ID NO: 30899 - protein, 311 aa, Azoarcus sp. EbN1
MEFRDYYQVLGVERGASADEIRRAYRKLARKYHPDVSKVADAEQRMKEINEANAVLSDPERRAAYDQLGRGFHAGQDFRPPPNWDAGFEFTRRGPGGDGGDFSDFFSDLFGGMGHGQRGAHFRARGEDHHAKIVIDLDDAFHGATREVTLRAPQLDPQGHVSMHERVLKVRIPKGVRDGQHIRLAGQGMPGTGGGTAGDLYLEVHFRPHRRYRVDGRDVHETVPVAPWEAALGASIDVPTPAGTVSVRVPPGSQTGRKLRLKGRGIPAAEPGDLYLVLEVVLPPADTDAARRLYETMAQELAFNPRQGLGG

SEQ ID NO: 30900 - protein, 379 aa, Azoarcus sp. EbN1
MNAPLVIVGTGAAGYALLRALRQIDRDRPLVLITRDDGAAYEKFHLARALGARTRPRGLVLATVEQMAHRYGATILAHRHILRIDRLRHELVMREGRHGYGQLVLATGAAALREPGLRGTAASQALTLGSLADYAYLRSELAGRNRVVVLGGGLAGCELADNLARSSCHVTLLEPANQLLAETLPALSAARVAQALQAAGVQVMTEDGIQRIDQGPDELELTTLAGVRFPADLLVLARGVVPRTELARDAGLAVARGIVVDPALGTVDPDIFALGECAEIDGRLFRLAEEIEAGAQVLAEVLCGRKRRMRWPARLRRLQIESCPVTVCEPPPLAGEWHEAATQRGVRAVFRDRRGALRGFALLGDQVAAAERLLGELGR

SEQ ID NO: 30901 - protein, 395 aa, Azoarcus sp. EbN1
MATNRVTFNWADPLHLDEQLTETERLVRDTARAYSQERLLPRVQEAFRHEKTDRAIFNEMGELGLLGATIPEEYGGSGMNYVCYGLIAREVERVDSGYRSMMSVQSSLVMVPINEFGTEAQKKKYLPKLATGEWVGCFGLTEPNHGSDPGSMVTRAKKVDGGYSLSGSKMWITNSPIADVFVVWAKDDEGQIRGFVLEKGWKGLSAPAIHGKVGLRASITGEIVMDEVFVPEENAFPTVRGLKGPFTCLNSARFGIAWGALGAAEACYETARQYTLDRKQFGRPLAANQLIQKKLADMLTEITLGLQGCLRLGRMKDEGTAAVEITSIMKRNSCGKSLDIARVARDMLGGNGISDEFCVARHLVNLEVVNTYEGTHDVHALILGRAITDIAAFSN

SEQ ID NO: 30902 - protein, 486 aa, Azoarcus sp. EbN1
MTLALNDPDLFRSRCLVGGTWADADSGATIAIHNPATGEQLGTIPKMGAAETRRAIDAASRAWPAWRALTAGARARVLRKWFDLIVEHQEDLALLMTSEQGKPLGEARGEVLYAASFVEWFAEEAKRIYGDVIPGHQPDKRIVVTKEPVGVCAAITPWNFPLAMITRKAGPALAAGCTMVLKPATQTPYSALALAVLAERAGVPAGVFSVLTGSATEIGGELTANPIVRKLTFTGSTEVGIKLAAQCAPTIKKLSLELGGNAPFIVFDDADLDAAVDGALASKYRNTGQTCVCANRLLVQDSVYDAFAEKLTAAVAKLKVGNGVDEGVTQGPLIDMRAVEKVEEHIADALAKGARVVTGGGRHALGRTFFEPTILADVTPQMKVAREETFGPVAPLFRFKDEAEAIRMANDTEFGLAAYFYSVGMNRVWRVSGALEYGIVGINTGIISTEVAPFGGMKSSGLGREGSKYGIEDYLEIKYLCMGGVQ

SEQ ID NO: 30903 - protein, 490 aa, Azoarcus sp. EbN1
MKSKPAYQNLELQPIAGQWRAGSAERNLDVTDPFTGKTLLSLPMASCEDLDQAYHAAQKAQSEWATMGPTVRGDVMRRAVEIFDERKEEILHWLIRESGSTHIKAEIEWASARAITLESASLPSRVHGRILPSDVPGKESRVYRAPLGVVGVISPWNFPLHLSARSVSPALALGNAVVIKPASDTPITGGLLLARIFEEAGLPAGVLSVLVGAGSDIGDAFVEHPVPSFISFTGSTPVGRNIGRLASGGTHLKHVALELGGNSPFVVLADADVDAAVNAAVVGKFLHQGQICMAINRIIVEAPLLEGFTRRFVERVKALPYGDPSKPETIVGPVINAKQLAGLTAKISKAQQEGAVVLVGGDPQGNVMPPHVFGNVTADMEIAREEIFGPLVGIQSARDAEHALTLANSSEYGLSSAVFTGDTSRGVQFAQRIRAGMTHINDMPVNDEPNAPFGGEKNSGLGRFNGDWAIEEFTTDHWVTVQHAPRRYPF

SEQ ID NO: 30904 - protein, 362 aa, Azoarcus sp. EbN1
MKIQAAVTPAQGEDFTIEKVTLAPPKLNEVLVRVVATGVCHTDAVARDLGISPYPIVLGHEGSGIVEQIGENVTSLEVGDHVVMSFAHCGQCENCLTGHPTVCSRFNELNFGGRMEDGTCRLHQGDTELSTFFGQSSFGTHVVAHERNVVKVDKDVDLALLGPLGCGIQTGAGTVLNRLKPAFGTSIAVYGCGAVGLSAIMAAKIAGCQQIFAIDVHESRLQLAGELGATHVLNGKEVDVVKEIKEASMGGTHYAVESTGVPPVVRQCLHALRPLGQAAIVGVTPEMNIDVHNDLMAEGKSMIGVIEGDSVPRVFIPKLVEFFKAGKFPFDKLVKFYRFDQINQAFEDSANGIAVKPVLRLA

SEQ ID NO: 30905 - protein, 185 aa, Azoarcus sp. EbN1
MSVDMDEILRAREEADCLADATAVDAALARMAAEITAQMAGSNPMVYTVMNGGLILAGRILPRLPFPLEVGYLHATRYGHALKGTQLDWRVRPTSDLRGRTVLVLDDILDEGHTLHAILDYLRAEGAKEVRAAVLAHKVHDRKAYPGMRADFTGIDVADRFLFGCGMDYKGYWRNAPGIYAVKGL

SEQ ID NO: 30906 - protein, 365 aa, Azoarcus sp. EbN1
MNSRLLEPVRLGALELPNRVVMAPLTRCRADNPEFAPTESTARYYAQRASAGLIVSEATIVSAQGRGYPYTPGIWSDAQVTGWRRVTDAVHAAGGRIVCQLWHCGRLSLTEFHDGELPVAPSAVNAEWKMFSAQGLKTTPTPHALSRDEIAAIVADFGRAARNAVLAGFDGVEIHSSNGYLIHQFFSPLANRRDDEYGGSHANRARFFFEVLDAVAAEWSPSRIGFRLNPMMNRFHGMRVDEDTLPMFEHVVRRTNAYELAYLHLTEPYLPNQLDGAVGAIDDVARHFRDIATMAVMTNGGFDQTRAEAALAAGTCDAVAFGRPYISNPDLVERFRAGAPLNEWDADTFYQGGDRGYIDYPTLGG

SEQ ID NO: 30907 - protein, 510 aa, Azoarcus sp. EbN1
MHDIIRQLQEKREAARLGGGQRRIDAQHAKGKLTARERIELLLDEDSFEEWDMYKEHRCTDFDMAEERVPGDGVVTGYGTVNGRLVFVFSQDFTVFGGSLSETHAQKICKIMDHAMKVGAPVIGLNDSGGARIQEGVDSLGGYADVFQRNVMASGVVPQISLIMGPCAGGAVYSPSMTDFIFMVKDSSYMFVTGPEVVKTVTHEEVTAEELGGAVTHTTKSGVADLAFEDDVEALAGLRRFIDFLPLSNREQPPVKPALDLADRVDESLDTLVPANANQPYDMKELIAKVVDEGDFFELQPDYAKNILIGFGRMEGQTVGIVANQPLVLAGCLDIKSSIKAARFVRFCDAFNIPVVTFVDVPGFMPGTSQEYGGIIKHGAKLLYAYAECTVPKITVITRKAYGGAYDVMSSKHLRGDVNLAWPTAEIAVMGPKGAVEIIFREEKNDPAKISAREAEYKKKFANPFVAARRGFIDDVIMPHNTRKRICRSLAMLRDKQLDNPWRKHGNIPL

SEQ ID NO: 30908 - protein, 297 aa, Azoarcus sp. EbN1
MEVGFIGLGLMGRPMALNLIRAGHRVHVWSRRRESMQPLLDAGAGDCASAAGVASRAEIVISIVADAPDVEEVALGPQGVADGARRGLVFVDMSTIAPGAAQAIAARLAERGIAMLDAPVSGGEVGAVGATLTIMVGGDAAAFERVKPLFDAMGRTVSLIGAVGAGQVAKACNQILTGVGVAAVAEAMNFAHKSGVDAAKVREALLGGFAYSRILENHGQRMLERNFKPGFKAWMHQKDMRIVMEEAHRLGLALPSAAATAQMFNAMVGSGLGDDDSVAMLKLLEHMSGGESGREGE

SEQ ID NO: 30909 - protein, 291 aa, Azoarcus sp. EbN1
MMDVGFVGLGVMGLPMARHLQQAGHRLHLWARRPQSVAPFAGSDAVVHDSPAALAAATEVAFTVVTASADVEQLALGAEGLIHGARPGWVHVDMSTIAPASARRIAAALEARGAAMLDAPVSGGAQGAQDATLAIMVGGSADVLERLSPLLACLGRTIVHVGGSGAGQVAKACNQMIMVAAIEACAEAMHLANAHGVDVAAVRSALLGGSAASRVLEVMGERMVRRDFAAGIESRLHHKDFGILMGEAARLGAPLPIAAQVWQQLNALMAGGGARDDTSALLRVLEATSRA

SEQ ID NO: 30910 - protein, 469 aa, Azoarcus sp. EbN1
MNAQEVMKMIQENEVRFVDLRFTDTRGKEHHVGLPVSAFEEDHFEHGHPFDGSSLAGWKGIQASDMILLPEAGSAYIDPFFDETTVVLTCDVIEPSDGKGYDRDPRSIAKRAEAYLKSTGVGDTAFFGPEPEFFIFDSVEWSVDMSGVYSKIISEEAAWSTADKFEGGNTGHRPRIKGGYFPVPPVDSLNDIRAAMVLALEACGVPVEVHHHEVANAGQCEIGTKFSTLTKRADWTQVLKYIVHNVAHQYGKTATFMPKPIVGDNGSGMHVHQSIWKDGQNLFAGNGYAGLSEMALYYIGGIIKHARALNAITNPGTNSYKRLVPHYEAPTKLAYSARNRSASIRIPYVANPKGRRIEARFPDPLANPYLAFSALMMAGLDGIQNKIHPGDPADKNLYDLPPEEDAKIPTVCTSLDQALEYLDNDREFLTRGGVFSNDFIDAYLALKGEEVDRMRITTHPVEFDMYYSL

SEQ ID NO: 30911 - protein, 231 aa, Azoarcus sp. EbN1
MPRIAPSLLSADFARLGEEVRNVVAAGADWIHFDVMDNHYVPNLTIGPLVCEAIRPHTSAPIDVHLMVKPVDRIVPDFAKAGANIITFHPEASEHVDRTLQLIRDCGCQAGLVFNPATPLHHLDHVLDSIDIVLLMSVNPGFGGQKFIPGTLPKLRAAREKLDAYEAASGRRILLQIDGGVKVDNIAQIAAAGADTFVAGSAVFGAGRDADPHRYDSVIAALRAELAKVGA

SEQ ID NO: 30912 - protein, 324 aa, Azoarcus sp. EbN1
MPHAIRFHRTGGPEVLQWEAVDVPPPAQGEARVRQHAVGLNYIDTYHRTGLYPAPLPSGIGLEAAGVVEAVGEGVDDLAPGDRVAYAGGPLGAYADLRNMPADRLVKLPDPVSFEQGAAMMLQGLTAQYLLRRTYRVQPGDTILIHAAAGGVGLIVCQWAKALGATVIGTVGTDEKAALARAHGCDHSIVYTRENFAERVREITGGEGLPVVYDSIGKDTFMESLGCLRPLGMMVLFGAASGPVPPFDLGLLAKMGSLFITRPTLFTYSAKRPDLLAMAADLFEVVVSGKVRIEVNQRFALKDAAQAHRELEARRTTGSSILLP

SEQ ID NO: 30913 - protein, 159 aa, Azoarcus sp. EbN1
MEFQTADLCDANESRVKIVSPMFRSYGGRGAFCGRITTLKVFEDNSLVRTALEGPGQGKVLVVDGGGSMRCALVGDQLALLGVKNQWAGVIVYGCIRDSKAIGTMELGVFALGSHPLKSIKKGAGDVDIAVTFGGVTFTPGHFIYADEDGVVVSESSLL

SEQ ID NO: 30914 - protein, 360 aa, Azoarcus sp. EbN1
TGRANERFTSSELIRAHARFKGKDGDHFRLEVGAREVLAREVVLDTGTRSAVPPIENLHEQDFINSENWLDRPQLPDRLVVVGGGYIGLEMGQFYRRLGSEVTIVQHGAQIAGHEDRDVADALQQLLEDERIGFRIGAKATRVRKLAAGLALTLDTDAGCEELEASDLFVAVGRQPNTDEQGLETIGLAPDDEGIIDVDSRLRTEVAGVWAVGDIRGGAMFTHTSWDDYRIVASQVLGDGSRTLDRVVPYAIFTEPQLGRVGMTEDEARRAGRNIRVGRFDMAGNGKARELGETRGFIKVVVDADSCKLLGTAVLAEDAAELVQLYVILMNVDAPYTVIENAVLIHPTLAEAAQSVFLTL

SEQ ID NO: 30915 - protein, 402 aa, Azoarcus sp. EbN1
MTNTPTRTNDSAHPAWHDETRVLHGDAHLSDDAAIVAPIYYTATFRASDARDFAERANTPRHPGFYTRYGNPTHQRVEAVLAELEGTESALLTASGMGAISTTVLALVSAGDHVIAQQRHYMSTAKLFDEVLPKFGVSVTFVEQSDLAAIEAAIRPNTRLMMFETPANPTLVLTDLEAVAALGRSRGILTVADNTFASPLNQKPHALGIDIVVHSATKYLGGHHDLMAGAVCCSEALAERIWRMHVTLGAVLSPMDAWLLLRGLRTLPVRIERINATALAFAGWLEAQPQVEQVFYPGLESHPQHALAKKQMKGYGAVIAFAVKGGFDATRRFVAALELATHGVSLGGVESLVVHTAAMWSGTMNEAQMKAAGIAPNFVRLSIGLEHLEDLKADFSQAFNRA

SEQ ID NO: 30916 - protein, 475 aa, Azoarcus sp. EbN1
MTLVRDKLFIDGRWVAAQGGGFIDVIDPSDASVYARIPEGVPADAEAAIAAARGAFDSWSRTSPAERAQYLERIAAGFQARSDELADAIAHEVGMPLKMASRIQVGGPLWSWQHYAKLAREFEWEARVGNSLVVREPVGVVGAITPWNFPLNQITLKVAPALAAGCTVVLKPSEVAPINAFILAEIIEAAGLPAGVFNLVTGYGPVVGEVLASDPRVDMVSFTGSTHAGRRVAELAAATVKKVALELGGKSAAIVLDDADLAAAVKGTVSNCLLNSGQTCSAHTRMIVPRAKVDEAATLAAAAASSFKVGPALAEGSRLGPLVSQAQRDRVVGYIRRGLDEGARLACGGVDAAPAGAGFFVAPTVLVVEDPKATVAQEEIFGPVLVIVPHDGDEDAILLANDSIYGLAGSVWAGTDEHALAVARRIRTGQVDVNGAPWNPLAPFGGYRQSGLGRENGVYGLEEFLEYKAIQLRPR

SEQ ID NO: 30917 - protein, 504 aa, Azoarcus sp. EbN1
MNKLDPARYGLNLKGRYGNYIGGQWLPPVAGRHFDNITPITGKPLCEIPRSDEQDVELALDAAHKAKAAWGRTSAAERAGVLNRIADRMEANLETLAQVETWDNGKPIRETRAADIPLAIDHFRYFAACVRAQEGSLGEIDHTTVAYHFHEPLGVVGQIIPWNFPLLMAAWKLAPALAAGNCVVLKPAEQTPLSILVFAELVGDLLPPGVLNIVNGFGVEAGKPLASSKRIAKIAFTGETGTGRLIMGYASQNLIPVTLELGGKSPNIFFDDVAAQDDAFFDKAIEGFVMFALNQGEVCTCPSRALIHESIYERFIERALKRVAEIRQGNPLDPATMIGAQASREQMDKIQSYLAIGRDEGAELLAGGERAHLDGELEGGFYIQPTVFRGHNKMRIFQEEIFGPVVSVTTFKDRDEALAIANDTPFGLGAGVWTRNINTAFHMGRHIEAGRVWTNCYHAYPAHAAFGGYKQSGMGRETHKMMLDHYQQTKNLLVSYSEDKLGFF

SEQ ID NO: 30918 - protein, 325 aa, Azoarcus sp. EbN1
MSNWYSDNALSIGKTPLVKLNRVTDGATATVLAKIEGRNPAYSVKCRIGAAMIWDAEQRGLLGPGKEIVEPTSGNTGIALAFVAAARGIPITLTMPETMSVERRKLLVAYGAKLVLTEGAKGMNGAIAKAEEIAASDPGRYVLLQQFNNPANPAIHASTTGPEIWNDTDGNVDIFISGVGTGGTITGVSRYFKETRGKPIVSVAVEPEASPVLTQTRAGEPLKPGPHKIQGLGAGFVPKVLDLSLIDAVETVSNEDAILYAHRLAREEGILSGISCGAAVAVAARIAQRPENAGKTIVVVLPDSGERYLSSILFEGLFDASGVAI

SEQ ID NO: 30919 - protein, 452 aa, Azoarcus sp. EbN1
MRKTLISAAIGLAFGLAGQAWANPVNTVTDTTDDNTQTATANSTQSGPGPQANEYSNATDNTDNRVDNSDNSDNRTDNNSDNRVDNSDNSDNRVDDNSDNRVDNSDNSDNHIDDDSDNRVDNTNNSDQNNDKSAGDNRNNDGTARAEGYGTAAANNGSTSTATFTNAFNTTEVMAIATLNGTVSGVSVSNVGNIATNHGSAYGGNGAAGGAGNGGDGIGGNANGAGGAGGAAAGGEGGMGSNGGDGAGGAAASGTANGATGSTGGSAYSANGDGGDGSGGGGSGSASNGSSGGSGVPGGEGGLAGGAGNSGDSSAAANGGSGTGGAGGTATNTAGNGGNGGTATSGAATAGNGTAGNGGNGGNGGTNTAGNGGDGGTNTAGAGTGGAGTGGAGAAGGAGGTAYADAGAFNMSNTVGGGSLANSAGISMTSLNSGIGALVQQSANVQANLTVR

SEQ ID NO: 30920 - protein, 232 aa, Azoarcus sp. EbN1
MSKVYPDAGSALADVVRDGQTVAVGGFGLCGIPEQLIHGLRDAKVKDLTVISNNAGVDGIGLGLLLETRQIRKMVASYVGENAEFERQLLAGELEVELTPQGTLAEKLRAGGAGIPAFYTRTGVGTLVAEGKEERDIDGKRYLLERSLTADVALVKAWKADRAGNLVYRKTARNFNPVVATAGRITVAEVEELVDTGTLDPDHIHTPGIFVQRIVVNSRPTKHIEQRTVREG

SEQ ID NO: 30921 - protein, 271 aa, Azoarcus sp. EbN1
MSKIQSTFQRLQVTGRRALIPFITAGDPAPELTVPLMNALVEGGADIIELGVPFSDPMADGPTIQRASERALANGMTLRRVLDTVREFRTGNAETPVVLMGYANPIEAMGVERFVSAAREAQVDGVLIVDYPPEECESFARAAKDAGLDPIFLLAPTSTEQRFRDVARVGSGYIYYVSLKGVTGSATLDFDEVAARIPQIRAQVGMPVGVGFGIRDAESARRIGEVADAVVIGSRIIEEIERSPRDRLAANVTAFLREVRTALDQVEGSVR

SEQ ID NO: 30922 - protein, 389 aa, Azoarcus sp. EbN1
MNPYEFDTLAVRAGTARSQFNEHSEALYLTSSFVFGSAAQAAARFSGEEPGNVYARFSNPTVTAMQERLAALEGAEACVATASGMSAILSLAMATLKAGDHVVAPTGLFGATQQLFGTILSKFGIETSFVAATELDAYRAAVTPRTRLFFVETPSNPLTEVIDIAGVAEIAHAAGALFAVDNCFCTPALQRPLELGADVVVHSATKYLDGQGRVLGGAVAGAKVVVDEVLKFLRTAGPSISPFNAWVILKGLETLRIRMDAQSATSLDLARWLEQQPGVVRVFYPGLPSHPQHALAMRQQKSGGAIVSFEVAGGRERAWQVVDGTRMISITANLGDTKTTITHPASTTHGRISAEARAAAGIGEGLLRVAVGLESIEDLRADLARGLRA

SEQ ID NO: 30923 - protein, 164 aa, Azoarcus sp. EbN1
MAVKLHTNHGTITLELDSEKAPETVENFLAYVTAGHYDNTIFHRVIKGFMIQGGGFEPGMVQKPTREPIKNEADNGLKNVTGTVAMARTQAPHSATAQFFINVTDNDFLDFRSADTQGWGYCVFGRVTEGMDVVNAIRSVKTGSSGFHQDVPVEDVVIERAEIV

SEQ ID NO: 30924 - protein, 193 aa, Azoarcus sp. EbN1
MKRLLASLFLFGWLVSAGAANPVVEMRTSEGPVMVELFADKAPKSVANFIEYVKSGHFNGTIFHRVIDGFMVQGGGFDAAMRQKPTRAPIENEAKNGLRNEAGTLAMARTADPHSASAQFFVNLVDNRFLDYPSRDGWGYAVFGKVTEGFDVVQKIGRLPTHTVNGMQNVPEQPVMIESIRIVDAVPAKSTQQ

SEQ ID NO: 30925 - protein, 376 aa, Azoarcus sp. EbN1
MAKRDYYEVLGVNRDASDNEIKKAYRKLAMKHHPDRNPDNKDSEDHFKEAKNAYEILSDAQKRAAYDRYGHAGVDPSAGAGPGGQGFDGFADAFSDIFGDIFGGAGGAGRGRSNVYRGADLRYNLEISLEEAARGADKTIRIPTVEECETCHGSGAKPGTQPKPCPTCGGAGQVRIQQGFFSIQQTCPKCHGTGRIIPDPCRDCGGAGRVKRQKTLEVKIPAGIDEGMRLRHAGHGEPGVNGGPPGDLYVEIHIRAHPVFQRDHDDLHCEMPISITTAALGGEIEIPTLEGMARLKIPAETQSGKVFRLRGKGIRNVRSQAHGDLMCHVVVETPVNLTERQKELLREFEEVSSSDADRHNPKAKSWMDKVKDFFGA

SEQ ID NO: 30926 - protein, 450 aa, Azoarcus sp. EbN1
MGRKYFGTDGVRGRVGDSTITPEFVMRLGYAAGVTLVGREQLPPGERPAILIGKDTRISGYMLEAALEAGFAAAGVDVMLAGPVPTPAVAYLTRALRLQAGVVISASHNPYDDNGIKFFSANGTKLPDALEEEIEFRVDQPMVCAEASRLGKARRIVDAAGRYVEFCKSAFPNEFDLRGYRIVLDCAHGAAYHIGPSVFHELGAEVIPLGVEPNGLNINDQVGATHPQTLRSAVLANKADFGIALDGDGDRVVMVDGDGELYDGDKLLYVIAASRQAEGRLEGVVGTLMSNLGLERAIGRLGLAFARAKVGDRYVLETMHERGWRLGGENSGHIICLDRHTTGDGIVSALQVIAALIKGQCTLATACADLVFYPQKLINVPLAAGFDWRSDERIDQARSDAELELGEQGRVLLRPSGTEPLLRVMVEGKDGSQVERLARHIADCVRHASV

SEQ ID NO: 30927 - protein, 271 aa, Azoarcus sp. EbN1
MARFDGFECMERKLVVGNWKMNGDLVSNQALFEQLVDRSPSSIDTALCVPFPYLAQGQRALSGSAIMLGAQNLSEFDAGAYTGEVSGRMLSDFDCRFVIVGHSERRTVFREDDQLVARKARAALAAGLVPIVCVGESLAERDAGQAEDVLLRQLEALVQLLDGASLARLVIAYEPVWAIGTGRAASPEQVQEILSFVRRWLSGHVGNSRAIRILYGGSVKADSAAALFSLPDSDGGLIGGASLVAQQFLEICEAAAKAAQDGNMGDFKGSR

SEQ ID NO: 30928 - protein, 474 aa, Azoarcus sp. EbN1
MQVFDMIINGKPVRAGSTFDVVNPATGEVFARVQAGDASHVDQAVAAARAAFPGWSRTPDAERKRLMHALGAALEAHMPELMELVTKEAGKPLGGLNGVGSGMEVGGAIAWTHVTADLELPVEVIQDNDDARIEVHRKPLGVVGSITPWNWPLMIAIWHVIPALRAGNTVVIKPSGMTPTATIRFVELANAILPPGVLNIVTGESGVGSAIAKHPDINKIVFTGSTPTGKNIMQNAAGNLKRLTLELGGNDAGIVLPDVDPKAIAPKLFGVGFHNNGQTCACLKRLYVHDSIYEKVCAELARIAKETVVGDGLVEGTELGPVQNKAQLDFVQELVEDARAHGARILSGGKARSGGGFFFEPTVIADAKDGMRVVDEEQFGPVLPVIRYSDIEEVIARANNNENGLGGSIWSKDHAKAAELALRLECGTAWVNEHGAVQPDAPFGGVKQSGLGVEFGRYGLEEYTSIQTLKIMKA

SEQ ID NO: 30929 - protein, 501 aa, Azoarcus sp. EbN1
MFQPPSPIYPVADIRAIEAHVAPLAQPTLMERAGRAAAEEAVRLTQDRTGHVLIVCGPGNNGGDGLVMARRLLQAGRSVTVAFAENPDSLPPDAAAAFAAWRAAGGETVSDFPGAPANGWALVVDALFGIGLRRPVEGRYARWIDTMNAQQAPRLAIDIPSGLDADTGAILGMAFQATATLTFIALKPGLLTLDGPDYAGTVHVHRLDIDPAAWLSPPGFEIRPAMVREFMRPRRQNTHKGSYGDVGIIGGAPGMTGAALLAGRAALKLGSGRVYVGLVDDYALPVDHTQPELMLKRPEQVLEQASVLALGPGLGTSATALALLERAARSDRPLLLDADALNLLADAPHLKAQVAAREAPTLLTPHPGEAGRLLGIGTPRVQADRIASALELSTRFGADIVLKGGGSVIATTTGQWFINTTGHPGMASAGMGDVLTGLIASLLAQGWPARSALLAAVHLHGAAADRLAREGIGPIGLTASEVAEAARGVFNGWIVKAARGR

SEQ ID NO: 30930 - protein, 467 aa, Azoarcus sp. EbN1
MLQKSSPGGAPVDIGRILDHGPFTSMQMLAVMLAAFAIVMDGFDGQLIGFAIPALIKEWGITRAAFAPAVAAGLVGMAVGSACAGIVADRIGRRLVVAASVFLFGIATCAIGFAPDVVTISLLRFIAGLGIGGALPSASTMTAEFTPARHRTLAVTSTIVCYPLGGMLAGLFASAILPVFGWRGLFWIGGALPIAYSFVLLATLPESPRYLARKPNHWPALKKLLARMARPTSPDTTFVDAAERAAEQRAGFASLFAGGLARDTLAIWCGFFMVMLATYTAFSWLPAMLASEGLPAALASSGLTAYNLGGVVGSLGCAVAITRFGSRWPLILCSIGAAASAFLLKYVDIAENGTWLMIGLGVHGMFVIAVQATMYALCAYVYPTIVRATGTASALSFGRLGAILSSFAGAAVITSGGASSYLSMLGFTMVLTLVALALVKRHIPSVNAQPPVAAPAAPAAATAKGYA

SEQ ID NO: 30931 - protein, 424 aa, Azoarcus sp. EbN1
MKHVILGNGPAGVIAAETLRRAAPTDDILLFGSEDAPPYSRMAIPYLLEGNIDESGTWLRKSPGHFDRLRIHEMRGRAVSLDSERRRILFDDGHFESWDRLLIATGSHPVRPPIPGIDLPEVQTCWTLEDARAIARFATPGARVLQLGAGFIGCIIMEALAARGVELTVVEMGDRMVPRMMTPTAGGMIRKWVEDQGVRVVTNAGVSRIDCRASNDAPLDVTLSTGEVVVADLVIVAAGVAPNIAFLEATPVHVAKGVLVDDRLQTSVPGIFAAGDVAEAPDLFTGAHLVAAIQPNAADQARVAALNMAGHEARLKGVLAINVLDTLGLISSSFGQWWGEERERGGAGVEHVDEAAYRYLSLQFKDDVLIGATSIGLTEHVGALRGLIHGRVRLGEWKERLLHSPLQFVDAYIARSQQPMALVR

SEQ ID NO: 30932 - protein, 217 aa, Azoarcus sp. EbN1
MRLILLGPPGAGKGTQANFIKEKFGIPQISTGDMLRAAVKAGTPLGVEAKKVMDAGGLVSDDIIIGLVKDRLKEDDCKSGYMFDGFPRTIPQADAMKEAGVPIDFVLEIDVPDSEIIERMSGRRAHLASGRTYHVKYNPPKVAGKDDLTGEDLVQRDDDREETVAKRLEVYHSQTKPLVEYYSKWAASGEPGTPKVRKISGLGAVDEITSRAFAALK

SEQ ID NO: 30933 - protein, 389 aa, Azoarcus sp. EbN1
MSHLMNTYARLPVAFTHGEGVWLFDETGKRYLDGLSGIAVSTLGHNHPRLVRAIAGQAAKVLHTSNIYRIPLQEELSDRLAAVSGMDEVFFCNSGCEANEAAIKLARFHGHRKGIEQPAIVVMENAFHGRTLATLSATGNRKTQAGFEPLVSGFLRVPYKDIGAIRTVGEHNHNIVAVMLEMIQGEGGVNIADETFQRDLRALCDERGWLLICDEVQCGMGRTGSWFGFQQGGVTPDVMTLAKGLGSGVPIGACVTSGRAAGLFGPGNHGSTFGGNPLACAAGLETLATIEDDGLMANAVKVGEAIRTGLQEALAGLSGVVDIRGRGLMIGIELDRPCGDLVRQALDAGLLINVTADRVIRLLPALVFTEANAQELVSRLAPLVRKHLE

SEQ ID NO: 30934 - protein, 452 aa, Azoarcus sp. EbN1
MRKIDVHELIDKAKFNRFHWQVLFWCALIIIFDGYDLVIYGVVLPVLMKEWDLTPLQAGTLGSYALFGMMFGALIFGPLSDRFGRKRVIAICVMLFSFFTFINGFATTPTEFAICRFIAGLGIGGVMPNVVALMTEYSPKKLRTTLVAIMFSGYSVGGMLSAGLGMYLIPNFGWPSVFFVAGVPLLLLPVILYALPESIGFLLHAKRDAEAGVLLGRVEPNFAARTGDRYEMPTGKTSHVSLVALFKDGRALSTLMFWLAFFMCLLMVYALASWLPKLMTQAGYGLGSSLSFLLVLNFGAIFGAIGGGFIADRLHLKTVLMVFFVIAAFSISLLGFKSPTAVLYLLVAAAGATTIGSQILLYAYVAQFYPMAIRSTGIGWASGVGRSGAIVGPILGGTLLGMAMPLEYNFMFFAIPGAIAAFAVSLVARSAAHAPSEELPLPFAAETGAISD

SEQ ID NO: 30935 - protein, 493 aa, Azoarcus sp. EbN1
MNAAETLLSAGVDTAIAIECDDEKVSYAVLRDRVSRAAGAWKTLGLQPGNRVIVFAPDSVDWVVAYLGAIWAGGVAIGVNPRLSMNEFAPILNECEPRFVWCETEQARALVAEARTVAEIVADGPGTSNWATHLAAAEAVAPLERATEDAALWIGTSGTTGVPKGVVHAQRTVTNAHSFACGILGLTAADRLYASSKLFFAYALGNSLFAGLRVGATVILDRQWPTAERVEYMVEKYRPTLLFSVPTLYRKMLQTGVARRIAQYGIRHCVSAGEALPLAVRQDWREATGHTLISGYGTSETLCLMLFSDDDSGLMRPTPLTEVRHADDVDPDVPQRVWIRHSAVALGYWERPEAQADGFRDGWFSPGDMFLRHADGRLEYTGRNDDMLKIAGQWVSTLWVEQSLASVCGETLHQIASVGVSSADGLTALAVLAVASPERRSEARQRMDEGIATLPGHRRPRWVHWLDELPLTPTGKLQRGRLRALHESAVAVS

SEQ ID NO: 30936 - protein, 480 aa, Azoarcus sp. EbN1
MKEYKLFIDGEWVGSSTETILDDLNPATSEVWGRVHQASAADLERAIAAAYRARESWGNTLANEREAILLRAADALQKRIPDVAAVLIDEAGSTYGKAMFEASFVVNLLRSAAGECRRITGETMPSDSPGVFSMSVRRPLGVIAGIAPFNFPFLLATKKVALALAAGNTFILKPASYTPVTGLKIAEIFEAAGLPKGVLNVVPVQGSVLGNTFVADPRVRMITFTGSTEVGRELSAEAGRHFKRITLELGGKSPMIVLKDADVDYAVNAAAFGIFLHQGQVCMANSRLIVEAPIFDVFCDKLATKIAGFKVGDPRDPQTVIGPLIDRKQCAVLDRHVADAVAKGAKLLHGGKSDGAFYQPTILAGVTPDMVVFREESFGPAVSVIRAADSEDALRLANDSCYGLSSGLITNDLQKAFDLSLRLEAGMVHINDSSIMDEPHVPFGGVKDSGFGREGGHHSMDEMTELKWITVQMGQRQFPF

SEQ ID NO: 30937 - protein, 421 aa, Azoarcus sp. EbN1
MEPAMEQTQYLVVGSSHAALEAISAIRMHDATGTLTVVTRDAHLPYSPTVLPYVVSGKSAPERVFLRDDDFFARNAVSYRPGAGLAALHADSNTAELADGTRLAYDKLLLATGTSPAIPPIPGIDTVSYHVLRTLDDALGLREAIAQSRQAVVLGAGLVGMHAAENLVKAGASVTIVEMSDQLTAGYFDKVAAQMIEQAFTDNGAKILTGSRVVRLEPSSVGARLTLANGQSLEADLLLVATGVKPNLEYLNGSGVAFDHGILVDDTMRTSVANVWAAGDCAQAKHFFSPTPRVNAILPSATEQGRLAGMAMAGDAGIKPYAGGVPLNTYHFFGRHAISVGSSEAPEGSEVLTRFDEKTGRYLKAIFRDGRLAGIFGVNEFFDGGIMCQLIVRRMDLTADKERLVADPLKVGRELMSRTWR

SEQ ID NO: 30938 - protein, 491 aa, Azoarcus sp. EbN1
MGDEAMEERFVNRMSMGKGWIGGWTDLDGGVLAVTEPATGERLAEVGLASAGDVRRAAQLAAEAQPAWAAMPFLKRAAIFRRAAVILEREQQAVADWIVRETGGIRPKAEGEVAAVINHLHEAAAMLTQPRGLILPSDEGTLSYARRVPHGVVGVISPFNFPFLLSSRSLTPALGAGNAVVLKPDPRTPVSGGLLLALLFEAAGLPPNLLQVLPGEAEAGEAVVTDPDITMISFTGSTAVGRRVGELAGRHLKKVALELGGKNSLIVLDDADVDLAVSNGAFASWMHQGQICMSAGRHLVHEKVADAYVERMARKAKSLPVGDPYREAVALGPLITAKQLDRVERIVSESVRAGARLKAGGTARGQCYSPTVLDGVTPSMPAFREEIFGPVVSVTTFASDDEAVRLANDTEYGLSAGILTRSMTRGKAIAERLRVGLVHINDQTVIDDGFMPMGGRGASGNGSRHGGPANWDEFTQWQWVTYRDTPPEYPF

SEQ ID NO: 30939 - protein, 371 aa, Azoarcus sp. EbN1
MTIKSRAAVAFGPKQPLQIVEVDVEPPKAGEALVRIVATGVCHTDAFTLSGDDPEGIFPAILGHEGGGIVEAVGEGVTSLEVGDHVIPLYTAECRECKFCKSGKTNLCQAVRATQGKGLMPDGTTRFSYNGQPIYHYMGTSTFSEYTVVPEISLAKIPKEAPLDKVCLLGCGVTTGIGAVLNTAKVEAGATVAIFGLGGIGLAAILGAKMAKASRIIGIDLNPAKSDLARQLGATDIVNPNDHAKPIQDVIVEMTDGGVDYSFECVGNVKLMRAALECCHKGWGESTIIGVAGAGQEICTRPFQLVTGRVWRGSAFGGVRGRTELPGYVEKAQRGEIPLDVFITHHLPLEDINRAFELMHEGQSIRSVIRF

SEQ ID NO: 30940 - protein, 331 aa, Azoarcus sp. EbN1
MARVVRFHEFGAPEVLKIEDLEVGEPGPGEMRIRVQVIGLNRAEAAFRAGQYIEKAQLPARLGYEAAGTVDALGQGVGGFEIGEAVCVIPEFSMNRYGVYAEQAIVPAAAVVKRPPGLSTAEAAAVWMPYLTAYGALIDVVRLGQGDAVVITAASSSVGLAAIQIANSVGAVPIAVTRTEAKRAELQAAGAAHVIVSQAQDIAAEVMRITGGDGARMVFDPVGGPSILPLVSALACQGTLVLYGNLSGEAHQTPFPFGLAVGRGLSLRGYLVFEIIHDPARLARAEAFIREGLRSGVLKPKIDRTFSLEKIVEAHRYLEGNQQLGKVVVTV

SEQ ID NO: 30941 - protein, 443 aa, Azoarcus sp. EbN1
MHAPSLLERSLRSVWHPCTQMKQHEALPLVPIVRGEGPWLIDAEGRRLLDGISSWWVNLFGHCNPRINAALRAQLDTLEHVMLAGFTHEPVVELSERLAALTGHRLGHAFYASDGASATEIALKMSAHYWRNLGLAEKSRFVSLAGSYHGETVGALAVTDVAIFRDAYAPLVRAGTTVPTPDARLALPGESAADVARRAAAALEAHLAEHHAQTAALIVEPLVQGASGMVMYDPEYLRLARALCDRYRVHLIADEIAVGCGRTGTFFACEQAGIWPDFLCLSKGISGGYLPLSLVLATNTVYAAFYADSATRAFLHSHSYTGNPLACRAALATLDIFEQDGVLAANRVLARQLGDAVRARFGAHPAVRQLRQRGMILAFDVATERPDFARNFFRAGLDHGVLLRPIGNTVYFMPPYILDAAHVAHLVDGAAAALAEALEPAPG

SEQ ID NO: 30942 - protein, 386 aa, Azoarcus sp. EbN1
MTPPIVIIGSGLAGYTLAREFRKLDRDTPLVILSRDAAGFYSKPMLSNAFSANRSAASLVMKPAEKMAAELAATIRSHVEVAALHPARRIVELAGGEEIPYRNLVLAPGADPIRLPLGGDAAADVLSVNDLDDFARFAARLDGAKRVAVLGGGLIGCEFANDLLARGITPTVIDIARWPLGRLLPEDAGQWFRQRLEAAGVSFRLGVSAASVSRHAGGYRLALSDGSTLDADVVLSAVGLRPRTALAAAAGLAVNRGVLTDRRLASSDPHIHALGDCVEVEGLTLPYVMPIMHQARALAATLAGTPTAVNYPAMPVVVKTPACPAVVCPPAINAQGSWQVVASDEAGGGIEAQYLDANEKLLGFVLLGSATARKQMLAGRAPATLD

SEQ ID NO: 30943 - protein, 429 aa, Azoarcus sp. EbN1
MSAIVDIIAREILDSRGNPTVEADVLLESGVMGRAAVPSGASTGSREAIELRDGDAARYLGKGVLQAVENVNTEISETLIGLDAEEQAFIDRTLIELDGTENKSRLGANATLAVSMAIAKAAAEEAGLPLYRYFGGSGPMAMPVPMMNVINGGAHANNSLDIQECMIMPVSMTSFREALRCGAEIFHHLKKLTDKKGYPTTVGDEGGFAPNVGGTEEALNMIQDAIAAAGYEPGRDVLLALDCAASEFYKDGQYVLAGEGLTLSSEGFADYLATLADRFPIVSIEDGMAENDWAGWKTLTDKLGRRLQLVGDDLFVTNTRILEQGIDQGVANSILIKINQIGTLSETFAAVEMAKRAGYTAVISHRSGETEDSTIADIAVGLNAMQIKTGSLSRSDRISKYNQLLRIEEDLGDTVSYPGRRAFYNLRVR

SEQ ID NO: 30944 - protein, 354 aa, Azoarcus sp. EbN1
MSIEIRNISKRFGNFVALDDLSLDIPTGELVALLGPSGCGKTTLLRIIAGMESPDGGNVLFGGEEATHVHARERQVGFVFQHYALFRHMSVFENVAFGLRVRPRKTRPPEAEIRERVMNLLKLVQLDWLANRYPSQLSGGQRQRIALARALAVEPKVLLLDEPFGALDTKVRKELRRWLRRLHDEMHISSVFVTHDQEEALEVADRVVVMNRGHIEQIGSPDEVYSSPASPFVYQFLGNVNVFHNRMHGGWAEVEREGEAPGAGSIAFVRPHDIDLDLAPLSGGMQARVSHVHRIGPLVRVELEHEAETIEVELTRERAANLELSPGHPVWFKPRQAKVFAAGAAPATKQPFLF

SEQ ID NO: 30945 - protein, 458 aa, Azoarcus sp. EbN1
MLLANGGQLPQGIRFVPAWSDLRSTFEDGRNMPSQRQKQFSVLLMSTTAFTMCFAAWMLFAVIGIPIKAQLGLNETQFGLLAATPVLTGSLVRLPLGLLTDKLGGRVVFFLLMLAAVVPIYLIGEATQYWQFLVAGLFVGLIGGSFSVGIAYCARWFERKNQGFAMGVFGAGNSGAALTKFVAPALVVAYGWQFVPKAFAVAMLIIAIAFWFFTYDDPKHRVSSSVKFSDQLRVLKNPRVWKYCQYYSIVFGGYVALALWMTKYYVAEFGLGLETAALLAACFSLPGGVLRAVGGWFSDRFGAHKVTWWVMWVSWVCLFLLSYPHTEFTIMTVAGPKTFAIHHNIWFFTVLMFTVGVAWAFGKASVFKYISDEFPHDIGAVSGIVGLVGGLGGFLLPIMFGALLDLTGVRSSAFMLLYGVTWVSLIWMYWTEVRRTDVMHGGEADVLHGGTAPVTATK

SEQ ID NO: 30946 - protein, 463 aa, Azoarcus sp. EbN1
MSAPILFPLSAPESSFTIAGRLFHHAWPVLVAQLLSMSMLIADTVITGRYGTLDLAAVAVGSGVYISIVMLLVGVLQAVAPTVAHHFGARRVDAIGPALQQGFWLALMLALPGIALLAFPGFLLELSSVPADVAGKTRDYLLATAFGLPAVLLYRTFYAFNNALGRPRALMMISFIVTSTHIPLAWALVHGAFGLPPLGAIGCGISTAIVNWIAFACGAGYLAHNRDYRPYRLFANWQPPRRRDLLALLKLGIPMGLSTFIEVSSFTLIALFAARLGAEAVAGHRVVANLAALIYMLPLAISIAILVLVGQAAGAREPARARATVRVGMGLTVGLVALIGVLLWVGREPVVALFSADPAVRAVALGLVFYICIYQIFDAVQTVAAHALRGYKVTFMPMLLHALCFWGIALAGGYWLAFHAPGREQSPTVAGFWEASVVATILASVLFGWLLRVVMRRPQNVQT

SEQ ID NO: 30947 - protein, 398 aa, Azoarcus sp. EbN1
MNPNLDRLQSYPFEKLRKLFEGLTPPAGLDTIRLSIGEPRHATPAFITQALVDNLDGLSAYPATQGSDALRGAIAGWLERRYGLPAVDVATQVLPVNGSREALFAFAQCVVDSRGGAAKVLCPNPFYQIYEGAALLAGAEPVFLNNLPENRFGSDFDSLPESVWRDVQLAFVCSPGNPTGRVLSLQEWARLFELSDRHGFVIAADECYSEIYFDENAPPVGALQAAHQLGRGDFRNLVTFSSLSKRSNVPGMRSGFVAGDAAVLKAFLRYRTYHGCAMNPAVQAASVAAWNDEAHVVDNRRLYREKFDRVTALVARHLKVERPDAGFYLWAQTPIPDTEFARRLQGEYNVTVLPGSFLAREANGVNPGAGFVRIALVAPTAECVEAAERIAAFCQSLP

SEQ ID NO: 30948 - protein, 162 aa, Azoarcus sp. EbN1
MSVPANVFDFETRRLNGAPMPLAEFRGKVLLLVNTASECGFTPQYEALQELHDRFAPRGFSVIGFPCNQFGGQEPGGAEEIAAFCAKNYGVSFPLSEKIDVNGDNAHPLYRHLTSVAPGILGTEAIKWNFTKFLVDRDGQVVARFAPATKPESIARDIEALL

SEQ ID NO: 30949 - protein, 177 aa, Azoarcus sp. EbN1
MSIDLQQDFFALFGLPRRFRVDEAALEMAYHDLQGQVHPDRFAHLPDVEKRLSMQWATRVNEGFRTLRKPLPRAQYMLELAGVDAGLHTNTAMSSAFLMEQMEWREAVEEARAAGEGHELTQLHHRLRHHAREVFDELERTIDERHDFAAAAEIVRRLMFMEKIQHEIDDALEALET

SEQ ID NO: 30950 - protein, 455 aa, Azoarcus sp. EbN1
MAKAKTVFSCTECGAQAPRWQGQCPQCKAWNTLVEAVAEAGGGSRFAALAGSTAQLQTLAELEPREEPRTPTGIDEFDRVLGGGLVAGGVVLIGGDPGIGKSTLLLQALSVLAGRHKAIYVSGEESGEQVALRAQRLQLDPAGLQLLAEINLERILAMLRDERPRIVVIDSIQTVYSEVLQSAPGSVAQVRECAAQLTRYAKQSGTCMIMVGHVTKDGTLAGPRVLEHMVDTVLYFEGDTHSSFRLVRAFKNRFGAVNELGVFAMTERGLRGVSNPSALFLSQHSQQVSGSCVLVTQEGTRPLLVEIQALVDGTHSPNPRRLSVGLEQNRLAMLLAVLHRHAAVVCFDQDVFVNAVGGVKIAEPAADLAVLLAIVSSLRNRPLPRELVVFGEVGLAGEIRPAPRGQERLREAAKLGFTTAIIPKANAPRQALGDMQVIAVDRIEEAIDRARELEG

SEQ ID NO: 30951 - protein, 259 aa, Azoarcus sp. EbN1
MSDGPVIELRGIVTRFGSNLVHDGIDLSVARGEVVALVGGSGSGKTTLLRHMIGLTRPARGEVSLFGEQLFSGSLPVQRARRRRFGVLFQQGALFSALNVAENIGFPLRELRVVTPMEIRDLVALKLAMVELEPSTALLMPAELSGGMVKRVALARALALEPELLLLDEPTAGLDPDRSAAFVELVRSLQAQLGLTVVLVTHDIDTLAALSSKVAILAERRIISYAPLEETMELDHPFVASFFRGELGRRAIARSRGET

SEQ ID NO: 30952 - protein, 486 aa, Azoarcus sp. EbN1
MRVIQKALTFDDVLLVPAHSTVLPRDVSLKAQLTRNIRINIPLVSAAMDTVTESRLAIALAQEGGIGILHKNLAVKQQAAMVAKVKRFESGVLKDPITIPPTMSVRDVMALTRLHKFSGLPVVENKRVVGIVTNRDVRFETNLDQPVAAIMTPFERLVTVKEGDSLEEARRLMHKHRLERVLVLNDAAELRGLITVKDMMKSTEHPLAAKDDLGRLRVGAALGVGAGTEERAEALVEAGVDVVVVDTAHGHSQGVLDRIRWVKKNFPHVEVIGGNIATAAAAKALVDCGADAVKVGIGPGSICTTRIVAGVGVPQVTAIDNVATALAGTNVPLIADGGIRYSGDISKAIAAGANVVMLGGLFAGTEEAPGETVLYQGRSYKSYRGMGSLAAMQQGAADRYFQESDGNADKLVPEGIEGRVPYKGSVTAVIHQLIGGLRASMGYLGCESIAAMHERAQFVEITSAGVRESHVHDVQITKEAPNYHVD

SEQ ID NO: 30953 - protein, 476 aa, Azoarcus sp. EbN1
MADKQFDVLVIGGGPGGYVAAIRAAQLGFKTACAESNPYADPKGEPRLGGTCLNVGCIPSKALLHTSHLFEEAEHAFPTQGIRLEGKVSIDVPVMIGRKNKVVDQLTSGIKGLFKKNKVTFLAGHGSFEGNGPAGYVVRVGAETVEARHVIIATGSKPRHLPGIPVDNRIVCDNVGALDFDSVPKKLGVIGAGVIGLEMGSVWRRLGAEVTVLEALPDFMPFADMDVAKEALKVFTKQGLDIRTGVTIGETKVGADGVSLAYTGKDGKEARLECERLIVSVGRVPNTEGLNASTVGLDVSDRGQIVVDGHCRTNLPNVYAVGDVVRGPMLAHKAMEEAVMVAEIIAGQAGHANLDTVPGVIYTSPEIAWVGKSEQQLKAEGVAYRAGKIPFMANGRALGSGDPTGFVKMLADADTDRILGVHIIGANASELISEAVVAMEFGGAAEDLARICHAHPTLSEVVHEAALAVDKRPLHF

SEQ ID NO: 30954 - protein, 511 aa, Azoarcus sp. EbN1
MKARRVYAGWPKPAHFDRNLVVIGAGAAGLVSSYIAAAVKAKVTLVEKHRMGGDCLNTGCMPSKALIRSAKLLSHMRRSNEFGIRSARAEFDFADVMERVHAIIKTVEPHDSVERYTSLGVEVIEGRAKIVSPWEVEIARNDGRHETLTTRSIIIAAGARPTVPPIPGIEDVGYYTSDTIWTLHALPRRLLVLGGGPIGSELAQTFARFGAAVTLVVKGRRIMPREDAEVSEMVMARFRAEGIDLRTGHDTRRFVVENGEKILIAEHQGQEVHVPFDVLLVAVGRSAQLKGYGLEELGVPTGRTIDVNEYLQTSFPNIYAAGDVAGPYQFTHTAAHQAWYASVNALFAPFRKFRADYSAVPWATFVDPEVARVGLNEQEARERDIPFELTRFDIADLDRAIADGEAHGFVKVLTVPGKDRILGVTIVGEHAGDLIAEYVMAMRHGLGLNKILGTIHIYPTLAEANKYAAGEWKRAHAPQKLLEWVGRFHAWRRGSGGRPTAAARPATPSQR

SEQ ID NO: 30955 - protein, 409 aa, Azoarcus sp. EbN1
MQNSPLHHFDFRFVLLEGIHATAVETLGTSGYSRVDARPGALTGDDLIHAVADADFVGIRSRTRLTEEVLTHAPKLLGIGCFCIGTNQVDLEAAALLGIPVFNAPFSNTRSVAELVLAEIVMLMRGIPEKNALLHRGGWMKSASNSWEIRGKTLGIVGYGHIGTQVGVLAEHFGMKVVYHDIEAKLSLGNAHQLGSLEDLLAASDVVSLHVPETPATRNMMDAARLAAMKPGSFLINASRGTVVDIDALADALGSGHVLGAAIDVFPAEPKSNDEPFVSPLLRFDNVILTPHIGGSTAEAQANIGREVAAKLARYANNGSTVSAVNFPEVSLPAHEGQCRVMHIHHNVPGMLARINERISKAGLNIVAQYLQTTQHVGYVVIDVDAEARQVAFDELNAIDGTIRCRLIC

SEQ ID NO: 30956 - protein, 1114 aa, Azoarcus sp. EbN1
MDLLPAMAAPDKETDDGLWYKDAVVYELHVKAFFDANDDGVGDFNGLTRKLDYIRDLGVNTIWLLPFYPSPLKDDGYDVADYHGVLPAYGTRADFRQFVREAHRRGLRVITELVVNHTSDQHAWFQAARRAPAGSSKRNYYVWSDDPTRYSGTRIIFTDTETSNWAWDPVAKSYYWHRFFSHQPDLNFENPNVLKAVLRTMRFWLDMGVDGFRLDAIPYLREREGTNNENLPETHDVIREIRKCIDAHYRGRVLLAEANQWPEDVREYFGDGDECHMAYHFPLMPRLFMAVAQEDRFPVVDIMRQTPDIPENCQWAIFLRNHDELTLEMVTDRERDYMWQFFANDPRMRINVGIRRRLAPLLENSRDRVELMSFLLLTMPGSPILYYGDELGMGDNVFLGDRDGVRTPMQWTPDRNAGFSRADPQQLYLPPIMDPIYGFQAINVEAQARNPHSLLNFTRRLIAMRNSSRAFGRGMLRFLEPGNRKVLAYLREYRDQSVLCVANLARTPQAVELDLARFEGRVPVEIVGRVPFPPVGKLPYLLTLAGHGFFAFELSADAPPPNWHEERLPQTELPILVLTEGWRTFFRGHQGGSAVRRAIATRSRDQLQNEVLLPYLQARRWFAAKGETVTRIEVVEEQEWAAGGGNWLLALLEVSLASGSSHLYFLPLGIAWETAGDNPVDRFGAAALARVREKARIGILYDAFIDPVYCRALGQSMGGGGPQPLGGGSLRFTASEHYARFAEALGDEVRQPLQEQTNTGVFFGSRLYLKGYRRLQFGTNPEIEVGYFLGSAPEFSRVAAVAGSVEYIAPDGRVAALAMLQEFVDNQGNAWDYTLNHLDRLFSPDTWPAAAADEPEAEGMDRVYLLLAQTLGRRIGEMHAAFAHGTDPAFVPEPLGDAEVEAWRAQVIGDVERTLSLLEAALPRLDERARDEARQVLAAHHLLVARLAGLDLASPGLVKTRLHGDLHLGQVLIVQNDFVIVDFEGEPARSIDERRCRHSPLRDVAGMLRSFDYAVRTVGYHHLQARPEHAEALARALPEWKEGVVRSFMQAYGEVVAPLPSVPPDAAVAADFVTLFVIEKLLYELRYELDNRPEWVRIPLSALAEIAASPQGSH

SEQ ID NO: 30957 - protein, 376 aa, Shigella flexneri 2a str. 301
MAKQDYYEILGVSKTAEEREIRKAYKRLAMKYHPDRNQGDKEAEAKFKEIKEAYEVLTDSQKRAAYDQYGHAAFEQGGMGGGGFGGGADFSDIFGDVFGDIFGGGRGRQRAARGADLRYNMELTLEEAVRGVTKEIRIPTLEECDVCHGSGAKPGTQPQTCPTCHGSGQVQMRQGFFAVQQTCPHCQGRGTLIKDPCNKCHGHGRVERSKTLSVKIPAGVDTGDRIRLAGEGEAGEHGAPAGDLYVQVQVKQHPIFEREGNNLYCEVPINFAMAALGGEIEVPTLDGRVKLKVPGETQTGKLFRMRGKGVKSVRGGAQGDLLCRVVVETQIGLDEKDKQLLHELHESYGGPTGEHNSPRSKSFFDGVKKFFDDLTR

SEQ ID NO: 30958 - protein, 457 aa, Shigella flexneri 2a str. 301
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 30959 - protein, 214 aa, Shigella flexneri 2a str. 301
MRIILLGAPGAGKGTQAQFIMEKYGIPQISTGDMLRAAVKSGSELGKQAKDIMDAGKLVTDELVIALVKERIAQEDCRNGFLLDGFPRTIPQADAMKEAGINVDYVLEFDVPDELIVDRIVGRRVHAPSGRVYHVKFNPPKVEGKDDVTGEELTTRKDDQEETVRKRLVEYHQMTAPLIGYYSKEAEAGNTKYAKVDGTKQVAEVRADLEKILG

SEQ ID NO: 30960 - protein, 458 aa, Shigella flexneri 2a str. 301
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGYGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFVAFKTLRRK

SEQ ID NO: 30961 - protein, 250 aa, Shigella flexneri 2a str. 301
MAVTKLVLVRHGESQWNKENRFTGWYDVDLSEKGVSEAKAAGKLLKEEGYSFDFAYTSVLKRAIHTLWNVLDELDQAWLPVEKSWKLNERHYGALQGLNKAETAEKYGDEQVKQWRRGFAVTPPELTKDDERYPGHDPRYAKLSEKELPLTESLALTIDRVIPYWNETILPRMKSGERVIIAAHGNSLRALVKYLDNMSEEEILELNIPTGVPLVYEFDENFKPLKRYYLGNADEIAAKAAAVANQGKAK

SEQ ID NO: 30962 - protein, 231 aa, Shigella flexneri 2a str. 301
MFRKLAAECFGTFWLVFGGCGSAVLAAGFPELGIGFAGVALAFGLTVLTMAFAVGHISGGHFNPAVTIGLWAGGRFPAKEVVGYVIAQVVGGIVAAALLYLIASGKTGFDAAASGFASNGYGEHSPGGYSMLSALVVELVLSAGFLLVIHGATDKFAPAGFAPIAIGLALTLIHLISIPVTNTSVNPARSTAVAIFQGGWALEQLWFFWVVPIVGGIIGGLIYRTLLEKRD

SEQ ID NO: 30963 - protein, 461 aa, Shigella flexneri 2a str. 301
MAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYEGDRTPVSET

SEQ ID NO: 30964 - protein, 472 aa, Shigella flexneri 2a str. 301
METNIVEVENFVQQSEERRGSAFTQEVKRYLERYPNTQYVDVLLTDLNGCFRGKCKPVSSLYKLDTRRYLVASIFALNILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGDLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDTEGEDSPLLKKMLAGMIDLMPSSMALLAPNVNSYRRFQPGMYVPTQASWGHNNRTVALRIPCGDRHNHRVEYHVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 30965 - protein, 495 aa, Shigella flexneri 2a str. 301
MNFHHLAYWQDKALSLAIENRLFINGEYTAAAENETFETVDPVTQAPLAKIARGKSVDIDRAVSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQKAASATAAGIFYNQGQVRIAGTRLLLEESIADEFLALLKQQAQNWQPGHPLDPATTMGTLIDSAHADSVHTFIREGEGKGQLLLDGRNAGLAAAIGPTIFVDVDPNASLSREEIFGPVLVVTRFTSEDQALQLANDSQYGLGAAVWTRDLSRAHRMSRRLKAGSVFVNNYNDGDMTVPFGGYKQSGNGRDKSLHALEKFTELKTIWISLEA

SEQ ID NO: 30966 - protein, 459 aa, Shigella flexneri 2a str. 301
MEQITKPHCGARLDRLPDCRWHSSMFAIVAFGLLVCWSNAVGGLILAQLKALGWTDNSTTATFSAITTAGMFLGALVGGIIGDKTGRRNAFILYEAIHIASMVVGAFSPNMDFLIACRFVMDVGLGALLVTLFAGFTEYMPGRNRGTWSSRVSFIGNWSYPLCSLIAMGLTPLISAEWNWRVQLLIPAILSLIATALAWRYFPESPRWLESRGRYQEAEKVMRSIEEGVIRQTGKPLPPVVIADDGKAPQAVPYSALLTGVLLKRVILGSCVLITMNVVQYTLINWLPTIFMTQGINLKDSIVLNTMSMFGAPFGIFIAMLVMDKIPRKTMGVGLLILIAVLGYIYSLQTSMLLITLIGFFLITFVYMYVCYASAVYVPEIWPTEAKLRGSGLANAVGRISGIAAPYAVAVLLSSYGVTGVFILLGAVSNIVAIAIATIGIETKGVSVESLSIDAVANK

SEQ ID NO: 30967 - protein, 311 aa, Shigella flexneri 2a str. 301
MGLGTWAIGGGPAWNGDLDRQICIDTILEAHRCGINLIDTALGYNFGNSEVIVGQALKKLPREQVVVETKCGIVWERKGSLFNKVGDRQLYKNLSPESIREEVEASLQRLGIDYIDIYMTHWQSVPPFFTPIAETVAVLNELKAEGKIRAIGAANVDADHIREYLQYGELDIIQAKYSILDRAMENELLPLCRDNGIVVQVYSPLEQGLLTGTITRDYVPGGARANKVWFQRENMLKVIDMLEQWQPLCARYQCTIPTLALAWILKQSDLISILSGATAPEQVRENVAALNINLSDADATLMREMAEALER

SEQ ID NO: 30968 - protein, 470 aa, Shigella flexneri 2a str. 301
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEKGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 30969 - protein, 480 aa, Shigella flexneri 2a str. 301
MSKRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPTDVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVPFDSANDGVAAASEAVNLLRDKGYLMSGDLVIVTQGDVMSTVGSTNTTRILTVE

SEQ ID NO: 30970 - protein, 266 aa, Shigella flexneri 2a str. 301
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITAALQQKRENNRSDDYESFSRSI

SEQ ID NO: 30971 - protein, 304 aa, Shigella flexneri 2a str. 301
MSWIERIKSNITPTRKASIPEGVWTKCDSCGQVLYRAELERNLEVCPKCDHHMRMTARNRLHSLLDEGSLVELGSELEPKDELKFRDSKKYKDRLASAQKETGEKDALVVMKGTLYGMPVVAAAFEFAFMGGSMGSVVGARFVRAVEQAQEDNCPLICFSASGGARMQEALMSLMQMAKTSAALAKMQERGLPYISVLTDPTMGGVSASFAMLGDLNIAEPKALIGFAGPRVIEQTVREKLPPRFQRSEFLIEKGAIDMIVRRPEMRLKLASILAKLMNLPAPNPEAPREGVVVPPVPDQEPEA

SEQ ID NO: 30972 - protein, 412 aa, Shigella flexneri 2a str. 301
MADTRPERRFTRIDRLPPYVFNITAELKMAARRRGEDIIDFSMGNPDGATPPHIVEKLCTVAQRPDTHGYSTSRGIPRLRRAISRWYQDRYDVEIDPESEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKCYDVLVVHDLAYADIVYDGWKAPSIMQVPGARDVAVEFFTLSKSYNMAGWRIGFMVGNKTLVSALARIKSYHDYGTFTPLQVAAIAALEGDQQCVRDIAEQYKRRRDVLVKGLHEAGWMVEMPKASMYVWAKIPEPYAAMGSLEFAKKLLNEAKVCVSPGIGFGDYGDTHVRFALIENHDRIRQAIRGIKAMFRADGLLPVSSKHIHENAE

SEQ ID NO: 30973 - protein, 303 aa, Shigella flexneri 2a str. 301
MSTLEQTIGNTPLVKLQRMGPDNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMANRGEGKLLDQFNNPDNPYAHYTTTGPEIWQQTGGRITHFVSSMGTTGTITGVSCFMREQSKPVTIVGLQPEEGSSIPGIRRWPAEYLPGIFNAALVDEVLDIHQRDAENTMRELAVREGIFCGVSSGGAVAGALRVAKANPGAVVVAIICDRGDRYLSTGVFGEEHFSQGAGI

SEQ ID NO: 30974 - protein, 488 aa, Shigella flexneri 2a str. 301
MLRIAKEALTFDDVLLVPAHSTVLPNTADLSTQLTKTIRLNIPMLSAAMDTVTEARLAIALAQEGGIGFIHKNMSIERQAEEVRRVKKHESGVVTDPQTVLPTTTLREVKELTERNGFAGYPVVTEENELVGIITGRDVRFVTDLNQPVSVYMTPKERLVTVREGEAREVVLAKMHEKRVEKALVVDDEFHLIGMITVKDFQKAERKPNACKDEQGRLRVGAAVGAGAGNEERVDALVAAGVDVLLIDSSHGHSEGVLQRIRETRAKYPDLQIIGGNVATAAGARALAEAGCSAVKVGIGPGSICTTRIVTGVGVPQITAVADAVEALEGTGIPVIADGGIRFSGDIAKAIAAGASAVMVGSMLAGTEESPGEIELYQGRSYKSYRGMGSLGAMSKGSSDRYFQSDNAADKLVPEGIEGRVAYKGRLKEIIHQQMGGLRSCMGLTGCGTIDELRTKAEFVRISGAGIQESHVHDVTITKESPNYRLGS

SEQ ID NO: 30975 - protein, 472 aa, Shigella flexneri 2a str. 301
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGAAFLTLLDSIGAAGTFWLYTALNIAFVGITFWLIPETKNVTLEHIERKLMAGEKLRNIGV

SEQ ID NO: 30976 - protein, 477 aa, Shigella flexneri 2a str. 301
MKKLTLPKDFLWGGAVAAHQVEGGWNKGGKGPSICDVLTCGAHGVPREITKEVLPGKYYPNHEAVDFYGHYKEDIKLFAEMGFKCFRTSIAWTRIFPKGDEAQPNEEGLKFYDSLFDELLKYNIEPVITLSHFEMPLHLVQQYGSWTNRKFVDFFVRFAEVVFERYKHKVKYWMTFNEINNQRNWRAPLFGYCCSGVVYTEHDNPEETMYQVLHHQFVASALAVKAARRINPEMKVGCMLAMVPLYPYSCNPDDVMFAQESMRERYVFTDVQLCGYYPSYVLNEWERRGFNIKMEDGDLDVLREGTCDYLGFSYYMTNAVKAEGGTGDAISGFEGSVPNPYVKASDWGWQIDPVGLRYALCELYERYQRPLFIVENGFGAYDKVEEDGSINDDYRIDYLRAHIEEMKKAVTYDGVDLMGYTPWGCIDCVSFTTGQYSKRYGFIYVNKHDDGTGDMSRSRKKSFNWYKEVIASNGEKL

SEQ ID NO: 30977 - protein, 451 aa, Shigella flexneri 2a str. 301
MTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 30978 - protein, 429 aa, Shigella flexneri 2a str. 301
MKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGVFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 30979 - protein, 382 aa, Shigella flexneri 2a str. 301
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLASEQSAAICEELANFDYLYLSGISLAILSPTSREKLLSLLRECRAKGGKVIFDNNYRPRLWASKEETQQVYQQMLECTDIAFLTLDDEDALWGQQPVEDVIARTHNAGVKEVVVKRGADSCLVSIAGEALVDVPAVKLPKEKVIDTTAAGDSFSAGYLAVRLTGGSAENAAKRGHLTASTVIQYRGAIIPREAMPA

SEQ ID NO: 30980 - protein, 445 aa, Shigella flexneri 2a str. 301
MSHQHTTQTSGQRMLERVFKLREHGTTARTEVIAGFTTFLTMVYIVFVNPQILGVAGMDTSAVFVTTCLIAAFGSIMMGLFANLPVALAPAMGLNAFFAFVVVQAMGLPWQIGMGAIFWGAVGLLLLTIFRVRYWMIANIPVSLRVGITSGIGLFIGMMGLKNAGVIVANSETLVSIGNLTSHSVLLGILGFFIIAILASRNIHAAVLVSIVVTTLLGWMLGDVHYNGIVSAPPSVMTVVGHVDLAGSFNLGLAGVIFSFMLVNLFDSSGTLIGVTDKAGLADEKGKFPRMKQALYVDSISSVTGSFIGTSSVTAYIESSSGVSVGGRTGLTAVVVGLLFLLVIFLSPLAGMVPDYAAAGALIYVGVLMTSSLARVNWQDLTESVPAFITAVMMPFSFSITEGIALGFISYCVMKIGTGRLRDLSPCVIIVALLFILKIVFIDAH

SEQ ID NO: 30981 - protein, 439 aa, Shigella flexneri 2a str. 301
MLPFLKAPADAPLMTDKHEIDARYRYWRRHILLTIWLGYALFYFTRKSFNAAVPEILANGVLSRSDIGLLATLFYITYGVSKFVSGIVSDRSNARYFMGIGLIATGIMNILFGFSTSLWAFAVLWVLNAFFQGWGSPVCARLLTAWYSRTERGGWWALWNTAHNVGGALIPIVMAASALHYGWRAGMMIAGCMAIVVGIFLCWRLRDRPQALGLPAVGEWRHDALEIAQQQEGAGLTRKEILTKYVLLNPYIWLLSFCYVLVYVVRAAINDWGNLYMSETLGVDLVTANTAVTMFELGGFIGALVAGWGSDKLFNGNRGPMNLIFAAGILLSVGSLWLMPFASYVMQATCFFTIGFFVFGPQMLIGMAAAECSHKEAAGAATGFVGLFAYLGASLAGWPLAKVLDTWHWSGFFVVISIAAGISALLLLPFLNAQTPREA

SEQ ID NO: 30982 - protein, 298 aa, Shigella flexneri 2a str. 301
MIRVACVGITVMDRIYYVEGLPTESGKYVARNYTEVGGGPAATAAVAAARLGAQVDFIGRVGDDDAGNSLLAELESWGVNTRYTKRYNQAKSSQSAIMVDTKGERIIINYPSPDLLPDAEWLEEIDFSQWDVVLADVRWHDGAKKAFTLARQAGVMTVLDGDITPQDISELVALSDHAAFSEPGLARLTGVKEMASALKQAQTLTNGHVYVTQGSAGCDWLENGGRQHQPAFKVDVVDTTGAGDVFHGALAVALATSGDLAESVRFASGVAALKCTRPGGRAGIPDCDQTRSFLSLFV

SEQ ID NO: 30983 - protein, 386 aa, Shigella flexneri 2a str. 301
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLCRFLGGLSLFTLAESLGGVESLISHAATMTHAGMAPEARAAAGISETLLRISTGIEDGEDLIADLENGFRAANKG

SEQ ID NO: 30984 - protein, 444 aa, Shigella flexneri 2a str. 301
MGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIESCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 30985 - protein, 327 aa, Shigella flexneri 2a str. 301
MATRIEFHKHGGPEVLQAVEFTPADPAENEIQVENKAIGINFIDTYIRSGLYPPPSLPSGLGTEAAGIVSKVGSGVKHIKAGDHVVYAQSALGAYSSVHNINADKAAILPAAISFEQAAASFLKGLTVYYLLRKTYEIKPDEQFLFHAAAGGIGLIACQWAKALGAKLIGTVGTAQKAQSALKAGAWQVINYREENLVERLKEITGGKKVRVVYDSVGRDTWERSLDCLQRRGLMVSFGNSSGAVTGVNLGILNQKGSLYVTRPSLQGYITTREELTEASNELFSLIASGVIKVDVAEQQKYPLKDAQRAHEILESRATQGSSLLIP

SEQ ID NO: 30986 - protein, 353 aa, Shigella flexneri 2a str. 301
MLYTSQTTPEKAPKMSMIKSYAAKEAGGELEVYEYDPGELKPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALSGQFDLIINTVNVSLDWQPYFEALTYGGNFHTVGAVLTPLSVPAFTLIAGDRSISGSATGTPYELRKLMRFAARSKVAPTTELFPMSKINDAIQHVRDGKARYRVVLKADF

SEQ ID NO: 30987 - protein, 460 aa, Shigella flexneri 2a str. 301
MAKAPKRAFVCNECGADYPRWQGQCSACHAWNTITEVRLAASPTVARNERLSGYAGSAGVAKVQKLSDISLEELPRFSTGFKEFDRVLGGGVVPGSAILIGGNPGAGKSTLLLQTLCKLAQQMKTLYVTGEESLQQVAMRAHRLGLPTDNLNMLSETSIEQICLIAEEEQPKLMVIDSIQVMHMADVQSSPGSVAQVRETAAYLTRFAKTRGVAIVMVGHVTKDGSLAGPKVLEHCIDCSVLLDGDADSRFRTLRSHKNRFGAVNELGVFAMTEQGLREVSNPSAIFLSRGDEVTSGSSVMVVWEGTRPLLVEIQALVDHSIMANPRRVAVGLEQNRLAILLAVLHRHGGLQMADQDVFVNVVGGVKVTETSADLALLLAMVSSLRDRPLPQDLVVFGEVGLAGEIRPVPSGQERISEAAKHGFRRAIVPAANVPKKAPEGMQIFGVKKLSDALSVFDDL

SEQ ID NO: 30988 - protein, 112 aa, Pseudotsuga menziesii var. menziesii
DVPEDIFHQSMGSFLQQAEEEISQIQVEEVKVFSHVKEITKYFHGNAVKEEAHPFRIFVVVRDFTSMLDRVCKEVGRLQKSRNPPISSQKGPSSTSDDKLSRSLFPTDFDRN

SEQ ID NO: 30989 - protein, 112 aa, Pseudotsuga menziesii var. menziesii
DVPEDIFHQSMGSFLQQSEEEISQIQVEEVKVFSHVKEITKYFHGNAVKEEAHPFRIFVVVRDFTSMLDRVCKEVGRLQKSRNPPISSQKGPSSTSDDKLSRSLFPTDFDRN

SEQ ID NO: 30990 - protein, 112 aa, Pseudotsuga menziesii var. menziesii
DVPEDIFHQSMGSFLQQAEEEISQIQVEEVKVFSHVKEITKYFHGNAAKEEAHPFRIFVVVRDFTSMLDRVCKEVGRLQKSRNPPISSQKGPSSTSDDKLSRSLFPTDFDRN

SEQ ID NO: 30991 - protein, 231 aa, Hordeum vulgare subsp. vulgare
TVESVGEGVTDVAPGDHVLAVFTGECKECPHCKSAESNMCDLLRINTDRGVMNRDGKSRFFIGGKPIYHFVGTSTFSEYTVMHVGCVAKINPEAPLDKVCVLSCGISTGLGASINVAKPPKGSTVAIFGLGSVGLATAEGARIAGASRIIGIDLNAFRFEEARKFGCTEFVNPKAHTKPVQQVLADMTNGGVDRSVECTGNVNAMIQAFECVHDGWGVAVLVGVPHKDAEF

SEQ ID NO: 30992 - protein, 206 aa, Nicotiana tabacum
VRLATRSLQYEARERPNAKSLVNSLMTIQKETEVPSHVLLGIRHGTATPPQPLLLTTTGEACLRMDLTALHEILQETGYKDDEGIANELSFQMWTNQMQETLNSKQQGDAAFRAKDSITAIECYTQFNDGGTMVSPTIYARRCLCYLMSDMAQEALGDAMQAQVISPEWPTAFYLQSVALFSLGMENDAQEALKQATKLEAKRNKN

SEQ ID NO: 30993 - protein, 178 aa, Musa acuminata
CGPGHGIRIGSLGKQNTRACVANITVKNAVIKHSDNGVRIKTWQGGSGSVSSISFENIRMDTVRNPIIIDQYYCLSKSCLNQTSAVYVSDVSYTGIRGTYDVRSPPIHLACSDSVPCTNITLSEVELLPAQGDSISDPFCWNAYGATETLTIPPVSCLSEGLPQSIIDIDSDKCYRGS

SEQ ID NO: 30994 - protein, 231 aa, Pseudomonas putida
QSAVVSYAKGAAQLDLDPGTASDALTAVVAGLGYRATLADTSSTDNRTGLHDKVRGWMGTADKGSDGERQLHIAVIGSGGAAMAAALKAVEQGAKVTLIERGTIGGTCVNVGCVPSKIMIRAAHIAHLRRESPFDGGMPPTPPTILRERLLAQQQARVEELRHAKYEGILDGNSAITVLHGEARFKDDQSLIVSLNEGGERVVMFDRCLVATGASPAMPPIPGLKESPYWT

SEQ ID NO: 30995 - protein, 205 aa, Thermoanaerobacter tengcongensis
MASMTGGQQMGRGSSTSLYKKAGLMPSPMEDIEEILITEEQLKAKVKELGEMITRDYEGKDLVLIGVLKGAIMFMSGLSRAIDLPLSIDFLAVSSYGSSTKSSGIVKIIKDHDIDIEGKDVLIVEDIIDSGLTLAYLRETLLGRKPRSLKICTILDKPERREADVKVDYCGFKIPDKFVVGYGLDYAEKYRNLPFIGVLKPELYK

SEQ ID NO: 30996 - protein, 339 aa, Salmonella typhimurium LT2
  misc_feature (168)..(168): Xaa can be any naturally occurring amino acid
  misc_feature (185)..(185): Xaa can be any naturally occurring amino acid
  misc_feature (306)..(306): Xaa can be any naturally occurring amino acid
  misc_feature (314)..(314): Xaa can be any naturally occurring amino acid
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRXREAGGYVLFDVNLRSKXWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAXAVTAKGAXTALPFPDQLNTFLSSHSLAQAMTVK

SEQ ID NO: 30997 - protein, 339 aa, Salmonella typhimurium LT2
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 30998 - protein, 342 aa, Sporidiobolus salmonicolor
  misc_feature (71)..(71): Xaa can be any naturally occurring amino acid
  misc_feature (191)..(191): Xaa can be any naturally occurring amino acid
  misc_feature (226)..(227): Xaa can be any naturally occurring amino acid
  misc_feature (241)..(241): Xaa can be any naturally occurring amino acid
AKIDNAVLPEGSLVLVTGANGFVASHVVEQLLEHGYKVRGTARSASKLANLQKRWDAKYPGRFETAVVEDXLKQGAYDEVIKGAAGVAHIASVVSFSNKYDEVVTPAIGGTLNALRAAAATPSVKRFVLTSSTVSALIPKPNVEGIYLDEKSWNLESIDKAKTLPESDPQKSLWVYAASKTEAELAAWKFXDENKPHFTLNAVLPNYTIGTIFDPETQSGSTSGWXXSLFNGEVSPALALXPPQYYVSAVDIGLLHLGCLVLPQIERRRVYGTAGTFDWNTVLATFRKLYPSKTFPADFPDQGQDLSKFDTAPSLEILKSLGRPGWRSIEESIKDLVGSETA

SEQ ID NO: 30999 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIREKHPTIPIGLLMYANLVFNKGIDEFYARCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKVFVQPMKAATRS

SEQ ID NO: 31000 - protein, 268 aa, Escherichia coli
MERYESLFAQLKERKEGAFVPFVTLGDLGIEQSLKIIDTLIEAGADALELGIPFSDPLADGPTIQNATLRAFAAGVTPAQCFEMLAIIREKHPTIPIGLLMYANLVFNKGIDEFYARCEKVGVDSVLVADVPVEESAPFRQAALRHNVAPIFICPPNADDDLLRQIASYGRGFTYLLSRAGVTGAENRAALPLNHLVAKLKEYNAAPPLQGFGISAPDQVKAAIDAGAAGAISGSAIVKIIEQHINEPEKMLAALKVFVQPMKAATRS

SEQ ID NO: 31001 - protein, 499 aa, Mycobacterium tuberculosis
MVTRIVILGGGPAGYEAALVAATSHPETTQVTVIDCDGIGGAAVLDDCVPSKTFIASTGLRTELRRAPHLGFHIDFDDAKISLPQIHARVKTLAAAQSADITAQLLSMGVQVIAGRGELIDSTPGLARHRIKATAADGSTSEHEADVVLVATGASPRILPSAQPDGERILTWRQLYDLDALPDHLIVVGSGVTGAEFVDAYTELGVPVTVVASQDHVLPYEDADAALVLEESFAERGVRLFKNARAASVTRTGAGVLVTMTDGRTVEGSHALMTIGSVPNTSGLGLERVGIQLGRGNYLTVDRVSRTLATGIYAAGDCTGLLPLASVAAMQGRIAMYHALGEGVSPIRLRTVAATVFTRPEIAAVGVPQSVIDAGSVAARTIMLPLRTNARAKMSEMRHGFVKIFCRRSTGVVIGGVVVAPIASELILPIAVAVQNRITVNELAQTLAVYPSLSGSITEAARRLMAHDDLDCTAAQDAAEQLALVPHHLPTSNHHHHHH

SEQ ID NO: 31002 - protein, 270 aa, Senecio squalidus
GCVIWTGTNISFIEAYGNYTSMYAISSLHPLRTITGKKTKNNRNRNWIWIPILAILLLFLSLGLLWYLKQRKRRREERRRRDDYFLELTASESFKDVHQLESNGGKGTDLFIFSFASIMAATCDFLIENKLGQGGFGPVYKGTLIDGQEIAIKRLSRTSDQGLVEFKNELVLITKLQHRNLVRVLGCCIHGEEKMLIYEYMHNKSLDYFLFDENRKLELDWLTRLKIIEGIAQGLLYLHKYSRMCVIHRDLKANNILLDENMNPKISDFG

SEQ ID NO: 31003 - protein, 268 aa, Senecio squalidus
  misc_feature (260)..(260): Xaa can be any naturally occurring amino acid
GCVIWTGSNSFLDNPSEIPTWMYEINSQNLSTGYKTKNKTTLILILIATIIPLVFLRLGILWFVKKRKRRQEEKERRERDEYFIQLTSSESFTDVHHLESSSGKGSDLLIYSFASIMTATNDFSIENKLGQGGFGPVYKGQLSDGQEIAIKRLSRTSGQGLVEFKNELVLIAKLQHTNLVRVLGCCFHREEKMLIYEYMPNKSLDFFLFDNNRKVELDWLKRFNIIEGIAQGLLYLHKYSRMRVIHRDLKANNILLDENXNPKISDFG

SEQ ID NO: 31004 - protein, 483 aa, Prunus avium
MLAQKQAEEAIVSNFSEAHDHEGKEDHHQDKEEENTSLFNVKNFLWHGGSVWDAWFSCASNQVAQVLLTLPYSFSQLGLLSGILLQIFYGIVGSWTAYLISVLYIEYRSRKEKENVNFKNHVIQWFEVLDGLLGPYWKAVGLAFNCTFLLFGSVIQLIACASNIYYINDNLDKRTWTYIFGACCATTVFIPSFHNYRIWSFLGLGMTTYTAWYLTIAAVVHGQKEGVTHTAPTKLVLYFTGATNILYTFGGHAVTVEIMHAMWKPQKFKYIYLFATVYVFTLTIPSATSVYWAFGDELLNHANAFSLLPKNAWRDAAVILMLIHQFITFGFACTPLYFVWEKVIGMHDTKSICLRALARLPVVIPIWFLAIIFPFFGPINSAVGALLVSFTVYIIPSLAHMLTYRKASARQNAAEKPPFFLPSWTAMYVINSFIVVWVLVIGFGFGGWASMTNFVRQVDNFGLFAKCYQCNSPKLPAAAAPHH

SEQ ID NO: 31005 - protein, 204 aa, Oryza sativa
  misc_feature (204)..(204): Xaa can be any naturally occurring amino acid
MVKLAFGSLGDSFSATSVKAYVAEFIATLLFVFAGVGSAIAYGQLTNGGALDPAGLVAIAIAHALALFVGVSVAANISGGHLNPAVTFGLAVGGHITILTGLFYWIAQLLGASIACLLLKFVTHGKAIPTHGVAGISELEGVVMEIVITFALVYTVYATAADPKKGSLGTIAPIAIGFIVGANILAAGPFSGGSMDSKGYRGCX

SEQ ID NO: 31006 - protein, 174 aa, Borrelia hermsii
MDEEISTLFTEEKIKSKIKELAQKIRNYYKDKSNVVFISLLKGSFMFFADITREIGLNVKIDFLQVSSYKNKTHSSLNVLIKKDIDIDIKDSYVIIFDDIIDTGLTYDKIITYLKTKNPKEIKICTLFNKPSRRLIELKIDYAGFEIENDFIVGYGIDFNEKHRTLKDVAKINK

SEQ ID NO: 31007 - protein, 456 aa, Methylophaga sp. SK1
MATRIAILGAGPSGMAQLRAFQSAQEKGAEIPELVCFEKQADWGGQWNYTWRTGLDENGEPVHSSMYRYLWSNGPKECLEFADYTFDEHFGKPIASYPPREVLWDYIKGRVEKAGVRKYIRFNTAVRHVEFNEDSQTFTVTVQDHTTDTIYSEEFDYVVCCTGHFSTPYVPEFEGFEKFGGRILHAHDFRDALEFKDKTVLLVGSSYSAEDIGSQCYKYGAKKLISCYRTAPMGYKWPENWDERPNLVRVDTENAYFADGSSEKVDAIILCTGYIHHFPFLNDDLRLVTNNRLWPLNLYKGVVWEDNPKFFYIGMQDQWYSFNMFDAQAWYARDVIMGRLPLPSKEEMKADSMAWREKELTLVTAEEMYTYQGDYIQNLIDMTDYPSFDIPATNKTFLEWKHHKKENIMTFRDHSYRSLMTGTMAPKHHTPWIDALDDSLEAYLSDKSEIPVAKEA

SEQ ID NO: 31008 - protein, 225 aa, Thermus thermophilus
MSWWQRAVIYQVYPRSFQDTNGDGVGDLEGIRRRLPYLKSLGVDALWLSPFYKSPMKDFGYDVADYCDVDPVFGTLQDFDRLLEEAHALGLKVLVDLVPNHTSSEHPWFLESRASRNSPKRDWYIWKDPAPDGGPPNNWQSFFGGPAWTLDEATGQYYLHLFLPEQPDLNWRNPEVREAIKEVMRFWLRRGVDGFRVDVLWLLGKDPLFRDEPGSPLWRPGLPDR

SEQ ID NO: 31009 - protein, 234 aa, Thermus thermophilus
MRAENPVFFLDYDGTLAPIAQRPEEAFPHPEAPRVLRALMERHPVYVVTGRRVRGLEPLLPLPGLPVVGGHGLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 31010 - protein, 210 aa, Thermus thermophilus
MSWWQRAVIYQVYPRSFQDTNGDGVGDLEGIRRRLPYLKSLGVDALWLSPFHKSPMKDFGYDVADYCDVDPVFGTLQDFDRLLEEAHALGLKVLVDLVPNHTSSEHPWFLESRASRNSPKRDWYIWKDPAPDGGPPNNWQSFFGGPAWTLDEATGQYYLHLFLPEQPDLNWRNPEVREAIKEVMRFWLRRGVDGFRVDVLWLLGKDPLFR

SEQ ID NO: 31011 - protein, 234 aa, Thermus thermophilus
MRAENPVFLLDYDGTLAPIAQRPEEAFPHPEAPRVLRALMERHPVYVVTGRRVRDLEPLLPLPGLPVVGGHSLEEGVLFGEVRPLFPVDLGPLRARLPSCPGVRVEDKGFALALHYRGAEDEEKARACLEAWLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 31012 - protein, 163 aa, Pseudomonas fluorescens
MIHYVTPDLCDAYPELVQVVEPMFSNFGGRDSFGGEIVTIKCFEDNSLVKEQADQPGAGKVLVVDGGGSLRRALLGDMIAEKAAKNGWEGLVIYGCVRDVDVLAQTDLGVQALAPHPMKTDKRGIGDLNVVVTFASVTFRPGEYVYADNNGVIVSPSPLKMPE

SEQ ID NO: 31013 - protein, 512 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLVPLFNVDLQDVFQRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGLRHEPSYKFFSFNAGPRTCLGKNLAMNLMKTVIVEILQNYEIKIVSGQKIEAKPGLVLHMKHGLKVTMTMKCSSLE

SEQ ID NO: 31014 - protein, 369 aa, Acinetobacter baumannii
MKSRAAVAFAPGKPLEIVEIDVAPPKAGEVLIKITHTGVCHTDAFTLSGDDPEGVFPAILGHEGAGVVIEVGEGVTSVQPGDHVIPLYTAECKECLFCKSGKTNLCVAVRATQGKGVMPDGTTRFSYKGEPIYHYMGCSTFSEYTVVAEVSLAKINPEANHEQVCLLGCGVTTGIGAVHNTAKVQEGDSVAVFGLGGIGLAVVQGARQAKAGRIIVVDTNPDKFELAKQFGATDFLNPKDYDQPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLQDINTAFDLMHEGKSIRTVIHF

SEQ ID NO: 31015 - protein, 328 aa, Glycyrrhiza echinata
MASSTSTTTSKEIDRELPPLLRVYKDGTVERFLGSSFVPPSPEDPETGVSTKDIVISENPTISARVYLPKLNNTTEKLPILVYYHGGAFCLESAFSFLHQRYLNIVASKANVLVVSIEYRLAPEHPLPAAYEDGWYALKWVTSHSTNNNKPTNADPWLIKHGDFNRFYIGGDTSGANIAHNAALRVGAEALPGGLRIAGVLSAFPLFWGSKPVLSEPVEGHEKSSPMQVWNFVYPDAPGGIDNPLINPLAPGAPNLATLGCPKMLVFVAGKDDLRDRGIWYYEAVKESGWKGDVELAQYEGEEHCFQIYHPETENSKDLIGRIASFLV

SEQ ID NO: 31016 - protein, 263 aa, Hymenophyllum digitatum
MSVRNRFEDKRKLGGLIGAFLEKATKGYVSSEREKDSHITIDTNKGLWTRCDNCGNMLYVRFLKQNKSVCEECGYHPPMTSTERIELLIDRDTRIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 31017 - protein, 260 aa, Hymenophyllum sibthorpioides
MSVRNRFEDKRKLGGLIGAFLEKATKGYVSSEREKDRHISIDTNKGLWTRCDNCGNMLYVRFLKQNKSVCEECGYHLPMTSTERIELLIDRDTWIPMDEDMTAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQ

SEQ ID NO: 31018 - protein, 263 aa, Hymenophyllum armstrongii
MSVRNRFEDKRKLGGLIGAFLEKATKGYVSSEREKDRHITIDTNKGLWTRCDNCGNMLYVRFLKQNKSVCEECGYHLPMTSTERIELLIDRDTRIPMDEDMIAQDVLSFSDEDSHQNRIITSQKRTGLTDAVQTGIGYLNGTPLALGVMDFQFMGGSMGSVVGEKITRLIEYATDKSLPIIIVCASGGARMQEGTLSLMQMAKISSVLQIHQVQRSLLYISVLTYPTTGGVTASFGMLGDIIIAESKAYIAFAGKRVIEQTLR

SEQ ID NO: 31019 - protein, 391 aa, Phytophthora parasitica
MKLFKSTLAILALVAAMVNGDDVDQSEVVQQSQENQDYEVGQVSPASQVGQDSPYQVDQDDTCTLTGNYTEGTDVSQCSTIVIDSLSVPAGVMLDLTNVTDGANIKFQGTSTFGPKLWAGPFIKLAGNDLTVTGPGTLDGQGAWYWPQGQNITRPVFFRLSRVANSKLSGFTIKNMPFRTFSILSSNYTTISELTIDSRAGNGSAKNTDGFDLSRNNHVTITNNRVYNQDDCLAMQSSSNTVFSNNYCSGSHGISIGSLGGPEQNVNTTVSGLLVKDNTIVNSTNGIRIKTIIGLKGLVTNVTYTNNRLVNVKHAIVMHSDYNKTKGGYSGIPSSLVNITNIKIDGLFGSATNLYDIVANPAVVSNWEFKNVAVNATNIGKCQGGPSNVQC

SEQ ID NO: 31020 - protein, 216 aa, Lycopersicon esculentum
MAAPPARARADYDYLIKLLLIGDSGVGKSCLLLRFSDGSLTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTAKGQALADEYGIKFFETSAKTNLNVEQVFFSIARDIKQRLADTDSKAEPSTLKINQPEAGAGGSQTSQKSACCGS

SEQ ID NO: 31021 - protein, 366 aa, uncultured bacterium
MTDQNLFTPYTLGALTLSNRVVLAPLTRNRAGEGFVPSEFAATYYSQRASAGLLISEATQISRQGQGYQDTPGIYTPAQIDGWRTVTDAVHAKGGKIFLQLWHVGRVSHVDLQENGAAPVAPSALRAATKVFVNNRFEDVSEPRALDIKELPGIVADFRQAAANAVCAGFDGVEIHGANGYLLDQFLRDSANLRTDAYGGSIENRARLLLEVTAAVVNEIGADRTGVRLSPVSPANGVSSSDPQAQFDYVVEQLDALDVVYLHVVEGATGGPRDVAPFDFGALRQRFKNTYIANNGYDLDLATSKLAEDQADLIAFGRPFIGNPDLVERLKRGAPLSAFNPATLYGGGATGYIDYPTLAESSASAS

SEQ ID NO: 31022 - protein, 257 aa, uncultured bacterium
AGTGDRVRQWKTGDEVMGIVSGGAYAERLVVHERQAMSVPKSVGLANAAAIPEVFITAWDALVVQAGLTSGRWALVHAGASGVGTAAIQICKAIGARVIVTCSTGKVSACRALGADAVVDYTTSNFVESVKQETDGGGVDAVLDVIGGEYLNRNVSALALKGHIVQVGVMGGGTAPFNLAALMAKRGKVSGTLLRVRPLEEKIAITQRFIVEMLPLFDTGVLKARVDRRFPLAQISDAHTYMEANANIGKIIIDIDA

SEQ ID NO: 31023 - protein, 421 aa, uncultured bacterium
MWTDVDSSHHRGALSAAASEVIAHAAKTARDQRLPLVLSMGSSGADIIEGVAALHGWGRAARAIADCSGVVPTITIVNGPAVSGPALLIGLSDFVIMTADSYAFVTGPTMVAEFTGVEISNDELGGTDAHARQSGVASMVVSDDQSALIALEHLLTYLPSHVDEIALRVNTSDPVDRLTPEAGRAIPNSATGSYDIRKVIRILADDEEMFELRDRWAPNVVTAFITIGGESVGVVANQPMALAGTLDISASQKAARFVSFCDSFNIPLLTLVVSAGFYPGKDLEWRGMIRHGGQLVFAYARATVPRVCVILRKSYGGAYIVMDSKTMGNDLCLAWPTAELAVMGAGQAAAILQRRATAKERAAFESDYSERLLNPYIAAERGYIDAVIDPSETRREIAAAFVMLRDKRERLISRKHDNTPL

SEQ ID NO: 31024 - protein, 285 aa, uncultured bacterium
MTHAPRATPRQKGAPPIPVGARDVAPPAGAPVLDSISPIDVRGLTMRYGARVVMHDLTFAVQRGEVFVIMGGSGSGKSTLLKHLIGLKAPAQGTVLIDGEDFAAAGPEARKDVLRRMGVLYQNGALWSGLTLTENVALPLTEFTTLGADAIGDVVELKLALVGLRGFGHFYPAAISGGMRKRAALARAIALDPDVLFFDEPSSGLDPVSASRLDDLILEIKASFGTTIVVVTHDLASIYRIADRALFLDIDQKTMTALGGPAELRDHPPNDAVHRFLTRSSEGVT

SEQ ID NO: 31025 - protein, 404 aa, Lactobacillus sakei
MAKQTVADLKDIKGKKVLVRVDFNVPIKGGVIGDDNRIVAALPTIQYIIDNGGKAILLSHLGRIKSDEDKKELTLKPVAARLGELLNKDVAFVASNEGQELEDAINAMTDGQVLVMENTRFQDIDNDFGKRESKNDPKLGEYWASLGDMFVNDAFGTAHRAHASNVGIATAMKANNKPAVAGYLLEKEIKFLGEAVDAPERPFVAILGGAKVSDKIGVIEHLLAKADKVIVGGGMTYTFYAAKGLSIGNSLVEEDKIELAKELIEKAGDKLVLPVDNVVADAFSNDAKTETVEGNIPDGYMALDIGPKAIADFENVLKDAKTVVWNGPMGVFEMDNFAKGTLAIGEFLGNLSGATTIVGGGDSTAAVKKLGVGDKLTHISTGGGASLEYLEGKTLPGIAAISDK

SEQ ID NO: 31026 - protein, 251 aa, Lactobacillus sakei
MRKPIIAGNWKMNMNPTQTTEFVNAIKANLPKFDQTESVIGAPAVDLPALLEAAKGTDLKVAAENCYFEEAGAFTGETSPKTLNEMGVDYVIIGHSERRDYFHETDEDINKKAHAIFKNNMTPIFCCGESLETREAGKAEEWVSNQVTEGLKGLSADQVSSMVIAYEPIWAIGTGKTASADQAQEICAVVRQTVAKLYDQTVADKVRIQYGGSVKPANVKEIMGKEDIDGGLVGGASMEPASFLDLVHFND

SEQ ID NO: 31027 - protein, 431 aa, Lactobacillus sakei
MSIITDILGREVLDSRGNPTVEVEVYTEDGGFGRAIVPSGASTGEHEAVELRDGDKSRFGGKGVLKAVENVNGPLAKEIVGFDTTDQRGIDAAMIKLDGTENKGKLGANAILGVSLAAARAAADELGLPLYEYLGGPNAHVLPTPMMNVINGGAHSDNKVDFQEFMIMPVGAKSVREAIRMGSETFQALKSLLSADGKVTSVGDEGGFAPDFANNEEPLQYLIKAIEKAGYKAGEDISIAIDVASSELWNNEDKTYKLRWSTGEEFTTPEFVKYLEGLVAKYPIISIEDPIDENNWEDWASITKELGEKVQLVGDDFFVTNTDYLRKGIKMGAANSILVKGNQIGTLTESLEAIEMAKEAGYTAVVSHRSGETEDTTIADLVVATNAGQIKTGSMSRTDRLAKYNQLMRIEEQLGDTASYKGINSFYNIKK

SEQ ID NO: 31028 - protein, 218 aa, Phytophthora infestans
QQTDTMSRPTISEVIAERKANNTAAFITFVPCGFKTKADTVDILLGLQRGGANIIEVGIPYSDPQADGPTIQRAHQVGVDQGITLHDVLATVSEARTKGLTTPVVLMGYYNNILQYGEVKICPDAQKAGVDGFIIVDLPPEEAKTLSDDAAKHGLAYIPLVSPTTTEERMKLIDSVAHGFVYCVSLTGVTGARNELPPNLDAFMAKIRANVKHPLALG

SEQ ID NO: 31029 - protein, 260 aa, Pyrococcus horikoshii
MIEFRDVWFWYQEGKTVLKSISFSFSEGTLAIVGPNGSGKTTLVKMLNGLLKPKKGNVLIDGINTKEVSVAELSRIVGYVFQNPDAMFFEENVFKEVAFGPKNLGLNEEEVKKRVRWALEAVGLRGFENRNPFELSGGEKQRLAIACILAMKPKYLVLDEPNTGLDERGLQDLINVIKNLRREGSSIILVTHDIELVLEVADKVLLLKDGELKFFGSTKEFFELDLEGFGLKEPELVKISKDVGINFVRNVEELLKVIGL

SEQ ID NO: 31030 - protein, 269 aa, Synechococcus elongatus PCC 6301
MKMLRALKHHWPEYLIEAWGLGLFMVAAGVVGTLVFYPQSPAYQAIADPFLQRVVMGLGMGLTAMIIMYSPWGKRSGAHINPAVTLTFYRLKKIAAWDAFFYVVFQFIGGLLGVVLVAFLLQTPFTQAPVNYVVTVPGKQGAIVACIAEYFIAVLMMSMVLFTSNQPKLERFTPFFAGCLIVSYVIFESPLSGFGMNPARTVASALPSGIWTAIWLYFLAPIAGMLTAAELYLRMIGPRKIFCAKLYHDPLYRCIHCGHLIHWHRPHLR

SEQ ID NO: 31031 - protein, 474 aa, Synechococcus elongatus PCC 6301
MESPLMLVPVILSGGSGSRLWPLSRESYPKQFHALLSDYSLLQETLLRLEGLPGLASPLLICNEQHRFLVAEHLRAIGQTAAAIVLEPEGRNTAPAVAIAALQAQSQGEDPLLLVLPSDHSIADPAAFRATVQTAIALATAGHLVTFGIVPEAPETGYGYIKAGSDLDLGGFAIDRFIEKPNLATAENYVASGCYYWNSGMFLIRASVYLSELARYAPEMFTACEAAWQKRQADLDFVRLDPATFAQCPSDSIDYAVMEHTQQGAVLPLQAGWTDVGSWSSLWQALEQDGAGNVTVGDSLALDCRNVYLRSEGRLVVGVGLEDVVAVETDDALLIAHRDRTQTVKQVVEALQREARRESRAHRKIYRPWGRYDSLDLGDRFQVKRITVNPGASLSLQMHHHRAEHWIVVKGTALVTRDNEEVLLTENQSTYIPVGCKHRLSNPGRVPLEMIEVQSGSYLEEDDIVRFEDHYGRS

SEQ ID NO: 31032 - protein, 478 aa, Synechococcus elongatus PCC 6301
MARSRSEYVCQNCGHRAPRYVGRCPACESWNSLVEEAIAPTAKTAIATVLPSRQRRDRLAEAPPQAVAAQPLSAIADVSQQRIASGSGEFDRVLGGGLVPGSLVLIGGDPGIGKSTLLLQTATALSQQQPILYVCAEESGQQVKLRWQRIAAHRSPNQADQQFYLLPEIDLDAIVAELETLRPPVAIIDSIQALYSPALGSAPGSVAQVRECTAALMRVAKQLTITLLIVGHVTKDGAIAGPKVLEHLVDTVLYFEGDRFASHRLPRSVKNRFGASQELGIFEMVDRGLEEVGNPSALFLGSRDQATSGTATIVACEGTRPLLVELQALVSPSSYSSPRRAGTGIEYNRLLQILAVLEKRLGLPLSKFDAYVASAGGLNVAEPAADLGIAIALVASFRDRCLRPDTVLIGEIGLGGQMRPVSQVELRLKEAAKLGFQRALLPKGQERCESDLELVPVSRLVDAIGLALQEAPPSSDRS

SEQ ID NO: 31033 - protein, 153 aa, Synechococcus elongatus PCC 6301
MKIWRSLSLLLVLIGGLIFGAGPALAITQLNVTTVDYQQCPAELNSGAVTSGGSSRPATCYLVVGTLNNPSNKTVYDVDIYGRVYDANGDSVMQNRTRLGEVEEVPPGDHPFEIRISVPASQPEPLQLKQFKASGFSATVRTQLLEEPAESRF

SEQ ID NO: 31034 - protein, 472 aa, Synechococcus elongatus PCC 6301
MPKTQSAAGYKAGVKDYKLTYYTPDYTPKDTDLLAAFRFSPQPGVPADEAGAAIAAESSTGTWTTVWTDLLTDMDRYKGKCYHIEPVQGEENSYFAFIAYPLDLFEEGSVTNILTSIVGNVFGFKAIRSLRLEDIRFPVALVKTFQGPPHGIQVERDLLNKYGRPMLGCTIKPKLGLSAKNYGRAVYECLRGGLDFTKDDENINSQPFQRWRDRFLFVADAIHKSQAETGEIKGHYLNVTAPTCEEMMKRAEFAKELGMPIIMHDFLTAGFTANTTLAKWCRDNGVLLHIHRAMHAVIDRQRNHGIHFRVLAKCLRLSGGDHLHSGTVVGKLEGDKASTLGFVDLMREDHIEADRSRGVFFTQDWASMPGVLPVASGGIHVWHMPALVEIFGDDSVLQFGGGTLGHPWGNAPGATANRVALEACVQARNEGRDLYREGGDILREAGKWSPELAAALDLWKEIKFEFETMDKL

SEQ ID NO: 31035 - protein, 455 aa, Synechococcus elongatus PCC 6301
MLPPGPSQLALLQTLRIITQPVSFLLSCADRYGDWFTLRVLGPQSPPVVFVSDPEAILAIFSSLADQLELGRIADVFRPLVGNESLIMQNGDRHRQQRQLLMPALQGERLFDYTPAMTAITQAAIAQWPLGQPLDLRRQMSQISLAVILQVVFGLTPGPRYRDLYQRLDQLLEAITDPLYSLQFFWPALQQDWGNWSPWGRFCRQREAIDALITAEIQEGRQSQQPRQDVLELLLAARDRDGNPLSDQELRDQLMTLLLLGHETTASALTWAVFWLLRHPDCLNRLQSELVAIGDNDRAIAKAPYLDAVCREALRLQPIALIAQPRRVASPLSLGGYDFASGTILVPCVLTAHRRAATYPNPDQFQPNRFLERRFSNGEFLPFGGGQRSCIGMALSLIEMKMVLATLLRQCQIAEVSQRPVRPARRGITFVPSQDFRIQVQQWHNPSAQTAIASV

SEQ ID NO: 31036 - protein, 331 aa, Synechococcus elongatus PCC 6301
MKVAFFSSKAYDRTFFEAANADYGHDLQFFETGLSLGTVQLATGFRAVCSFVNDRLDAITLEALAELGVEHVALRCAGFNQVDLSAAERLGLRVVRVPAYSPHAVAEHAIALILTLNRKIHRAYARTREGNFALDGLVGFDLNGCTVGIIGTGRIGAVLTQILRGFGCHVLAHDLVENPDCLAAGAVYTDLDQLWQEAQIISLHCPLTPQTYHLVNREAIAKMQPGTMLINTSRGGLVDTQAVIEGLKLKRIGALGLDVYEQEEPLFFQDHSTEIIHDDVFQRLLTFPNVVITGHQAFLTDTALHNIAETTLSNLTDLEQGRACPNQLFAG

SEQ ID NO: 31037 - protein, 511 aa, Synechococcus elongatus PCC 6301
MAALSLADRVVVTAEQMQAIESRLFAAGMPVAALMEKVAGLLSQRLQMAYPDRTQRWGIWVGPGHNGGDALVVARELHLQGYPVQIWHPFERRKPLTEAHLQFAQHLGISIACDYPEHCDRWLDGGFGFGLNRPLNEATQTAIAQLNDSGKPILSIDLPSGLDTDSGEPLGAAIRAERTYCLGLWKQGLLQLVAAPWHGELERVDFGIAEADIVAVLGPVPDRQILTDEAAIAALPLPIAADAHKYRRGQLLLIAGSQRYRGAALLAALAARSSGVGMMTLAVPASLSAIAIAQVPEALVVACPETETGEIAELPIDRDRYNAIAIGPGVGTGPTIRTILHRVLQQSTPFLIDADALTVLAQHPEDWALRPAEARTVITPHAGEFQRLFGSAPTPASLSSAASERSLILVRKGPSPTVVTPVGASWALVDSTPALARGGRGDVLTGLLGGLLAQTDAVSAAIAATWWHSRTAQAIAQKQTALGVTPTELAAQLTPWLGQRLQSEIAQYLAS

SEQ ID NO: 31038 - protein, 484 aa, Synechococcus elongatus PCC 6301
MSAVHLTVTPPGPIRFGTDGWRGVIAADFTFERLFRAAGAAAKVLARTYGDNGSRRILVGYDRRFLSEEFASITAQAIQAVGLEAQLASNYATTPALSWAVHEQAALGALVITASHNPGQYSGLKIKGAFGGSVPGSVTAEVEALLDQGFTPDLPDSSSAIARFDPWQSYRQMLRQKVDLAAIQAAIAGGRLSVFVDVMHGAAAGALAQILEAPVTELRSDRDPLFGGGAPEPLAANVVGLCQRLSDGVTTPLAVGFVFDGDGDRIAAVDRSGEFLSSQVLIPVLIEHLAARRSCPGELVKTVSGSDLMPKVAALFNIPVTELPVGYKYIADRMLSQTVLLGGEESGGIGYGSHIPERDGLLSALYLLEAIVQSDRNLGDLYADLQARTQFQSTYDRIDLPLADMSARDRVLQALQTQTPQAIAGLEVISYQTIDGFKFRLSDGRWLMVRFSGTEPLLRLYCEASSPEAVQETLNWAKDWAQRC

SEQ ID NO: 31039 - protein, 253 aa, Synechococcus elongatus PCC 6301
MNGLARSEQSAVRRIIIAGNWKMYKTQAEALEFLQAFLPQLSETPESRKVVLCAPFTTLSSLSKTLHGSRVRVGAQNIHWAKEGAFTGEISGAMLTEIGVRYVVVGHSERRQYFGETDETVNQRLLAAQSFGLLPILCVGESKQQRDAGETEAVISRQLERGLVGADQTNLVIAYEPIWAIGTGDTCAAEEANRVIGLIRSQLKDTDVPIQYGGSVKPENIDEIMAQPEIDGALVGGASLEAESFARIVNYQS

SEQ ID NO: 31040 - protein, 159 aa, Synechococcus elongatus PCC 6301
MRRLFAVVLAACLWLGFAPQASADVAGLTPCSESPRFIQRAEAAATPQAKARFENYSQALCGADGLPHLIVDGRLDHAGDFIIPSLLFLYIAGWIGWVGRSYLQAIKSDKDAAGKEIVIDVPLAVKFSLTGFAWPLAAFQEFSSGKLLAKADEITVSPR

SEQ ID NO: 31041 - protein, 167 aa, Synechococcus elongatus PCC 6301
MKIRNVSMAPQVTDIAVTTIDGAAKSLSDYAGQVLLIVNVASYCGYTSQYSGLEALYRQYRDRGLQVLAFPCNDFGAQEPGSNEEIKTFCSTRFDVSFELFDKVHAKGADQHPLYAALTQTDPAGDVAWNFEKFLVGKDGTVLARFKSGVAPNDASLIQAIEAALAA

SEQ ID NO: 31042 - protein, 479 aa, Synechococcus elongatus PCC 6301
MSSEFDYDVIVIGAGYGGFDAAKHACEKGLKTAIVEARDLGGTCVNRGCVPSKALLAASGRVREITDTDHLQNFGIQVQGVSFDRQAIADHAANLVDTVRTNLGNTLERLGAEILMGRGRLAGSQRVTVTAADGTEKTYSARDVILATGSDPFVPPGIEIDGKTVFTSDDALKLETLPQWIAIIGSGYIGLEFSDVYTALGCEVTMIEALDRLLPTFDPDVAKVAQRSLLDGRDIETRTGVLARKITPGSPVVIELADFETKELVEVLEVDACLVATGRIPSTKNLGLETVAVEVDRRGFIPVDDGMRVLRDSKPVPHLFAVGDATGKLMLAHAAAAQGVVAIENITGHPRSVDYRSIPAATFTHPEISSVGLSEADAKALGGQEGFEVGSVRSYFKANSKALAEADADGFAKVLFRKDTGEVLGAHIFGLHAADLIQEVANAIARRQSVKELAFEVHTHPTLSEVIESAYKQAATAIA

SEQ ID NO: 31043 - protein, 507 aa, Synechococcus elongatus PCC 6301
MSPADSHNQLLIDRVHPQDWINPEPADCYDLVVIGAGTTGLVVAAGATGLGLGLKVALIEKQLMGGDCLNFGCVPSKALIRSSRVIGELQRANTLGIQVAPEAIAVDFAAVMERLRKVRAGMSVHDSAQRFQALGVDVFLGQACFCDRNTIQVGEATLKFRKAVIATGARATYPNIEGLEASGFLTNETVFSLSNCPRRLAVIGGGPIGCELAQAFQRLGSQVTLFQRRSQLLPKEDFEAAEVIQNQLRADGVQVCLSAEITRIERTASGKLITFRQEGRESVLEVDEILVGTGRSPNVQDLNLEAVGVDYDSVHGVKVNDYLQTTNPKIYAAGDVCSPWKFTHAADAAARIVIKNALFSPFGLGKSKVSDLIIPRVTFTDPEVAHVGLSETAARHQGIAIATITIPLDQVDRTVLDGETAGFIRIHHQPNSDKILGATIVAPHAGEMISEVTTAIANQLGMSALSSVIHPYPTQAEGIKKAADNYRRTLLTPMTKQLLKLLMIFSK

SEQ ID NO: 31044 - protein, 402 aa, Synechococcus elongatus PCC 6301
MSKRTLASLTAADLEGKRVLVRVDFNVPLDGNGKITDDTRIRAALPTIRYLSESGAKVILVSHFGRPKGKPVESMRLTPVAERLSELLGRPVVKTTDAVGAGAEAQVAATSNGQVVLLENVRFHAEEEANDAEFAKALASLADIYVNDAFGAAHRAHAPTAGVTEYLSPCVAGYLLEKELQYLQAAIDNPQRPLAAIVGGSKVSSKIGVIETLLDKCDKLLIGGGMIFTFYKAQGLSVGGSLVEEDKLDLARSLMAKAQEKGVQLLLPVDVVVADKFAPDANAKTVAIDAIPDGWMGLDIGPESVKQFEGALADCRSVIWNGPMGVFEFDQFAVGTEAIARSLAGLTRKGATTIIGGGDSVAAVEKVGVASEMSHISTGGGASLELLEGKVLPGVAALDDAA

SEQ ID NO: 31045 - protein, 447 aa, Synechococcus elongatus PCC 6301
MATPLELLTCWGPDWLASGQGDRLGQLAEQRWLSLQGRPAQRVLIVHTDAIAYLADWIAAVSAGWPVILGNPHWRRQEWEAIATQLQPQQIWGEAPIATSVGIADPLETGWIGIATGGSSGGLRFAVQTWERLTAAALAFQRSPLIDGQAIAGICSLPLHHVSGLMVAVRSLVTGGPLWLLPWSELQSAECLPTCSEAVLSLVPTQLQRLLPLRSQWLQQRLLILLGGAPAWPTLLQQAQNLQLPIAPCYGATETAAFISVLFPQQFLAVSRGVGKPLPGVMIQLNADRTVAIQSPSLALGYWQGPGQVEPIIDAQGFWQSGDRGEWSADHSLILLGRQGDRILSGGEKIWPLEVETVLYNSGLVREVCVVGLADPDWGEVVAAAYVPQQQAVTPEQLKAAIAPELAPYKHPKQWLNCSALPRTSQGKLDRTAVRQLFAARPPLPAL

SEQ ID NO: 31046 - protein, 403 aa, Synechococcus elongatus PCC 6301
MLNASVAGGAATTTYGNRLFIYEVIGLRQAEGEPSDSSIRRSGSTFFKVPYSRMNQEMQRILRLGGKIVSIRPAEEAAANNGAAPLQAAAEEPAAAPTPAPAAKKHSAEDVPVNIYRPNKPFVGKVLSNEPLVQEGGIGVVQHLTFDISEGDLRYIEGQSIGIIPDGTDDKGKPHKLRLYSIASTRHGDHVDDKTVSLCVRQLQYQNEAGETINGVCSTFLCGLKPGDDVKITGPVGKEMLLPADTDANVIMMGTGTGIAPFRAYLWRMFKDNERAINSEYQFNGKAWLIFGIPTTANILYKEELEALQAQYPDNFRLTYAISREQKNEAGGRMYIQDRVAEHADEIWNLLKDEKTHVYICGLRGMEDGIDQAMTVAAAKEDVVWSDYQRTLKKAGRWHVETY

SEQ ID NO: 31047 - protein, 422 aa, Synechococcus elongatus PCC 6301
MSPETVLAAVDAAIASPFSTDAFDACVMQTYGRFPLALERGEGCRVWDTQGRSYLDFVAGIATCTLGHAHPELVDAISDQIRKLHHVSNLYYIPEQGQLAAWLTANSCADRVFFCNSGAEANEAAIKLARKHGNTVLEAENPIILTAQASFHGRTLAAVTATGQPKYHKGFQPLVQGFRYVPYNGLAAPEATLAELDAAGETVAAILLEPLQGEGGVNPGDRAYFQAVRQLCDQRRMLLILDEVQVGMGRSGQLWGYENLGIEPDAFTVAKGLGGGVPIGALLVKASCNILQAGEHASTFGGNPLACRAGLAIAQVMERDQLLANVQARGEQLRAGLQELVDRYPNLLAGVRGWGLINGLVLRNDPNVTPIALVKAAIEQGLLLVPAGAEVVRFVPPLIVSAAEIDEALAMTERALLAIAGE

SEQ ID NO: 31048 - protein, 119 aa, Synechococcus elongatus PCC 6301
MKVGDRDQRPWGQFEILAQGSGYQVKRLEVLPGQQLSLQRHQQRQEHWLVVQGLARVQLGDRQFSLRVGQSLDIAIGEWHRLQNPGDELLALIEVQMGAYLGEDDIERRADDYGRCPTS

SEQ ID NO: 31049 - protein, 298 aa, Synechococcus elongatus PCC 6301
MDRQGKAMSERAIAHLGPVGTYAEMAALRFQAWLTQQDQQPSRLLACRSIPATLQTLADGAVDYAVVPVENSVEGSVAATLDSLWQLPQLSIQRALILPIAHALISFESDRTAIRQVLSHPQALAQCQQWLQRHLPQAELIPANSTTEALQDLERHPQRAVIASTRAAELYQMPIQSFPINDSPDNRTRFWVISRSPTPGGACTSLNFSLDANVPGALVKPLQTLADRRINLSRIESRPTKRSLGEYLFFLDLKADLRDPAIAAAVQAVADCTEQLRVLGSYDSLDFTQSVLVPAQAR

SEQ ID NO: 31050 - protein, 446 aa, Synechococcus elongatus PCC 6301
MSFDYDLLVIGAGSGGLAASKRAASYGAKVAIAETDLVGGTCVIRGCVPKKLMVYASSFASQYHYAEAYGWSAIQPQFSWPKLIAAIDAEVNRLSRLHISLLEKAGVDLILGHAQFVDEHRLQVGDRQVTAAKILIAAGGRPIKLPIPGGELAITSREMFHLPEQPQRFAVIGGGYIGCEFAGILRSLGSEVTQIIRRDRILQGFDQELREAVQTGMSQLGVQFRTGVTVERIDQTETGLQLSYSDGSQQIVDQVLMATGREPWLEGLDLDAAGVAIEGRRIAVDAWSRTNQPHIFAVGDCTDRVNLTPVAIAEGRAFADTEFGQKPRQISYENIASAVFSQPEACSVGLSEEAAKAEYGEERIRVYRSRFRPMFYTLPQAEERVLMKLVVETESDRVLGAHMVGKDAAEIIQSVAIAVTMGATKADFDATMALHPTSAEEFVTMP

SEQ ID NO: 31051 - protein, 271 aa, Synechococcus elongatus PCC 6301
MNLLDRSLSPDSLIFFGLILGRYLLIAGGLYWLFYGFLAERSTRRRVKHWPTWKKSIRSDVGLSIASALVFALLASWLTSTPVLIHTRLYTDVSQYGFFYLIFSFFLVLILQDTSFYFCHRLFHQPWLFRWVHRGHHRSQCPTPWTSFAFDLPEAVMQALLIIGIVFVFPVHVGILLAALVTMTLWSVFNHLGFSLFPDSGVSQWLAQWLIGPQHHLLHHQRYSFHYGLYFTFWDRLLGTQIPASQPQTQRSVRLALLTAAKPLAVRGKER

SEQ ID NO: 31052 - protein, 411 aa, Synechococcus elongatus PCC 6301
MPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 31053 - protein, 430 aa, Synechococcus elongatus PCC 6301
MPDDYGTQIAEITAREILDSRGRPTVEAEVHLEDGSVGLAQVPSGASTGTFEAHELRDDDPSRYGGKGVQKAVENVSAIEDALIGLSALDQEGLDKAMIALDGTPNKKNLGANAILAVSLATAHAAATSLNLPLYRYLGGPLANVLPVPMMNVINGGAHADNNVDFQEFMIMPVGAPSFKEALRWGAEVFHALAKVLKDKGLATGVGDEGGFAPNLGSNKEALELLLTAIEAAGYKPGEQVALAMDVASSEFYKNGLYTCDGVSHEPAGMIGILADLVSQYPIVSIEDGLQEDDWSNWKTLTQQLGSTVQLVGDDLFVTNPDRLQSGIEQGVGNAVLIKLNQIGTLTETLRTIDLATRSGYRSVISHRSGETEDTTIADLAVATRAGQIKTGSLSRSERIAKYNRLLRIEAALGENALYAGAIGLGPKGR

SEQ ID NO: 31054 - protein, 286 aa, Synechococcus elongatus PCC 6301
MSADAPVWIDEVFEDRVRYGLRGQILWEETSPFQKITIVDTEHYGRGLLLDDCWMTAERCEVCYHEYLVHPPLTTAASIARVLVIGGGDGGTVREVLRYAEVEQVDLVEIDGRVVELSQEYLGAIGTAWADPRLNVKIGDGIAFVQTAPDASYDVILVDGSDPAGPAAGLFNREFYENCRRVLKPGGVFASQAESPDSFLAVHLEMIETLSAVFAEAKPYYGWVPMYPSGWWSWLYASDTPGQFQKPQSDRLAAIEPQVEIYNRDIHQAAFAQPNFVRRGLSARQG

SEQ ID NO: 31055 - protein, 189 aa, Synechococcus elongatus PCC 6301
MMDGRFVPNITIGPLIVEALRPVTQKPLDVHLMIVEPEKYVPDFAKAGADIISVQAEACPHLHRNLAQIKDLGKQAGVVLNPSTPVETLEYVLELCDLILIMSVNPGFGGQSFIPAVLPKIRKLRAMCDERGLDPWIEVDGGLKANNTWQVLEAGANAIVAGSAVFNAPDYAEAIAAIRNSKRPELVTA

SEQ ID NO: 31056 - protein, 459 aa, Synechococcus elongatus PCC 6301
MTAVVLPAAAETLAALQATFDRGDTRTLAFRLARLQDLAKLVADNEAELLQALASDLRKPALEAYASEIYFVRDQIKLTCKHLRRWMQPEKQSISLMQQPGQAYRQAEPLGVVLIIGPWNYPFQLLITPLIGAIAAGNCAVLKPSELAPATSSLIQRLISDRFDPDYIRVLEGDASVSQALITQPFDHIFFTGGTAIGRKVMAAAAENLTPVTLELGGKSPCIVDTDIDLDVAARRIAWGKFFNAGQTCIAPDYLLVQRTVAEPFIEALIDNIQQFYGEDPQQSADYARIVSDRHWQRLNSLLVDGTIRHGGQVDRSDRYIAPTLITDVNWRDPILQEEIFGPLLPILIYDQLDEAIAQIRAQPKPLALYLFSRDRQVQERVLAETSAGSVCLNDTILQVGVPDAAFGGVGPSGMGGYHGKASFETFSHYKLVLKRPFWLDLALRYPPYGDKINLFRKL

SEQ ID NO: 31057 - protein, 368 aa, Synechococcus elongatus PCC 6301
MSESLKLLTPVQVGRYELRNRIVMAPLTRNRATGPDNIPNDLNVLYYQQRASAGLIITEASQISPQGQGYPLTPGIHSPEQVEGWKPIVQAVHDRGGCIFLQLWHVGRISHPSLQPDGALPVAPSAIQPAGMAATFQGEQPFVTPRALETEEIAGVVEDYRRAAENALAAGFDGVEVHGANGYLIDQFSQDGTSQRSDRYGGSFENRSRFLREVLDAVISVWGSDRVGLRLSPWGQFNDMRDSDPVGLFSYVAQMLNPYNLAYLHWIEPRWDKAEESPEFNQMATPVFRSLYNGPVIAAGGYSRSTAEAAIASGAADLVAFGRLYISNPDLVERFALDAPLNPYDRNTFYGGDEHGYTDYPSLEAASV

SEQ ID NO: 31058 - protein, 241 aa, Synechococcus elongatus PCC 6301
MKLLDWWALLHPAIAVVVIYPILGVVLRQAWLTRQRRLSPADQKSKIPVSVGQDHSQAGRWLTTGVVVVSLLGIGYPIFSKFVEAGPTGFDGGTPRLITLLLAWIGSLAAIASLFLLRPKTPRELRLPRALFAILTGFGVVALGQQSEVFKRDYEALVSHYYYGIALVLLMIFALATLPEIQRFPRWRILHIVLNIAAAVLFLGQGVTGARDLLEIPLSWQKPTIYQCDFQNLTCPGQPPS

SEQ ID NO: 31059 - protein, 369 aa, Synechococcus elongatus PCC 6301
MKSRAAIAWAAGQPLTIEEVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 31060 - protein, 505 aa, Synechococcus elongatus PCC 6301
MLSKELFQMPRGVAPAFAGRKPKGWAWASTAVPDFQGGFKRLINRFQGSKLWLACVPLAATIAVFWGVAANAQGSADPVPSAQFLVNNLWLMVATVLVIFMNAGFAMVETGLCRQKNAVNVLAKNLIVFTLAATAYWFIGYSLMYGSPVVDGFLYFGKGGPLGFFFDPTVSAETIKNDGLISSLDFLFQAAFAGTAATIVSGSVAERIKFVDFIIFSLILTAVIYPIAGSWQWNVGSGWLNKAGFIDFAGSTVVHSVGGWAALIGAITLGPRMGKFQDGRPGALPGHNLAIATLGALILWIGWYGFNGGSVLAFNTAVPYVAVTTTLGGAAGGISATITSWSTSGKPDLSMVINGILAGLVGVTAGCDGFGMGGSFIVGLIAGVLVVFSVYTFENLKIDDPVGACSVHLVCGIWGTLAVGLFNLEKGLFYGGGFGQLGSQILGIISYGVWTVVASVIIWNILKALLGLRVSPEEELQGLDIGEHGMEAYSGFAKDASNALSSISE

SEQ ID NO: 31061 - protein, 266 aa, Synechococcus elongatus PCC 6301
MTAISDCFAALRSQGRCALIPFLTAGDPDLETTRQALLALDREGADLIELGVPYSDPLADGPVIQAAATRALQAGTRLDDVLALLKDVRSQIKAPIVLFTYCNPILNRGFEAFLDQIAAAGANGLVVPDLPLEESQRLSEVAAERGIDLILLIAPTSSADRIAAISKQARGFIYLVSVTGVTGMRQGMQSRVADLLQEIRQGTDKPIGVGFGISGAEQARQVRDWGADGVIVGSAFVNRLQEQGVEGVATLCRELRQAIDRQPVLS

SEQ ID NO: 31062 - protein, 347 aa, Synechococcus elongatus PCC 6301
MLPDDFSVLPSEPETPPVLLPELGREPETPAEPALELPAPESSLTEETVATPVEDSPPPAEASLQRLTAIALADLEARQAALLASIEKLERRRDRIQQEIRSSFAGKSQEIAVRVQSFKDYLVGSLQDLAASAEQLDLVPPQPIAAPEIIAPPPASVEAKAPLRPGFADPEFAPEAELIEQELNRYRQSPDYYGQPWVLRRTFEAVHEEPVREWFFTMGGRGALRSFGSRQQNVLIASAVISVLNHLYGERLVPLILASTPERLGEWRRGLQDCLGLSREDFGPNQGITLFEFADALVQKAERIEERGDLPLIVIDDGEDSVSLSLLQFPLWLAFAPDPRQPSYDLF

SEQ ID NO: 31063 - protein, 434 aa, Synechococcus elongatus PCC 6301
MSQHLETLALHAGQKPDPTTGSRAVPIYQTTSYVFEDAEHAANLFALKAFGNIYTRLMNPTTDVLEQRLAALHGGTGAVATSSGQAAIFYAIAAITSAGQNIISTTNLYGGTINLFRHTLKRFGIEVRFVDSSDASSVAAAIDENTRLVYTESIGNPKGNVDDFEAIAAIAHDSGIPFIVDNTVSPPPLFNPLEHGADVVVLSLTKLAGGHGTSLGGIVIEKGDFPWNNGKFPEIAGPDPSYHGVNFWDAFGNHPEAVAPGLAYVLKIRTGLLRDIGATLSPFNAQQVLLGVETLPLRAERHVRNAQAVAEWLERHPLVTWVNYPGLPSHPDYDRAQRYLPNGAGAILGFGVQGGLEAGKRFISAVKLASNLANVLDAKTLVIHPASTTHQQLSPEEQAAAGVSPDFVRLSVGLEHLDDILADLDQALQASQVA

SEQ ID NO: 31064 - protein, 307 aa, Synechococcus elongatus PCC 6301
MQSSFLSAVLLPLALVIIMFGMGLTLTVQDFRRVWIAPKAVAIGLIAQLVMLPLPGSAIASLTPLSPELAVGVIILAACPGGPTSNLFTFLAAGDVALSITLTAISSLITVFSIPWVVNLGLQAFLDQTSTFQLPFGPTVVQIAVVAIIPVVLGMLVRHYAPQLAQRTDRSLRWISTAFLAAVIVGFFAQERQNILAFFQSVGGVVLLLNLLAMALGVGLASLTRLGYARATTIGLEVGIQNGTLAIAIAASPTLLNNPAMAIPAAIYSLVMFMTGGIFVWLRQRYQPTRAVQTAAEVPAAVGSHLE

SEQ ID NO: 31065 - protein, 324 aa, Synechococcus elongatus PCC 6301
MQRTMADRLTNLFPFWLLLIGAIALRWPQIFIGLNQGNLPVLILTLVMLGMGLTLSLDDFQRVSRLPRAVLTGFCAQYLIMPFLGWAIGAALQLPTALAVGLILVGTCPGGTASNLITYIARADVALSVVMTLASTLAAVVMTPLLTQFLAGAYVPVNGWLLFAQTLQVVILPVAIGVALNRWTPRLVRQVLPIAPLLSVVGICLICAATFSANAEAIVQQGRQMLLGVFLLHSLGFALGFGFAKLFGYSQAIARTIAIEVGMQNSGLAIILARQAFPLLPLAAAIGAISGVMHSLVGSFLAVIWRSQAQRQSEAVQPHNSLTM

SEQ ID NO: 31066 - protein, 292 aa, Synechococcus elongatus PCC 6301
MGWCTGESARWPRIAATFPKIWAIFAPTLMSSRDAEPLVELRNVRKAFGKQMVLDGVDLSIYPGEAIGILGPSGTGKSTILRIISGLILPDSGEVWVAGQQRTAPITEQPNPFPINLVFQQAALFDSLTVGENVGFYLYQHTRLSPAEIEHYVACSLDSVGLPNIAHLMPSELSGGMRKRVSFARAIISTLLEESGGRSLILYDEPTAGLDPIASTVVEDLMRSLKQQQPQASYVVVTHQESTTRRTADRLILLYRGQVCWQGTAAALDETDNIYVRQFLSGRIDGPIQVAT

SEQ ID NO: 31067 - protein, 338 aa, Synechococcus elongatus PCC 6301
MMSNTMRAVVLEMPGGPEQLQLQSLPWPAIAHPSEVLVQLQAAGLNPIDTKLRQRGSFDPDRRPAILGCDGAGWVAAVGSAVDRFAVGDAVYFCHGGLGLEPGTYADYAVVDQAWLAPKPERLSFVEAAGVPLALITAWEAPYDRGRLQAAQTVLIHAGAGGVGHLAIQLAKLRGARVATTVSTPEKAAIAGHYGADFVIPYRDRDWVAAVLDWTDGKGVDLAFDTVGGAVLEQTFPAVRLYGDLVTILAPDAATNWKVARDRNLRISLELMLTPQLQRVTEARQHQTQILTTASRWFDQEQLHIHIGQVLPISEISQAHQFLERQQGAGKIVIDLTA

SEQ ID NO: 31068 - protein, 372 aa, Synechococcus elongatus PCC 6301
MAARDIHFANRDRRPSPLVGAFLLRVREPKQVGRIKPGCPTEKRMDIRNGFIDTIGNTPLIRLNSLSEATGCNILGKAEFLNPGGSVKDRAALFIIEDAERQGKLRPGGTVVEGTAGNTGIGLAHICNAKGYRCLIVIPETQSQEKIDLLRTLGAEVRTVPAVPYRDPNNYVKVSGRLAEELDNAIWANQFDNLANRQAHYATTGPEIWQQTEGTVDAWVAATGTGGTYAGVALYLKEQSSKVRCVVADPMGSGLYSWVKTGEIHLEGSSVTEGIGNSRITANMQDVPIDDAIQIADPEALEIIYQLLHRDGLFMGGSVGINVAAAYRLAKEMGPGHTIVTVLCDGGARYQSRLFNAEWLASKGLQMPQVTT

SEQ ID NO: 31069 - protein, 324 aa, Synechococcus elongatus PCC 6301
MTAQAPTVICLGEMLWDCLANDRDLPAEQVQSWTPWPGGAPANVATALVKLGVQSGLITCLGSDPEGDRLFQVLQDNGVAIAAVQRHPRLPTRQVQVLRTAQGDRQFGGFGAIACDQFADTELQAEQLPQAWFRLAKVLCLGTIPLAYPSSAIAAQQALTWANQQGMTVLLDVNWRPSFWPDPSLAPDRIRAILPQIQQLKLAREEAEWLFDTVDPATIQARQPQLQAVLITDGDRGCHYWVAGWQGHCPSFPVKAIDTTGAGDAFVAAWLAQNTQMDFQWTSAEQVQTAIRWASAAGALTTLNPGAIAAQPTSDAIQSLLSKT

SEQ ID NO: 31070 - protein, 240 aa, Synechococcus elongatus PCC 6301
MARSQQFPSSTAVSVSPPAASSIAKPPQPVLDGLWAFAPNRDTLGGTAYFLKLPQGNWLIDAPAWHGETQAFVEEQGGLQGVFLTHRGAFGKAIAIQQHFDCDLVVQEQEAYLLPGANVTTFEQEQAIAPALTAIWTCGHSPGSACLYWEGHGGVLFTGRHLLPTRAGGVAPLRTAKTFHWPRQIRNTQMLCDRFSSETLAWICPGASSGFLRGRKAIASAYMQLQQLDWSALSEAQPLL

SEQ ID NO: 31071 - protein, 471 aa, Synechococcus elongatus PCC 6301
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELIIDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQCDYFGAHTYERTDRSGSFHAQWF

SEQ ID NO: 31072 - protein, 117 aa, Synechococcus elongatus PCC 6301
MPLIKLQTSIAALPSDQTTSLLQSLSTTLAQQLGKPERYVMTLLETDVPMTFAGTTAPACYVEIKSVGQMKPTQTAQMSRLFCNQIASELGIASDRIYIEFADAQGYLWGWNGSTFG

SEQ ID NO: 31073 - protein, 210 aa, Synechococcus elongatus PCC 6301
MVAAQLSARELFRAAYENRYTWDANFPGYRANVTYSDGNQSWQGAVEVSADLKPSISGIEEPEVVKLIHGQLFEVAIHRVRRGFEDTHGKNEFEFGNSDNDGTVEILVNGKSAGDRYKVRDNEVVLVHRHIHGVVVTINTFSTHKSAEGYLSHRYDSVYHDPTTGEQKGDRSEFEDEYITVGGYQLLSARTIRSDSGTISFRFSDLELLS

SEQ ID NO: 31074 - protein, 321 aa, Synechococcus elongatus PCC 6301
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFGSLYPGCVADTPLFRNTPKLFQKIFPWFQKNITGGYFTQELAGERVAQVVADPEFKTSGVHWSWGNRQQKDRQSFVQELSDKASDDRTAQRLWDLSAKLVGL

SEQ ID NO: 31075 - protein, 173 aa, Synechococcus elongatus PCC 6301
MPRTQRNDNFIDKSFTVMADLILKVLPTNKKSKEAFAYYRDGMSAQADGEYAEALENYQEALTLEEDPIDRSFILYNIALVHTSNGDHQTALDHYLQALDLNPKMPQALNNIAVIHHFLGQRSEEAGNDDEAERHYDQAAEYWTQAIRLAPNNYIEAQNWLKTTGRSKVDVYF

SEQ ID NO: 31076 - protein, 440 aa, Synechococcus elongatus PCC 6301
MGVERDMDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDADGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 31077 - protein, 134 aa, Synechococcus elongatus PCC 6301
MPKKAIPNQPLTGEALLQRVRELQDASKDQKARACGYVTITKNGRERVNSLQFLNALLEAQGITLDNELKLGRGRTGRSPSFRVSVQDNGNLLVGAAYTRKMGAKPGDAFTISLGRKQIKLQKVSEDGSEDTEE

SEQ ID NO: 31078 - protein, 186 aa, Synechococcus elongatus PCC 6301 [sequence omitted]

SEQ ID NO: 31079 - protein, 473 aa, Synechococcus elongatus PCC 6301
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRSHPYEFALYYDC

SEQ ID NO: 31080 - protein, 273 aa, Synechococcus elongatus PCC 6301
MAHPIPVVVNGATGKMGRETIKAIAAADDVTLVGAIARSADVQGQDIGEIVGLGPLEVPVTNDLEGMLCLASQEREVPVVVDFTHPDCIYDNVRKAIAYGVRPVVGTTGLNNEQLQELAEFAEKASVGCLVIPNFSIGMVLLMQAAIQASRFYDHVEILELHHDQKADAPSGTAIKTAQMLAELGKTFNPPKVTEKETMPGARGAVGPENIRIHSVRLPGLIAHEEVIFGAPGEILTLRHDTMDRSCYMPGVLLAVRKVRQLTGLIYGLDRIP

SEQ ID NO: 31081 - protein, 323 aa, Synechococcus elongatus PCC 6301
MNLEQALSGRLPIVYSDRFLDHDTGLGHPERPERLSATVTHLRSQPWSTALDWYLPTDLATRSPLPWIETCHSLHYIDSVQHLAERGGGSLDPDTPCSAASYEVALLAVNVWLDGIDRLLTRQSQAAFALTRPPGHHALATHGMGFCLFGNAAIAARYALAQGLTKVAIVDWDVHHGNGTQALVEQQPAIAYVSLHQSPAYPGTGSASETGFYENVRNLPLPPGSDGQDYRQCFETIVLPFLRAWQPQLLIVSAGYDAAAADPLANMRLQPADYGALTQQLRSLQIPILFGLEGGYDLPALSASVAATLAACLEPPSAPKQSG

SEQ ID NO: 31082 - protein, 1030 aa, Synechococcus elongatus PCC 6301
MNNGKVRIYELSKELNLDNKDVLAVCDRLEIPYKSYSSTLSEEQVVQVRQVLAGAAPSEPVAAASAADSPKAERKQEIVSVRRPTPQAAGGAKPEIVGRPTASEKPQAERPNIVAPPRRPAAANEPAKAPIKPARPEKSAEKPEIVTPRPPAPAASAEPAKSPSRPAPAATPRPVAETKKPKPAAAELLRKPEIVRRSEAKPERTSEAPTPRPKIERRPEQTGPARPQLGQPVAGNGVSKPAKPVKPIELVAPPSRPKVAASASGVPAAASRVLPNKPQKPTAPGGPELKQRPKPAAPASGEDLAATVDVFQPVPPLELRRPTAPARPARPRKGWEEEEDERAAANRKAGNKAAAKAKRRQLIQDDDDDDLLTAEQELAAADALNLAMSLARPSKPKVPQAKPAVAVMPTKGRKPRRESARERQHRRRMEREQKPVRPELISLRSSMTVQELAQLMVVPETDIIKSLFFKGIAATVTQSLDVATIEQVAEEFGILVEQETEESGARKTTQMVEDADAESLQTLPPVVTAMGHVDHGKTTLLDAIRKTRVAAGEAGGITQHIGAYHVDVEHNGDQHQIVFLDTPGHEAFTAMRARGARVTDIAILVVAADDGVRPQTLEAISHAKAAEVPLIVAINKCDKEEAQPDRVKQELTEYGLVPEEWGGETVMVPVSAIKGENIDQLLEMILLVTEVEELVANPDRAARGTVIEAHLDKARGPVATLLVQNGTLRVGDVLVAGSVLGKVRAMVDDRGDRVEAATPSFAVEVLGLGDVPAAGDEFEVYSDEKSARAVATSRADEQRQSRLQQAMASRRVSLGTVSAQAQEGELKELNLILKADVQGSVEAILGSLEQLPQKQVQVRVLLAAPGEITETDVDLAAASGAVIVGFNTTLASGAKRAADEAGVDVRDYDIIYKLLEDIQAAMEGLLEPELVEEPLGQVEVRAVFSIGRGAVAGCYVQSGKAIRNCNIRVRRGSNLVYTGTLDSLKRMKEDVKEVNSGYECGIGLDSFSAWQEGDIIETYRMVTKRRTLEV

SEQ ID NO: 31083 - protein, 211 aa, Synechococcus elongatus PCC 6301
MAPLSLSLPLDQLRFDERGLLPAIAQDYLDGTVLMLAWMNREALEKTLETGEVWYWSRSRQELWHKGATSGHFQKLQAIRYDCDSDALLLTIEQIGDIACHTGERSCFHRDVDVVTPPPADILTEVYRVVCDRRDRPSEASYTSKLFAGGDNKILKKIGEEAAEVVMACKDDDADGLAGEAADLFFHTLVALAQHNVDLRSVYRKLQERRR

SEQ ID NO: 31084 - protein, 125 aa, Synechococcus elongatus PCC 6301
MTSITPLTGKALLTRLKELGNASRSETAKACGYYSITKTGRERINFTAFYEALLASKGVAFDEAAPRKGRHPSYTVRVQSNGNLLIGSAYTKQLNLQVGDEFEIKLGRRQIRLVPVNGGDDDSEE

SEQ ID NO: 31085 - protein, 387 aa, Synechococcus elongatus PCC 6301
MDIQLGRGKTVRRAYGIDEIALVPGDRTVDPAVTDTRWTIGGIEREIPILASAMDGVVDVKMAVRLSQLGAIGVINLEGIQTRYEDPEPILDRIASVGPTEFVPLMQELYAVPVQESLIRKRIAEVKSQGGIAAVSATPAGAAKFGPVVAEAGADLFFIQATVVSTDHVAPEGVEPLDLAAFCQSMPIPVILGNCVTYDVTLKLLKAGAAGILVGIGPGAACTSRGVLGVGIPQATAVSDCAAARDDYERETGRYVPIIADGGLITGGDICKCIACGADAVMIGSPFARAAEAPGRGFHWGMATPSPVLPRGTRIKVGTTGTLEQILRGPAQLDDGTHNFLGALKTSMGTLGAQTLKEMQQVSVVIAPSLLTEGKVYQKAQQLGMGK

SEQ ID NO: 31086 - protein, 372 aa, Synechococcus elongatus PCC 6301
MDRAKAVAIAAGREVIDLSLGSSDLPAPDHVVAVIAASLQDPSTHGYLLHQGTLPFRQVAAAWYERKFGLGVDPETEVLLLIGSQEGTAHLPLAVMEPGEIALLQDPGYPSHAGGVYLAAGEIYRLPTTADRGFLPDFSTIPTEILSRSRLLVLSYPHNPTTAIAPLAFFEEAVAFCRHHQLVLAHDFPYPDLGFDGVEVPSIFQADRQKQQAIEFFSLSKSYNMGGFRVGFAIGNAELIGALRRLKAVVDFNQYQGILAGAIAALTGPQACVEATRQRFRDRRDIFINALAATGWTIPKPVSTMYLWAPLPEPWQTRSLEFCEKLVAETGVAASPGIGFGDCGEGFVRFALVHDRDRLEEAARRITQFLAR

SEQ ID NO: 31087 - protein, 326 aa, Synechococcus elongatus PCC 6301
MAATDFKDYYATLGVGRAASADEIKKAFRKLARQYHPDMNPGDKVAEARFKEINEAYEVLSDTDKRRKYDQFGQYWSRVGGPTGGPGPGVGFEDFEFGRYGSFDDFINELLGRFGGGATASASAGYRSPGFQDFAGGFGSQATAGARAVNLDAEASISLSLSDAFRGTQKQLRINSEMVEVKVPAGIKAGSKLRLRGKGNIMPNTGKRGDLYLKIEVKPHEFFQLEGDQLSCEVPIAPDEAALGATIAVPTPDGLVNVTIPAGVRTGQSLRLRGKGWPTRTGRGDLLVKVAIAVPKSLTEAERQAYEQLQRSRSTDLRSALMQYSL

SEQ ID NO: 31088 - protein, 130 aa, Synechococcus elongatus PCC 6301
MTTPDRSGLEPELGGSLRHGQARSGLEPELGGELRQKLVWVDEVTCIGCRYCSHVATNTFYIEPDYGRSRVVRQNGDPEELVQEAIDTCPVDCIHWVNPSELRQLEAERRNQVIMPLGFPQERSKQRRRT

SEQ ID NO: 31089 - protein, 464 aa, Synechococcus elongatus PCC 6301
MNLRTIRAELQQFLQLAIPLAAAQVAQAAVGFVDTVMMGRLGPEPLAAGGLASALFQFILATASGVVMAVSPLVAEAQGAGKDYKIAAIARQGLWLSVLLGLPVMLIISQLARLMPVLGQSATTIALARDYWMAVLWGIIPGLGFAMLRGYVAALEQARIILPLVLFGTLVNGLGNYLLGYGQLGFPRLELTGLGLSSALGLWVMFLGLLAYTAWQPKLRRYPFWQDWRRLQPSICRQILQLGWAIAVTVAVEFGLFTIITILMGAIGVEALAAHQTVSQTIILIFMVPLGCSFAVTVRVGWWLGRQDGLGARRAGLVGVGAIALWMLLLAIPLALFPRAIVGIYVDLNNPVNAGLLNLALPMLRVASLALVLDGVQRVAMGALHGLQDTRIPLLLSLLAFWMVGVGSSAMLGFQLGWGSTGLWIGQSLGVAIAGGLFLQRFLKLTQNRTFKQRLQPQPLATHP

SEQ ID NO: 31090 - protein, 344 aa, Synechococcus elongatus PCC 6301
MPKDKAVGIQVSQVSKQFGSFQAVKDVDLTVETGSLVALLGPSGSGKSTLLRLIAGLEQPDSGRIFLTGRDATNESVRDRQIGFVFQHYALFKHLTVRKNIAFGLELRKHTKEKVRARVEELLELVQLTGLGDRYPSQLSGGQRQRVALARALAVQPQVLLLDEPFGALDAKVRKDLRSWLRKLHDEVHVTTVFVTHDQEEAMEVADQIVVMNHGKVEQIGSPAEIYDNPATPFVMSFIGPVNVLPNSSHIFQAGGLDTPHPEVFLRPHDIEIAIDPIPETVPARIDRIVHLGWEVQAEVRLEDGQVLVAHLPRDRYRDLQLEPEQQVFVRPKQARSFPLNYSI

SEQ ID NO: 31091 - protein, 334 aa, Synechococcus elongatus PCC 6301
MIIRTPSSPANRSVMRIAQNITELIGRTPLVQLNRIPVADGCLARIVVKLESFNPSASVKDRIGISMILEAERKGLIAPDRTTLVEPTSGNTGIALAMAAAARGYRLILTMPDTMSSERRAMLRAYGATLELTPGIEGMAGCIQRAQEIVASHPEAYMLQQFKNPANPKIHRETTAEEIWADTDGTVDILISGVGTGGTITGVAEVLKERKPSFQAFAVEPANSPVLSGGRPGPHKIQGIGAGFVPEVLATQLIDEVVTVSDDEAIAYGRRLAREEGLLSGISSGAAVAAAVQVARRPENTDKLIVVILPSFGERYLSTPLFQEPELVSVSSNG

SEQ ID NO: 31092 - protein, 492 aa, Staphylococcus aureus subsp. aureus N315
MKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYHEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPAAVAVKHMNPCGVGIGDTIEQAFQHAYEADSQSIFGGIVALNRAVTPELAEQLHSIFLEVIIAPKFTDEALDILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 31093 - protein, 319 aa, Campylobacter jejuni
MKKLILTTGPSLGGKINLNQIHQDKFIYRINGAHGDIESIKNTIINLRKQKADIDILIDLPGNKIRTSGISEAIQVEKDKDFSLKIDQFNYKEFYKLVKPGMEVYANDSVFLFIVKEVNDKEIIFTSKSTGLLLNNKGMHVRNLHDNIPFLFEKDKELIKLCNEFDIAYVGASFVRKASDIQEIKQVLHSNTKIISKIETLEAVNNLYSILQEVEYILIDRGDLSTEIGIEKIPRFQNYIVEMAHHNAIKVFLATQILKNMEEKPIPTIAEIDDLYNIAKSGVFGVQLSEETAVGHYVEECVKILNLMQDEINNEKIIL

SEQ ID NO: 31094 - protein, 214 aa, Oryza sativa (japonica cultivar-group)
MAMAAAWSPALAAVLLAAAVASASNSEGDALYALRRALADPRGVLQSWDPTLVNPCTWFHVTCDRAGRVTRLDLGNSNLSGHLAPELGHLEHLQYLELYKNNIQGTIPAELGSLKNLISLDLYNNNITGTIPKELGKLSSLVFLRLNDNSLNGPIPRDLAKISSLKVIDVSNNDLCGTIPTSGPFEHIPLNNFDKNPRLEGPELQGLATYDTNC

SEQ ID NO: 31095 - protein, 306 aa, Oryza sativa (japonica cultivar-group)
MAAPPLPRAPVSSSAAAASPGGRALLLLRVGGGGSGRCAGVAAAAAPGWRRPFPAASVAARSAGTTPGEVAVDPKVEAILDSVKWDSKGLAVAIAQNVDTGAILMQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 31096 - protein, 510 aa, Oryza sativa (japonica cultivar-group)
MAVMEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 31097 - protein, 430 aa, Oryza sativa (japonica cultivar-group)
MDRIVGGKFKLGRKIGCGSFGEIYLATHVDTYEIAAVKIESSKTKHPQLFYEAKLYNALQGGSGIANVKWCGVDGEENVLVIDLLGPSLEDLFVYCGRKFTLKTVLMLADQMITRIEFMHSKGYLHRDIKPDNFLMGLGRKANQVYIIDFGLAKRYRDSTTNRHIPYRENKNLTGTARYASCNTHLGVEQSRRDDLESLGYVLLYFLRGSLPWQGLKAATKKQKYDKICEKKISTPIEVLCKSCPVEFASYFHYCHSLTFDQRPDYAFVKRLLRDLFTRQVYEFDYVFDWTVLRYKQGQKVQHGSGATITRATPGDLDKTAGVNGAFPHNEAREQTGPSHLAGSAAQLQVKRSTERGPHPNIQHTENITQDMTARKHLAASVLPGAEWRKDGNSRQLGQLDALHQKQSFVSNTGSSSGRFPTFLHDSPAN

SEQ ID NO: 31098 - protein, 336 aa, Oryza sativa (japonica cultivar-group)
MDGGGGGGGGGGVMAGPGVAGGGGGGGGGGVGGDVELVSKTLQFEHKLFYFDLKENPRGRYLKISEKTSSTRSTIIVPVAGVAWFLDLFDYYIRTDERDAFSKELRLDTKVFYFDIGENKRGRFLKVSEASVNRNRSTIIVPAGSSGEEGWEAFRNVLLEINNEASRLYVLPNHPNQVQETIPFFDIFMKSQMTSSLNSCHCIWQQHLEPPERLPGLSDDVGAGFIAGHGSQSASGPEVDVERLVDLPPQEEISGMGMSKVIRADQKRFFFDLGSNNRGHYLRISEVAGADRSSIILPLSGLKQFHEMVGHFVDIMKDRLEGMTGANVRTVESSQR

SEQ ID NO: 31099 - protein, 276 aa, Oryza sativa (japonica cultivar-group)
MTGSSCPADSSQLLYPRRGAPTTTTTSRPPLHPLIAHAPYDVVLHRSVVLSISSARDQAELASFWCYIRLGGGASAKRAAGEDDRSRSSLTAARGGGGETMSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 31100 - protein, 403 aa, Oryza sativa (japonica cultivar-group)
MVGMYQQQLVEDPFPLSGGYCSDQPRHAPASASTSTSTSSSAAVAASPLAQAHGAGEPRRLFEAFMGEILLPLRGEGGANGGGVGRGPGGVGDLGELLRWTREVAANPVAARPVPAEVKARKRQVLALRRARYLRMEDVANADELPSFFKKRKYRSHNNHAERQKGKGSMNMPTRKSERLAKRMKLMTSVLLTQRKKIGVGEHFQAEVPDWTEPPSDELARYKNDPNISKMLGTRIWPPEGQVLQTDKKIAGQGRMESCNCSYPGSFFCRQHHTDAARDQLRCELGRAFTEWRFDSMGEEVSKMWTREEQLKFNALERLVPVMDHKTFWAVASKHLASKTRIELVRYYLNVFLMRRVLSQCRLNLLEIDSDEDETEEEEDEDQSESTSTSQRTQHAQNVKSIS

SEQ ID NO: 31101 - protein, 169 aa, Oryza sativa (japonica cultivar-group)
MPRSRINGNFIDKTFSIVANILLRIIPTTSGEKRAFTYYRDGMLAQSEGNYAEALQNYYEATRLEIDPYDRSYILYNIGLIHTSNGEHTKALEYYFRALERNPFLPQAFNNMAVICHYGEQAILQGDSEIAEAWFDQAAEYWKQAIALTPGNYIEAQNWLKITKRFEFE

SEQ ID NO: 31102 - protein, 158 aa, Oryza sativa (japonica cultivar-group)
MGKRQQQRRLVRFAVAAAVVVAAALILTASAKKSGDVTELQIGVKYKPESCTLQAHKGDKIKVHYRGSLTDGSVFDSSYDRGDPFEFTLGNGQVIKGWDQGLLGMCVGEKRKLKIPAKMGYGERGSPPKIPGGATLIFDTELIAVNGKTTGGASNSEL

SEQ ID NO: 31103 - protein, 322 aa, Oryza sativa (japonica cultivar-group)
MSVIDILTRVDAICQKYGRYDAEKLHGSGVAGEDPFARLYASVDADLNECLEKAEAAKQEKNRATVVALNAEIRGTKAKLLEEDLPKLQRLALKKVKGLSKEELAIRGDLVTALPDRIQSIPDGSATSSKKTGLWGSSGSRAGTGIKFDSTYDLEWKLIYVGSAEDENYDQLLESVLVGPVNVGTYRFVLQRPVLILHWTCCIFAAILDADPPDPSKIRKEDIIGVIVLLLTCSYMGQEFIRVGYYVNNDNDDEQLREEPPAKLLIDRVQRNILADKPSVTKFPINFHPETSAGAGQEQQQQQQSGSPENHPNQGSKPNPDQ

SEQ ID NO: 31104 - protein, 486 aa, Oryza sativa (japonica cultivar-group)
MEAKPVAMEVEGVEAAGGKPRFRMPVDSDLKATEFWLFSFARPHMASFHMAWFSFFCCFVSTFAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 31105 - protein, 104 aa, Oryza sativa (japonica cultivar-group)
MAAAAAAAAAEEEIAVKEPLDLIRLSLDERIYVKLRSDRELRGKLHAYDQHLNMILGDVEEIVTTVEIDDETYEEIVRTTKRTIPFLFVRGDGVILVSPPLRTA

SEQ ID NO: 31106 - protein, 245 aa, Oryza sativa (japonica cultivar-group)
MHAAQPPGSSKRRGAVERPASGAGLQAEEASSAGPGAPCGACKFLRRRCVPGCVFAPHFSGCGGSGVGAGVGGRGRERGAAEFAAVHRVFGASNVAKLLSRVPAALRREAARTVCYEAQARIADPVYGSVGTILALQHQVSLLQGQLSVLESQLFNLRVALASAHPDTPPQHFVVLQPAHSAASTLNQVVVNYDDLPHAVDFMDAEPAALRGLESLQLSQPLQREEDEGHRDMNLFSDSVGQRQL

SEQ ID NO: 31107 - protein, 1997 aa, Oryza sativa (japonica cultivar-group)
MSTEDEKLLKEAKKLPWDERLQHKNWKVRNDANIDLAALCDSITDPKDARLREFGPLFKKTVADSNAPVQEKALDALLAFQRAADADASRYAKEVCDAIVAKCLTGRPKTVEKAQAAFLLWVELEAAEVFLESMEKAVKNKVAKAVVPAIDVMFQALSEFGAKVVPPKKILKMLPELFDHPDQNVRASSKGLTLELCRWIGKEPVKAILFEKMRDTMKKELEAELANVSGIAKPTRKIRSEQEKELEEEVVPEAAGTNNSEEAVPEAPMEIDEYDLVDPVDILTPLEKSGFWDGVKATKWSERRDAVAELTKLASTKKIAPGDFHEICRTLKKLITDVNLAVSVEATQAIGNLAKGLRTHFSGNSRVLLPVLLEKLKEKKPTMTEALSQTLQAMHKSGCITLLDVIEDVRVAVKNKVPLVRSLTLNWVAFCIETSNKATVLKLHKEYVPICMECLNDGTPEVRDASFSVLTAIAKMVGMKPLERSLEKLDDVRKKKLSDMIGSASDTTSGTVAASNTGVGTSAREVMDSSSMRRSAASMLSGKKPVQAVPATKKSGPAKSATAKKTDGGPQSKASAAPVIEDVEPSEMSLEEIEEKLSSVVKSETISQLKSTVWKERLEAISMLKQEVESLTELDKSAELLVRLLCAVPGWSEKNVQVQQQVIEVSTYIASTVNRFPKRCVVLCLLGISERVADIKTRGHAMKCLTAFCEAVGPGFVFERLYKIMKEHKNPKVLSEGILWMVSAVEDFGISNLKLKDTIDFCKDIGLQSSAAATRNATIKLIGVLHKFVGPDIKGFLSDVKPALLSTLDAEYEKNPFEGTASAPKRTVRAADAVSSASSGTSDGLPREDISAKITPTLLKNLGSPDWKLRLESIDAVSKIVEEAHKRIQPTGTVELFTALRARLYDSNKNLVMATLSTIGGLASAMGPAVEKSSKGILADVLKCLGDNKKHMRECTLTALDLWVAAAQLDKMVPYITVTLGDQKTGSEGRKDLFDWLSKHASNMSDPSEALPLLKPSASSLMDKSSEVRKAAESFMNEILKICGQDVVAKNLKDLPSPTLAIVAERLKLSTVHEGFSDSVKMVTTSMSLPSKAGSKNNKHGPNDRGSNVSKAVSQRGIPARSSVTMISSQDSIQSQALFNIKDSNKEERERRVLVRKFKFEEPRREQIDELKIELFRHFREDVSLRLWNSDFKRQIDGIELLQKALPSSRKEVIELLDILLRWFVLRFCESNTTCLLKVLDFLPELFDVLKDQSYMLTEAEAAIFLPCLMEKSGHNIEKVREKMGELIKQMVNIYSLPKLLPYILEGLRSKNNRTRIECVDIIGYFMDHHGTEVSGLLKNLPSVAALTAERDGEIRKAALNTLATAYKNLGDDVWRYVGKLSDAQRSMLDDRFKWKAREMDKRREGRPGDARAALRRSVRENGSDIAEQSGEAVSRSMAGSMISRENFGYSDAHMVPRQMATATPGPADWREALDIVALGLPEQSVEGMKVICHELTQAVDPESSVLDDLIKEADRLVSCLAVMVPKTFNFSLSGASSRSCKYVLNTLMQTFQIKRLAHAVKEGTLDNLITELLLWLLDERVPLMDDGSQLLKALNVLMLKILDNAERTSSFVVLINLLRPLDPSRWPSPTPPESLAVKNQKFSDLVVKCLIKLTKVLQSTIYEVDLDRILQSIHIYLQELGMEEIRRRAGADDKPLRMVKTVLHELVKLRGTAIKGHLSMVPIDAEPQPIILAYIDLNLQTLAAARMLTPSGTMGQTHWGDAGSNNPNPSTHSTDAQLKQELAAVFKKIGDKQTCTIGLYELYRITQLYPKVDIFAQLQNASEAFRTYIRDGLAQVEKNAAAGRTPSSLPLSTPPPIAPIPSPKFAPSPVHTKSINNKTDCNEDDAGGDTHPFRGQGEIDNRLQTTNLQTDRYQSSGTLDALRERMKSIQAAAVGANFDGVQARPLPSMNGNTLHGGTRLDADPQTQNIIPPMDERALSGLQARMERLKSGSMEPL

SEQ ID NO: 31108 - protein, 406 aa, Alcanivorax sp. EPR 7
IGGTCVNTGCVPSKIMIRAAHIAHLRTESPFDAGLSAQAPVVDRAKLLEQQQRRVEELRDAKYEGILRDHPAITVLHGEARFIDAHSLMVKLNEGGEQVVHFDRAFIGTGARPAVPPIPGLADTPYLTSTSALALDTLPERLIVIGASVVALELAQAFARLGSRVTVLARSRLLSQEDPAVGDAVEAAFRREGIEVLKQTQASRVDYTDNEFIVDTNAGTLRADQLLVATGRTPNTEALNLASLGVETAHGAILVDEHLHTTVPGLYAAGDCTDQPEFVYVAAAGGSRAAVNMTGGEATLDLSAMPAVIFTDPQVATVGLTEAEAIEQGFSVDTRELDLENVPRALVNFDTGGFIKLVAERDSGRLLGVQAVAGEAGELIQTAVMALRARMAVHDIANELFPYLRW

SEQ ID NO: 31109 - protein, 380 aa, Oryza sativa (indica cultivar-group)
MLRAVARCCGHWPPGAAAADGMLWQTELRPHAAGEFSMAAAQANLAMEDQAQVLASPAATLVGVYDGHGGADASRFLRSRLFPLVQRFEKEQGGMSTEVIRRAFGAAEEEFLQQVRQAWRQRPKMAAVGSCCLLGAISGDTLYVANLGDSRAVLGRRVVGGGVAVAERLTDEHNTASEEVRRELTALNPDDAQIVVHARGAWRVKGIIQVSRTIGDVYLKKQEYSMDPVFRNVGPPIPLKRPALSAEPSIQVRKLKPNDLFLIFASDGLWEHLSDDAAVQIVFKNPRTGIANRLVKAALKEATRKREVSFRDLKTIEKGVRRHFHDDISVIVVYLDRHRGRRHTRVVDSSSNCTNAPVDIYSSNSGQSVETLQAHRGSGW

SEQ ID NO: 31110 - protein, 464 aa, Escherichia coli
MSKQQIGVVGMAVMGRNLALNIESRGYTVSIFNRSREKTEEVVAENPDKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCITYIGADGAGHYVKMVHNGIEYGDMQLIAEAYSLLKGGLNLSNEELATTFTEWNEGELSSYLIDITKDIFTKKDEEGKYLVDVILDEAANKGTGKWTSQSSLDLGEPLSLITESVFARYISSLKDQRIAASKVLSGPQAKLAGDKAEFVEKVRRALYLGKIVSYAQGFSQLRAASDEYNWDLNYGEIAKIFRAGCIIRAQFLQKITDAYAENKGIANLLLAPYFKNIADEYQQALRDVVAYAVQNGIPVPTFSAAVAYYDSYRSAVLPANLIQAQRDYFGAHTYKRTDKEGVFHT

SEQ ID NO: 31111 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVSHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 31112 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 31113 - protein, 427 aa, Mannheimia haemolytica
QNLILNMNDNGFKVVAYNRTTSKVDEFLEGAAKGTNIIGAYSLEDLAAKLEKPRKVMLMVRAGEVVDQFIEALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 31114 - protein, 427 aa, Mannheimia glucosida
QNLILNMNDNGFKVVAYNRTTSKVDEFLEGAAKGTNIIGAYSLEDLAAKLEKPRKVMLMVRAGEVVDQFIDALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 31115 - protein, 427 aa, Pasteurella trehalosi
QNLILNMNDNGFKVVAYNRTTSKVDEFLAGAAKGTNIIGAYSLEDLAAKLEKPRKVMLMVRAGEVVDQFIDALLPHLEEGDIIIDGGNSNYPDSNRRVKDLAAKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDEDGTPLVEKILDTAGQKGTGKWTGINALDFGIPLTLITESVFARCVSSFKDQRVAASKLFNKTISPVEGDKKVWIEAVRRALLASKIISYAQGFMLIREASENFGWDINYGATALLWREGCIIRSRFLGNIRDAYETNPDLVFLGSDDYFKGILENAMADWRKVVAKSIEVGIPMPCMASAITFLDGYTSERVPANLL

SEQ ID NO: 31116 - protein, 310 aa, Chlamydomonas reinhardtii
PDIILSNATIKQLIGTKCDGVIGQLTEDWGAELFEALKQAGGKAYSNYAVGYNNVKVDEATKRGIPVGNTPGVLTETTAELAAALTLAAARRVPEADVFMRAGKYKGWLPNLFVGQLLQNKTVGIIGAGRIGAAYARMMVEGHKMNLVYFDPYPNKQLEEYIRLYGELLRHRGEPPVACKRVETVEEVLKEADVVSLHCNLDASTRHLINSQRLALMKPTAVLVNAARGPCIDEAALVAHLKANPEFRCGLDVFEDEPAMKPGLADCANAVIVPHIASASLWTRSGMAPLAPANVAGILSGYPVWNKQDI

SEQ ID NO: 31117 - protein, 435 aa, Arabidopsis thaliana
MGFLWRTRSNEKKITPVLSWPESEPESEITIPPEFQCPISIDLMKDPVIISTGITYDRVSIETWINSGNKTCPVTNTVLTTFDQIPNHTIRKMIQGWCVEKGSPLIQRIPTPRVPLMPCEVYEISRKLSSATRRGDYEKCGVIIEKIKKLGDESEKNRKCVNENSVGWVLCDCFDKFSGDEKLTFMLNEILSLLTWMFPIGLEGISKLASATSFRCVAGLLKSTDDSVRQNAAFIMKEILSLDETRVHSFAVENGVAEALVKLIRDSVSSSSTKSSLIAIYQMVLQKPEIASEFLEIGLVSITVEMIVDAENSVCEKALAVLDAICETEHGREEVRKNALVMPLLVKKIAKVSELATRSSMSMILKLWKTGNTVAVEDAVRLGAFQKVLLVLQVGYGEETKEKATELLKMMNTQMKLMSDCVDSLKEFKYIKKPF

SEQ ID NO: 31118 - protein, 278 aa, Silene vulgaris
EAHSLKVEKILFQGKSKLQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFRNPVNPIDKMEDEKRPLKFYNAEIHSAAFCLPSFAKRIIEAKANST

SEQ ID NO: 31119 - protein, 278 aa, Silene latifolia
EAHSLKVEKILFQGKSKYQDVMVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKAATEGSYDAVIVDSSDPIGPAKELFEKPFFESVAKALRPGGVVCTQAESIWLHMHIIEDIVSNCREIFKGSVNYAWTTVPTYPSGVIGFMVCSTEGPAVDFKNPVNPIDKTEDEKRPLKFYNAEIHSAAFCLPSFAKRIIEAKANST

SEQ ID NO: 31120 - protein, 278 aa, Silene latifolia
EAHSLKVEKILFQGKSKYQDVIVFQSSTYGKVLILDGVIQLTERDECAYQEMISHLPLCSIPNPKKVLVIGGGDGGVLREVARHSSVEHIDICEIDEMVVTVSKEFFPEVAVGYDDPRVNLHIGDGVAFLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 31121 - protein, 150 aa, Silene latifolia
FLKVAPEGSYDTVIVDSSGPIGPAKELFEKPFFESVAKALRPGGVVCTQAESIWLHMHIIENIVSSCREIFKGSVNYAWTTVPTYPSGVIGFMVCSTEGPAVDFKNPVNPIDKTEDEKRPLKFYNAEIHSAAFCLPSFAKRVIEAKAKST

SEQ ID NO: 31122 - protein, 193 aa, Exophiala dermatitidis
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQTDLRDDPQVREKLAKQKMQPVRKEDGERMAKELGAVKYVECSALTQYKLKDVFDEAIVAALEPPPKKSSKKCTIL

SEQ ID NO: 31123 - protein, 359 aa, Lycopersicon esculentum
MVFPLDSQLQNPISALLDGLYCEEDRFLDDDLGEWSSLDVGNENVKKTLPLLECDMFWEHDELATLLSKENEFHLGFQSLISDGSLMGARKEALDWMLRVIAYYGFTATTAVLAVNYFDRFVSGWCFQKDKPWMSQLAAVACLSIAAKVEETQVPLLLDLQVADSRFVFEAKTIQRMELLVLSTLKWKMNLVTPLSFIDHIMRRFGFMSNLHMDFLKKCERLILDIITDSRLLHYPPSVIATASMFYVINDIEPSNAMEYQNQLMSVLKVRKDIFEECHDLILELMDTACYKLCQSLKRKHHSVPGSPSGVIDAYFSSESSNESWSVASSISSSPEPQYKRNKTQDQRMTLAPLGSNLH

SEQ ID NO: 31124 - protein, 464 aa, Schizosaccharomyces pombe
MAPISKVFDYLVIGGGSGGLASARRAAKHGAKVALIEASGRLGGTCVNYGCVPKKIMWNIADLVAKMKTAKQNGFPNSQLGSFDWGMIKRKRDAYIGRLNGIYERNVNKDGVAYISGHASFVSPTEVAVDMNDGSGTQVFSAKYILIAVGGHPIWPSHIPGAEYGIDSDGFFELESQPKRVAIVGAGYIAVELAGVFAALGTETHMFIRQSKFLRKFDPIISDGIMDHFQHIGINVHTNSLEFKKVEKLPSGELCIHQQDGSTFNVDTLLWAIGRAPKIQGLRLEKAGVKTLPNGIIIADTYQRTNVPTVLSLGDVCGKLELTPVAIAAGRRLSDRLFGGIKDAHLDYEEVPSVVFAHPEAGTIGLTEQEAIDKYGESQIKVYNTKFNGLNYSMVEQEDKVPTTYKLVCAGPLQKVVGLHLVGDFSAEILQGFGVAIKMGATKSDFDSCVAIHPTSAEELVTLV

SEQ ID NO: 31125 - protein, 468 aa, Yersinia aldovae
MLLPVIMAGGTGSRLWPLSRTLYPKQFLALTSELTMLQETLTRLDGISHQPALIICNEEHRFIIAEQLRQLHIEHSGIVLEPAGRSTAPAIALAALLARSRGEDPLLLVLAADHVIQDRTTFIDSIISALPLAEAGKLVTFGIVPDAPESGYGYICRGMSVGDNAYKVDAFVEKPDQSTAEKFIASGGYYWNSGMFIFKASRYLQELELYRPEIFASCKKAIDGCRNDLDFIRLNEEPFLNCPEDSIDYAVMEKTSDAVVVPMDAKWSDVGSWSALWALNEKDGNGNVIRGDVLIENTNDSYIYSKNKLVATVGVNDLIIVETKDAILVAHKDKVQDVKSIVAQLKKNSRTEHLQHREVYRPWGSHDSIAEGERYHVKHLIVRPGQRTAMQIHHHRAEHWVVVSGTAKVYRGDEIFLVTENESTYIPVGLAHAIENPGKFDLEIIEVRSGSYLQEDDIVRIDHKNAGY

SEQ ID NO: 31126 - protein, 495 aa, Pseudomonas sp. MT-1
MRVSTLFEWKRPEIRALHLTWIAFYICFFVWFGMAPLASSMLKSVNWLTPEDLKLFAIANVALTIPARILVGMALDHWGPRRVFSVLLVTMAAPALFFAFGDSRTQLLVSRLILGSIGASFVVGIHMTAMWFKPKDIGFAEGFYAGWGNFGSAAAAMSLPAIAIHAFGGPEGWRWAIASSAIIMAVYGVYYWFALTDGPVGTIHRKPHKASALEVSTWADMVKLIIWTIPMVGVLGILVWRIEGLGYLGATGAAICYSVIALVVIFQVVQILRVNIPILKKGVPEDDKYPFNTVAALNSTYFANFGAELAVVSMLPMFFELTWGLTPTTAGIIAASFAFVNLVARPMGGLVSDRFGNRRFVMLAYMLGIAVGFFLMGLMNASWPLIVAVAITVACSMFVQGAEGATFGIIPSIKRRVTGQISGMAGAYGNVGAVCYLTLYTFVTPSQFFMVIAAGAFVSFGLCLLWLKEPEGAFSDEYYVSSVDRELEARQKLAS

SEQ ID NO: 31127 - protein, 305 aa, Sulfolobus shibatae
MPLDPRIKKLLESGFVVPIGKASVDEVRKIFRQLASAAPKAEVRKVEDIKIPGSETSINARVYFPKAKGPYGVLVYLHGGGFVIGDVESYDPLCRAITNACNCVVVSVDYRLAPEYKFPSAVIDSFDATNWIYNNLDKFDGEMGIAIAGDSAGGNLAAVVALLSKGKLDLKYQILIYPAVGFDSVSRSMIEYSDGFFLTREHIEWFGSQYLRSPADLLDFRFSPIIAQDLSGLPPALIITAEYDPLRDQGEAYANRLLQAGVPVTSVRFNNVIHGFLSFFPLIDQGKDAIGLIGSVLRRTFYDKS

SEQ ID NO: 31128 - protein, 319 aa, Oryza sativa (indica cultivar-group)
GVLRDGTTVAVKVLSATSRQGVREFLTELTAISDIKHENLVTLIGCCAEGSHRILVYNYLENNSLAQTLLGSRGSNIRFDWRTRVKIAVGVARGIAFLHEEIRPPIIHRDIKASNILLDKDLTPKISDFGLARLLPPNATHVSTRVAGTLGYLAPEYAIRGQVTKKSDIYSFGVLLLEIVSGRCNTNTRLPYEDQFLLERTWVRYEQERLAEIIDADLGNDLDVDEACRFLKIGLLCTQDAMARRPNMSTVVRMLTGEKHFSVHRITRPAMITDFADLKVSSSQQKENETTRSSNMRSFSTTDETEPFSSSETPTQTSI

SEQ ID NO: 31129 - protein, 131 aa, Allium cepa
ATAMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 31130 - protein, 136 aa, Allium cepa
SLALLATTMEAMAATAMAKDPTGQMMLSGFQGLRSVGSVPVGRSVKALPIPSSFSSSVITAVAVPEVKRSKVEIFKEQSNFLRYPLNEELLTDAPNINEASTQLIKFHGSYQQYDRDERGKRSYSFMLRTKNPCES

SEQ ID NO: 31131 - protein, 240 aa, Allium cepa
RSYSFMLRTKNPCGKVPNELYIAMDTLADEFGIGTLRLTTRQTFQLHGILKKNLKTVMSTIIHNMGSTLGACGDLNRNVLAPAAPYTKKEYVFAQETADNIAALLTPQSGFYYDMWVDGEKIMTSEPPEVTKARNDNSHGTNFPDSPEPIHGTQFLPRKFKIAVTVPTDNSVDILTNDIGLVVISDSNGEPQGFNLYAGGGMGRAHRTDTTFPRLAEHLGYVPKEDILYAIKAIVVTQRE

SEQ ID NO: 31132 - protein, 127 aa, Allium cepa
LFCGLHIDNGRLKGQAKETLREIIEKHNLSVRITPNQNMILCDIDPSWKESINAALSQVGILEPQYVDPLNITSMACPALPLCPLAIAEAESGIPDILKRVRAVIDKVGMGKEESVVIRITGCPNGC

SEQ ID NO: 31133 - protein, 478 aa, Streptomyces coelicolor A3(2)
MRRAKIVCTLGPATDSYDQIKDLVDAGMDIARFNFSHGTHAEHEERYHRVRKASDETGRSVGALADLQGPKIRLGHFGEGPVLLERGDSFTITVEEGVEGDRYICGTTYAGLAEDVTPGERVLVDDGKVCLEVTGVDGTRVRTRVIEGGMVSDHKGLNLPGVAVSVPALSKKDEDDLRWALRAGFDVVALSFVRSGRDILDVHRIMDEEGRRLPVIAKVEKPQAVENIEDIVAAFDGIMVARGDLGVEMPLEQVPTVQKRAVKLAKRNAKPVIVATQMLDSMIDNARPTRAEASDVANAVIDGTDAVMLSGETSVGKHPTDTVRTMARIVEAAEEDILAKGLPPLTERNKPRTQGGAVARAAAEMGDFLGAKFLVAFTQSGDTVRRLSRYRSPIPLLAFTPEPATRSQLSLTWGVETFLGPHADSTDAMVDQVDELLTRYGRCEKGDVVVITAGSPPGVSGTTNLVRVHHIGEDDIPK

SEQ ID NO: 31134 - protein, 331 aa, Streptomyces coelicolor A3(2)
MEILAFGVQADEKPLIERAFRDHEDVRCLDVFLNEDTAPIAAGHEIVSTSVNADLGAAVLEILAAGGTRMVAQRSTGFNNVDLDTADRLGMTVARVSYYSPHSVAEFAWALAMAVNRRIVRASIRTRDFDFRLDGLMGRDLHGRTAGVLGTGKIGEAFARIAHGFGMRLLGWDVAENPACAELGMRYVAKDELLARSDLITLHVPLMAETRHLIDATALKAMRDDAILINSSRGGLIDTAALVGELRAGRFAGVGLDVYEAEAGLFFLDKSLEAVEDDTLARLVTFPNVLVTSHQAYYTEDAVGQIVGTTVRNVLDYREGRRSENVLVPRS

SEQ ID NO: 31135 - protein, 174 aa, Ammopiptanthus mongolicus
MISSPAVTTVKASMGAPFTGLKSMASFPVPRKVNSDITTIANNGGRVQCMLVWPPLGRKKFETLSYLPPLSIESLTKEVEYLLRKGWVPCLEFELEHGFVYRENNRSPGYYDGRYWTMWKLPMFGCSDASQVMKELEECKKEYPTAFVRIIGFDNKRQVQCISFIAYKPPGFEN

SEQ ID NO: 31136 - protein, 485 aa, Bacillus sp. KSM-K16
MWETKFQKEGLTFDDVLLVPAKSEVLPRDVSVATKLSENVKLNIPILSAGMDTVTESEMAIAIAREGGIGIIHKNMSIEEQAEQIDKVKRSESGVITDPFFLTPDRQVFDAEHLMGKYRISGVPIVDEEQKLVGILTNRDLRFIEDYSIKIDDVMTKEGLVTAPVGTTLEQAEKILQQHKIEKLPLVDDNGILKGLITIKDIEKVIEFPNSAKDKQGRLLVGAAIGVSADADARIAAVVKAGVDAIVIDTAHGHSKGVLDKIKQVRNDYPDLTIIAGNVATAEGTRALIEAGASVVKVGIGPGSICTTRVVAGIGVPQITAVYDCATEARKHGVPIIADGGIKYSGDIVKALAAGGHAVMLGSLLAGVSESPGETEIYQGRQYKVYRGMGSLGAMEKGSKDRYFQENNQKLVPEGIEGRTSYKGPLADTVHQLVGGIRAGMGYCGTPTIDELRENSQFIRITAAGLRESHPHDVQITKEAPNYTL

SEQ ID NO: 31137 - protein, 404 aa, Bacillus sp. KSM-K16
MAIEKSDHIIEQTNAYGAHNYHPLPVVIAEAEGVWVKDPEGNKYMDMLSAYSALNQGHRHPKIIQALKEQADKVTLTSRAFHNDQLGPWTKRVAELTGKDKVLPMNTGVEAVETAIKAARRWAYEVKGVEENKAEIIAAKGNFHGRTLNAVSLSNDPGATKHYGPFVPGIKKVAYGNVEVIREAITPNTAAMIIEPIQGEAGIIIPPEGYLQAVRDLCTENDILFIADEVQTGFARTGKMFACEWENVVPDIYVMGKAMGGGVFPVSAIAADKDIMDVFTPGSHGSTFGGNPLACAVSLAAIEVIEEENLVKKSLELGEYFTTALRAIDNDDLTAIRARGLFIGVEFNHPVRKYCEQLKEAGVLCKETHENTIRFAPPLVITKEELDWAIEKINYVLSKEKPVK

SEQ ID NO: 31138 - protein, 399 aa, Bacillus sp. KSM-K16
MTKMNNAKFATKAVWAGEKDYLVHGATQVPVIPSVAFGYDDMDEWYEVAVGRKKGHIYGRNTNPTVQAFEDKVKVLERANAATSFSTGMAAISNTLYTFLRPGDRVVTIKDTYGGTNKIFTEFLPKLNIDVVFCETGDVEQIKKETAKGCTIVYLETPTNPTVKITDIRACAEAGKQVGALVVVDNTFATPVNQNPLTLGADLVLHSATKFLGGHADALGGVVVGLDESLIEAIYHYREINGATMDPWAAYLILRGMKTLELRVKRQAENAEKLATYLQTVEEVETVFYPGLIDHPNHEIAKAQMSGFGGMLSFAVAGGVDTVRHLLPKLAFANRAANLGAVETTVGPARTTSHVECTPQERAAMGIPEGLIRVSCGIEDGEDIIADFKQAFEAAQIEA

SEQ ID NO: 31139 - protein, 240 aa, Bacillus sp. KSM-K16
MIKVTDLHKSFGDHEVLKGITTDIREKEVVCIIGPSGSGKSTFLRCLNRLEDITSGEVVIDGVNIADPKTNINAVRQEVGMVFQHFNLFPHKTVLENITLAPLKVRGIEKGEAVAAAKKLLEKVGLEDKADAYPASLSGGQKQRVAIARALSMNPKVMLFDEPTSALDPELVGDVLSVMKELALEGMTMIVVTHEMGFAREVGDRVFFMDEGRLVEEGTPVEIFEQTKNERTKSFLSKVL

SEQ ID NO: 31140 - protein, 349 aa, Bacillus sp. KSM-K16
MSKTSERRMMKAAVVNQFNQQLEIKEVPVPTVEYGEVLVKIKACGVCHTDLHAAHGDWPVKPKLPLIPGHEGVGIVEEIGEGVTSIKVGDRVGIPWLYSACGECEYCLTGRETLCPDQLNAGYSVDGGYAEYCKAPANYIVKIPENLDFAEVSPIFCAGVTTYKALKVADAKAGDWVAIYGIGGLGHVALQYAKAMGYNVVAVDIMEDKLELAKRLGADLTVNGLQVDPVQEIKEKVGGVQAAISVAVTKKAFEQAYGSVKRGGTLVVVGLPNDELPIPIFDTVLNGVTVKGSIVGTRKDLQESIEFAAQGKVRTNIETQPLDKINEVFERMENGKINGRVVLTIDETA

SEQ ID NO: 31141 - protein, 498 aa, Bacillus sp. KSM-K16
MSQVPTGENSLKTRLVSFLNGGSKKLLINGEWVDAVSGQTFETMNPATGDTLAIVAEAGQEDIDSAVKAARKAFDEGPWSKMSAAERSRLIYKLADLIEEHKEELAQLETLDNGKPIRETANADVPLAIEHFRYFAGWATKIVGQTIPVQGNYFNYTRHEAIGVVGQIIPWNFPLLMAAWKLGAALATGCTVVLKPAEQTPLSALYLGELINEAGFPKGVVNIVPGFGHSAGTAIVNHPAVDKVAFTGSTNVGKLIMKQASESLKRVTLELGGKSPNIILPDADLSKAVPGSLMGIMFNQGQVCCAGSRLYVQKKQYDHVVADLVSLTKKINQGDGLLEHTTMGPLISTQQQKRVKNYIDRGVEEGAELLAGGTIPYDQGYFVSPTIFADVDHSMTIAKEEIFGPVVAAMPFESVDDLIGKANDSDYGLAAGVWTQDIKKAHYIAHRIKAGTIWVNCYNVFDAASPFGGYKQSGIGREMGSYALDNYTEVKSVWVNMD

SEQ ID NO: 31142 - protein, 327 aa, Bacillus sp. KSM-K16
MVVFLLAFGAFSMPAYGQEGAEAANVNFSMQGFATLNGGTTGGAGGDVVTVSTGDQLIAALKNKKANTPLTIYINGTITPANTSASKIDIKDVNDVSLLGVGTNGELNGIGIKVWRANNVIIRNLKIHHVNTGDKDAISIEGPSKNIWVDHNELYNSLDVHKDYYDGLFDVKRDADYITFSWNYVHDSWKSMLMGSSDSDSYGRKITFHNNYFENLNSRVPSVRFGEAHIFSNYYADIREAGINSRMGAQVRIEENDFERANNPIVSRDSKEIGYWHLVNNRYVSSTGEQPTVSTTTYNPPYSYQATPVNQVKDVVRANAGVGVISP

SEQ ID NO: 31143 - protein, 179 aa, Bacillus sp. KSM-K16
MKNDMKEILLTEEQIQQKIKELGQAITKEYEGRFPLVVGVLKGALPFMADLIKAVDTHLEIDFMDVSSYGKSTVSSGEVKIVKDLDTKVEGRDVLIVEDIIDSGLTLSYLIELFKYRKAKSVKVVTLLDKPEGRKVDLVPDMTGFVVPDEFVVGYGLDFAERYRNLPYVGILKPEVYEG

SEQ ID NO: 31144 - protein, 312 aa, Bacillus sp. KSM-K16
MTVVNNITELIGNTPLVKLNRLATAEHADVYLKLEYQNPGSSVKDRIALAMVNAAEESGELKPGATIVEPTSGNTGIGLAMVAAAKGYKTKLVMPETMSMERRNLLRAYGAELVLTPGPEGMGGAIRKATELAKQDGHFMPQQFENSANPKIHRETTGKELLKQVDGQLDGFVAGIGTGGTITGAGGLLKEHFPELKIVAIEPKDSPVLSGGKPGPHKLQGIGPGFVPGILNTNVYDSVLQVSTEQAFEYARRAAREEGILGGISSGAAIYGALELAKELGPGKKVVAIIPSNGERYLSTPLYQFEEETTHS

SEQ ID NO: 31145 - protein, 482 aa, Bacillus sp. KSM-K16
MELFLRFYLLFGTLHVVNPNGGMGYMAKQKTKFVCQECGYESAKWMGKCPGCQSWNTMVEEINILEKQKNRSYVTSSGTRQKPQPITAVQGEKEPRVSTTMAELDRVLGGGIVPGSLVLVGGDPGIGKSTLLLQLSAKLANVNERVLYISGEESVKQTKLRADRLELASDQLYVLAETDIALIEGAIDEVQPSLVIIDSIQTVYQDEITSAPGSVAQVRECTAAFMRVAKTKGVAIFIVGHVTKQGSIAGPKLLEHMVDSVLYFEGERHHSYRILRAVKNRFGSTNEMGIFEMKQLGLEEVKNPSEIFLEERSQGAAGSVVVASMEGTRPVLVELQALISPMGFGNPRRMATGLDHNRVSLLMAVLEKRAGMLLQNQDAYLKVAGGVKLDEPAIDLAIALSIASSFRDQPTEPMDVAIGEVGLTGEIRRVSRIDQRVNEAAKLGFKRVIIPEKNKGGWTAPAGIEVIGVQTLEQAIEVVLGR

SEQ ID NO: 31146 - protein, 143 aa, Bacillus sp. KSM-K16
MEAGVMMSTNREWRQLNGLALAYMGDAVYEQRVRYELLKQGAVRPNRLHKAATTYVSAKAQAAVLFQMGEQGILTEEEQAIVRRGRNAKSHTTPKNTDVVTYRNATGFEALLGYLYLTNKHERLEELLKLALTMAAQKEGNPS

SEQ ID NO: 31147 - protein, 217 aa, Bacillus sp. KSM-K16
MNLILMGLPGAGKGTQAEKIVNDYGIPHISTGDMFRAAMKNETELGLKAKSFIDAGDLVPDEVTIGIVKERLSEDDCENGFLLDGFPRTIAQAEALEGILSSLGKQLDHVLNIAVPKELLMERLTGRRVSPTTGKTYHIVYNPPKVEGKCDIDGSDLIQRDDDKPETVKRRLEVNEKQTKPLIDFYEAKGYLRQVDGNQDMNTVYADIKAILSEKRA

SEQ ID NO: 31148 - protein, 511 aa, Bacillus sp. KSM-K16
MRIVTGEEMASIDAITMNKVGLPGAVLMENAGRGIARKLLDHYGRKRRFFIVIGSGNNGGDGFVVARVLKDEGAEVQVFIVPEESRYKGDAKLHKRVFEQSGYRWKYWKDIESQWPAMLYETDIIVDALLGTGISGQVKEPYASVIASINKLKNEIVSIDLPSGVPAGSAELNHEAIKADRTLTLQWTKVSYYLEETKPYYGEVDVVPIGIPPNTLRHLASQRYIWGKNEVVNSWVMSKPNAHKGDNGRVGIIAGSEAMPGAAALAGSAAVRSGAGFTTIATVAQNVPVIASHVKEAMYTIFSEKHGYLAPTETELAAFMDNKQSIAVGPGLGRTPALTKMVAYLLVHFKGVLILDADALHCLKECGPIVQERTAPTVITPHPGEMAMLIDQSVSYVNKNRFEVAESYAEQYGVYVVLKGPNTIVAEPSGCISVNVTGNAGLAKGGSGDVLTGMVAALVARQRIQPALSSAVFFHGYAADLLAKQRHVLATITPSDIIEHLPEAFSIVDDD

SEQ ID NO: 31149 - protein, 462 aa, Bacillus sp. KSM-K16
MTTYLFPPDFWWGTAVSATQIEGAADRDGKGKNIWDHWYEIEPNRFFNEVGPAKTSQFYDRYKDDIALMKKLGHTSFRFSISWSRLIPAGNGAVNEKAVQFYDQVIDELLAAGITPFVNLFHFDMPMAMQKIGGFENREVAYAFARYAEICFTHFGDRVKTWFTHNEPIVPVEGGYLYEFHYPKVVDFKRAVQVGYHTMLSSALAIERYRRLGQGGKIGIILNLTPSYPRAEENERDVEAAKLADAFFNRSFLDPSVKGTFPQELVAILKQYGLMPHVEEGDKAVISGNTVDLLGVNYYQPRRVKAKETPIGDGPLMPGTFFDSYDMPGKKINPHRGWEIYEKGIYDLLMNIKDHYGNIECFISENGMGVEGEEKFRDEAGVIQDDYRIEFISNHLRWLHKALTEGANVKGYHLWTFMDNWSWTNAYKNRYGFVSVDLEKDGKRTVKKSGWWFKTVIENNGF

SEQ ID NO: 31150 - protein, 309 aa, Bacillus sp. KSM-K16
MLCRSNDELELLISQARAFAGQGEVAQYIPALAAAHKHELSVALYYPDGKGFMAGDTEENFTLQSISKVLSLALALIDQGEECVFTRVGKEPTGDPFNSIAKLETNKPSKPLNPMINAGALAVTHMIKGNTAGERFERLLDFIRCLTGNETITYNKEIAKSEFETAHLNRALVYFMKEHGVIDEDVEELMDLYTKQCAIEMNCIDLARVGCVLAMDGCDPDTGKQLLPIDVARICKTFMVTCGMYNASGEFAINVGIPAKSGVSGGIMGAVPKKCGIGICGPSLDEKGNSIAGIKLLEMMAKRYSLSMF

SEQ ID NO: 31151 - protein, 472 aa, Bacillus sp. KSM-K16
MNHALFINNECVATDDMIEVENPATKEVIGTVANGGKQEALAAVDAAAAALPEWRAKTAAERGAYLQKWYELIQREEEEIAKLMTLEQGKPFAEALGEVRYANSFLSWYAEEGKRVYGETVPAAATNKRIFVQKQAIGVIAAITPWNFPAAMLTRKLGPALAAGCTAVMKPSELTPFTAYRIVELAKVAGIPKGVVNMITGDAQQIGETWMADERVRKVSFTGSTRVGKLLMRQAADTVKKLSLELGGHAPFIVTAQADIQKAVDGLIASKYRNGGQTCVCANRIYVHESIKAPFVEAFAAEMKKLKVGNGMEPDSHIGPLINEAAVAKVQKHIEDAQAKGGEVIFGQEADATNGYFQTPALIANATDDMLCMKEETFGPLAPIATYTSTEDVIERANHSPYGLAAYVYSNDLSEAVTIAERLEYGIVGLNDGLPSVAQAPFGGMKESGLGREGGHWGIEEYVEVKYISLQL

SEQ ID NO: 31152 - protein, 426 aa, Bacillus sp. KSM-K16
MNETMSIFNELESEVRSYCRSFPAVFTKAKGWKMWDEDGTEYIDFFAGAGALNYGHNDEKMKRALIDYIADDGITHSLDMATKPKAAFLKKLNEVILKPRKLNYKVMFPGPTGTNTVESALKLARKVTGRTEIISFTNGFHGMTIGSLSVTGNASKRKGAGIPLTNVVTMPYDKFGDEEVDTLRYLEQFLHDNGSGVDIPAAVILETVQGEGGINAARMEWLQQLERICKKYDILMIIDDVQAGIGRTGTFFSFEEAGITPDIVCLSKSIGGYGLPLALTLFKPELDIWAPGEHNGTFRGNNHAFITATAALSYWEDPSFEQAIKDKSKKIHAFLTKLVDSYPEMDGCVKGRGFMAGIGSKVDGLAGKVAAEAFKRGLIMETAGPEDEVFKLFPPLTISDEDLEKGFAIIEESVRAVLGVKEPVTT

SEQ ID NO: 31153 - protein, 300 aa, Bacillus sp. KSM-K16
MKPYSTFGIVGFPWDGGASLGRPGSRFAPEKIREAFAWFANRIENNQVYNVEKRKTFTLPKNALTDYGNIEIAAYSTDQTFAQAEAKLKAVLADHAFPFVLGGDHSISYPLIKALHDQNPGKRIGIIQFDAHLDLVDESPVQGRFSQSSQMRRAIELEHVSAKDIVQVGVRSYNYPWYATYLKDIGIHQITAQEVHQSDPLAIAEQIKSVMENVDLVYLTYDMDVLDPAYAPGVGANEPGGLTPVQSFAILDALYPLVDAFDIAEVNPLYDHQDITTAMAARIMFDCFVARMECGENAQT

SEQ ID NO: 31154 - protein, 326 aa, Bacillus sp. KSM-K16
MGIQFQEGKQFDVIALGRACIDLNAAEYNRPMEETRSFTKYVGGSPANIAIGSAKLGLKVGFVGKIPDDQHGRFISSYMREAGVDTSQLVIDREGHKAGLTFTEILSPEECSILMYREKAADLYLSPDEIDAGYVRSAKVLLISGTALAQSPSREAALKAVSLAKAAGTKVVFELDYRPYTWSSREETSVYYTLLAGMAHIVIGTREEYDIMEGASASGNEQTAKMLFAKEPELVVIKHGVDGSYAYLPSGETFRAGVYKTNVLKTFGAGDSYASAFLYGLLRGYDIDQALRFGSASASIVVSKHSSSEAMPTLSEIKALVEEQHV

SEQ ID NO: 31155 - protein, 478 aa, Bacillus sp. KSM-K16
MDAHNFIYGQWVPAVDGQTAKSINPGNLNDTVGTYQDSTEADVEQAVQAAQEAAKPWRKLSGAERGAFLYKTADIMEERLDEIAKTAAREMGKTLAETKGETLRGIAILRYYAGEGLRKNGDVIPASDAKALMYTTRVPLGVVAVITPWNFPIAIPLWKTAPAIIFGNTVVLKPASETAVTCAKVVACFEAAGLPPGVLNFITGSGAKVGQSLVEHHRVNAITFTGSNTTGKKIGQTALARGAKYQLEMGGKNPVIVAADADIEQAVDATLSGAFKSTGQKCTATSRAFVDRAVYSTFKKLLLEKTKEIVVGDSLDAKTWMGPLASQNQLANCLAYIEKGLSEKATLLTGGHAIDQEKGSFIEPTIFECRDHHSSIAQEEIFGPVLALFEVDGIEEALRLANDVPYGLSASIFTKNIANMLAFIEDMDAGLIRVNAESAGVELQAPFGGMKQSSSHSREQGEAAKEFFTATKTIFVKA

SEQ ID NO: 31156 - protein, 462 aa, Bacillus sp. KSM-K16
MAHAYSFPKDFWWGSAVSATQIEGAANEGGKGKNIWDHWYELEPNRFFEEVGPSATSDFYHRYQDDIALMKAIGHNSFRFSISWSRLIPGGEGEVNKEAVAFYNNVIDELIANGIEPFVNLFHFDMPFELQEKGGWENREVVELYAQYAAACYDLFGDRVKKWFTFNEPIVPVEGGYLYDFHYPNIVDARRAFQVAYHTVLAHALAVAAFRTRSIEDGKIGIILNLTPSYPRSDHLGDQKAAAIADLFFNRSFLDAVVLGSFPKELVALLDEYGQLPTYEKEDVALINAQRIDLLGVNYYQPRRVKAKEHLPNPASPFMPEWFFDHYDMPGRKMNHYRGWEIYEKGIYDIMVNLKDNYGNIESFVSENGMGVQNEERFMENGQIQDKYRIEFIKGHLKWLHQAIQEGCNVRGYHLWTFMDNWSWTNAYKNRYGFISVDVQTQKRTPKKSAEWIKAVSQQNGF

SEQ ID NO: 31157 - protein, 239 aa, Bacillus sp. KSM-K16
MIKVSNLTKEFMQGQEATQVLKGVDFTIKEGEFVAIMGPSGSGKSTLLQLLGGLDVPTAGEIEIDGKPLHQMKEKERTIFRRQKLGFVFQNYQLLPTLTVEENVAFPLHADGKWTSEHSQAVNDLIDSVGLKGLNRKRVNLLSGGQQQRVAIARALVHNPTVLLADEPTGNLDRAKAEEILALLSTFHRKDKQTVVMVTHDIFAAGFADRIILFRDGVIDQVISREDRDYAKYLANFLA

SEQ ID NO: 31158 - protein, 502 aa, Bacillus sp. KSM-K16
MINKLQLPLQTMNLVLGFMVWVIISALLPFIQEDIAIPADRVAILTAIPVVLGSVLRIPLGYYANVVGARMVFITSFILLLFPVYFISIATSFTHLVVGGLFLGIGGAVFSVGVTSLPKYHLKEKLGLVNGIYGMGNLGTAITTFAAPVIATQIGWSATVQLYLILLLVFVALNAVFGDRKETKVKTPIMEQVKGVYKNDKLWYFSLFYFITFGSFVAFTVYLPNFLVSHFELPKVDAGLRTAGFILIATFLRPVGGWLADKFKPLFLLMGVFIGMTLAAVVLAFSPSLALYTVGCLTIAVCAGLGNGIIFKLVPFYFNKQAGIVNGIVSMMGGLGGFFPPLMLSFIHSVTGQYSIGFMALSQVALASFVLVVWMYYQDKLTVASQVFNSTGQGILVTDAKKRIHAVNPAFTRLTGYEEEEVLGRNPNLLKSGRQSSAFYQIMWTEIMEKGSWQGEIWNRRKNGEEYLELLTINAVKDETGDIVHYVGTFSDITDHPPRKHA

SEQ ID NO: 31159 - protein, 335 aa, Bacillus sp. KSM-K16
MKAIGLYRYLPIDDKESLVEEQVPDPVPSGRDLLIEVKAVSVNPVDTKVRAPKDKTEEALRILGFDASGVVKAVGEDCVLFDVGDEVYYAGNIARQGSNAEFQLVDERIVGPKPKSLSFAEAAAMPLTSITAWEALFDRLRISEGDAGKSILLIGGAGGVGSIAIQLAAKANLNVIATASRQETAAWCKSMGAHHTINHKQELLPQLQELGYKDVDYIFCMADTNEHWDGMAACIKPQGAICAIVENKRPLDMGKIRSKSVTFSWELMFTRPVFQTEDQIEQHRLLVDIAAMFDRGELKQTMTKTLSPMNADTLKEGHRLLEQGNMIGKLVIINE

SEQ ID NO: 31160 - protein, 463 aa, Bacillus sp. KSM-K16
MFSKPYNEVYIFLGVVPLEKEQQLKRTLTLVPLLVIGLAYMDPLVVFDTYGVVAQLTQGHVATSYLFTIAALLLTAYSYGRMVQAFPKAGSAYTYAQQSIHPNVGFAAGWSLLLDYLFLPMVNFAIGMAYLNAAFPEVPAFIWVVILAAAITTVNILGIQLTANITGLFVAFQVLVAAVFVVFMIRGLMNGLGTGELLSPVPFFSDTFAFQTAFTGASILCFSFLGFDAISTLSEETKNPKKTVPLAIVLVVLIGGALFVAVSYLLQLVYPNYDAFISAEAASLEIAQYVGGAFMHAFFLAGTMVAVVSSSMSSHASASRLLFAMGRDNTLPKRFFGYVHPRFKTPTFNIVLIGLLSLTAIFGELEIIYSFISFGALIGFISVNASVVFHYYIREKRRSLKGTVANLLLPALGAAFCIWLLYSIDRHALTIGVIWTILGLIYFLVRRKNSPHFTADAANRHKE

SEQ ID NO: 31161 - protein, 273 aa, Bacillus sp. KSM-K16
MSEVMEKVEPASVVQMEQAETLVRYRNVKKAFGDTVVLNNLDIDVKKGEKIALIGPSGSGKTTIIRMLMTLEQPTAGTIEVDGEMLWHKKVNGELKPADEKHLRKVRGNIGMVFQQYNLFPHMTIMKNCIEAPIHVLGLSKDEAKERAVAMLEKVGLADKVDMYPSQLSGGQQQRVAIARSLVMQPKVMLFDEVTAALDPELVGEVLQVIRDIAEEGKTTMMLITHEMDFARDVADRILFLDKGSIAEQGTPDDVLNHPKTERLKTFLGRFHA

SEQ ID NO: 31162 - protein, 433 aa, Bacillus sp. KSM-K16
MDRFFKLTENGTSVKQELLAGFTTFLAMAYILFVNPDILGAAGMNVGAVFVATALAAMTGSIIMGLVANYPIALAPGMGLNAFFAFSAVIGMGLSWQAALLAVFFSGVIFLGITVFKIREKIIDAIPEELKYAAGAGIGLFIAFIGFKNAEIIVSDPATFVALGDLSAPGPLLAVFGIVVTIIFVVLGFKGAVFYGLAITAIVGVITGFTTLTGVVSAPPSIAPTFLQAFQVDWQNEVFTVQMVGVVLTLLFVVFFDTAGTLFAVATQAGFVKNNKLPRAGRALFADASATTIGSLLGTSTTTAYVESTSGVAVGGRTGLTAIFTGLLFVVALFFSPLLSIITGHVTAPALIIVGVMMATSLRFIDWNKMEIAIPVFFTVVTMPLTYSIATGIALGFVLYPITMVVKGRGKELHPLMYLLFVVFIVYLGFLHH

SEQ ID NO: 31163 - protein, 491 aa, Bacillus sp. KSM-K16
MIRGKMFINGEWTDAKNGRVREIINPFNQEVIATVPEGSAEDSHAAIAAARAAFDEGVWSAASASERGERVRLIGQKIANQNEEFARLESLDTGKTLEESRTDMEDIANVFFYFAGLADKNGGEVIRSPLPNSTSIVVREPVGVCGLITPWNYPLLQAAWKLAPALVAGNTLILKPSELTPLTTMKLFELFEEVGLPTGVANLVLGTGKEVGAPLAESTDVDLISFTGGIETGKTIMQAASSNVKKMALELGGKNPNIVFADADFETAIDQALNAVFFHAGQVCSAGSRLLVEEAIHDDFVEELVKRTKRIKLGNGFDEKTESGPLISAAHRAKVESYIQIGLDEGATLACGGKRPDAAELQNGFFLEPTIFTNCRSSMRIVQEEVFGPVLTVETFRTTEEAIAKANDTIYGLAGAIFSNDIGKAERIASKLRLGTVWINDFHPYFVQAPWGGYKQSGFGRELGKIGLEEYTETKHIFRNKQPQPIGWFRG

SEQ ID NO: 31164 - protein, 511 aa, Bacillus sp. KSM-K16
MTKRALVSVSNKTGLIPFVKGLAEAGVEILSTGGGTKRALEEAGIAVVNVSDVTGFPEILDGRVKTLHPNIHGGLLAMRTNDEHIKQIEELGIEPIDYVVVNLYPFAETIANPDASFADAIENIDIGGPSMLRSAAKNHADVTVVVDPADYDAVLASLDASKEEQLALRQKLAAKVFRHTAAYDAMIGSYLTDAVGEENPESLTVTYTHKQTLRYGENPHQKAAFYESRTSSPSSIAQAKQLHGKELSYNNINDANAALEIVKEFSEPAAVAVKHMNPCGVGTGATVGEAYTRAYEADPKSIFGGIVALNREVDRATAEKMAAIFLEVILAPSFSEEAKAILQQKKNIRLLEVAVTKGELEKKLASVHGGLLIQEEDHLGFDDGDIRIPTKREPTEEEWTALKLGWKVVKHVKSNAIVLTNGEMTVGIGAGQMNRVGAAAIAIEQAGERAQGAALASDAFFPYGDTVEAAAKAGITAIIQPGGSVRDNESIEKADEYGIAMVFTGVRHFKH

SEQ ID NO: 31165 - protein, 489 aa, Bacillus sp. KSM-K16
MAKFTQTVEVFQNYINGEWKDSTSGQVMDSVNPANKTETIGQLQSSTTEEVDEAIQSATEAKIGWRKTGAYQRGQLLASVANELEKNVDDIAETLTKEMGKTLPEAIGETQRGIAILRYYAAEGMRKEGEVIPASDKEALMFTKRTPLGVVGIITPWNFPVAIPIWKIAPALVYGNTVVFKPASESAVTAAKVVKCFEHAGLPKGVLNFITGKGSIVGEALINSKKLNGITFTGSESTGKRVAKAASANGIKYQLEMGGKNPVIVLDDADVQSAVQGILSGAFKSTGQKCTATSRVIVQEGIYEELKAALLAETKKITIGDGMNSSIWMGPCASESQLNTVLEYIQIGQEEGATLLYGGQRLTENEYAHGFYVEPAIFEQVTSTMRIAQEEIFGPVIALLKVKTVEEAIDIANDTEFGLSASLYTSNIGSALSFIDDIEAGLVRVNSESAGVELQAPFGGMKASSTGTREQGEAAKEFYTAIKTVLIRS

SEQ ID NO: 31166 - protein, 317 aa, Bacillus sp. KSM-K16
MMEKLYGNTPCFLNAKNIAKSKSTEGIDAVVYGIPWEGAVTWGDYTGCELGPKVMRLCSARYSGYLPELDHIDVFEHIRLGDAGDVDVVPADVDETMRRIERFAAEFWKKGTFLIGLGGDHGVTYPIVKALANEGKKVGIIHLDAHYDNLPHHEGDPFARCSPFKRLYELEGVRNESIVHAGIHGPRNKPESGRNAKEAGAVTITINDIREQRDLKGYAAQMYKLASQDVDEVYLSICSDVLDYAFNPGGPVDGNGLSSYELLTFVHEICKQGVVGMDFVEVYPQQDPSQFSAHLASTVVLYALAGHIWNEKNMVSS

SEQ ID NO: 31167 - protein, 442 aa, Bacillus sp. KSM-K16
MSKKKEKNTSLNWWQLSLLGVGCTIGTGYFLGSSIGIGLTGPSIVIAFLLAALGTYVVFIALAKLTADDPQEGSFCYYAEQAFGNRVGFACGWNYWMSNILIIGSQLTALSILSRFWFDNVPLWVFASIYSLLGIGVVLLGTKGFDSVENVLAAVKTAAILLFIVLGFLAVFQWLDGTGPDPSVPSSYNELFPRGIKGFWGSLIYAFYAFGGIEVIGLMAMQLKQKQDAPKSGTALLLLLAIIYTVSLGLAVSMVSFDQFTDKESPFVTALSDYHLAFFPHVFNAAIIVAGFSTMTAALFGVTTLLTTLAHDGNAPKWFEKKIKYKDLPLPSLGLAVVGLICAVIAALLLPGKLFEYITTAAGILILFNWICIVLSNMRLLKQTFFSISGNIIGILLMLLAISGILAEKTGRPGFYLSIGFAAIIVLIAWLVKKPHKEQSSS

SEQ ID NO: 31168 - protein, 322 aa, Bacillus sp. KSM-K16
MKWIERLSSFAGKYFALLVIAAAITAFLVPEIFIPINAYVPILLGVVMLGMGMTLKPVDFKLVATRPLPVLLGLVAQFTIMPFTAFMIAYLLQLPPELAAGLVLLGSVPGGTASNVMVYLAKGDLPLSITMTSMSTLLAPIATPALLYLLAGQWLPVNFVDMFTMIVQVIVIPVIAGLLINRFLPKVAAKTSVAMPLVSVLAILAILSAVVAANTGSLIQAGLISFVAVMLHNAAGLALGFIAALAFRLPASQRRAISIEVGMQNSGLGVALATAHFTPLAAIPSVLAAAWHNISGPILATYWSKRPLPPEATSPLNKKRAS

SEQ ID NO: 31169 - protein, 357 aa, Bacillus sp. KSM-K16
MTILLNKIDKRFGNTHVLKQVDLRVEQGELLALLGPSGSGKTTLLRMIAGLEAVDSGEVWINGKHVTNVNPRKRKVGFVFQHYALFAHMTVEQNIAYGLNVLKRSERPSKAEIKSIVEQLLALVKLEGLEKRRPSELSGGQRQRVALARALAIKPEVLLLDEPFGALDAQVRKELRRWLRTLHKETGITTVFVTHDQEEALDVADKIVVMNKGEIEQAGTPTEVYEEPNSPFVYEFLGNAYPFKGVSQSGKLAVAGAKWELAAIDATTNGPVVGYARPHEIAVSKTYEGEGDLQVDIVSVHPVGPIVFIEAKWAGEGDTIEIQQPKKTFAQLGLSIGDKAYIRPEKLGVFQVSDYTI

SEQ ID NO: 31170 - protein, 161 aa, Bacillus sp. KSM-K16
MSVYDFSVKTSNGQDVSLSAYKGNVLLIVNTATKCGFASQFAGLEKLYNDYKEKGFYVLGFPSNQFLNQEPVADEDMEQVCKINFGVTFPLFAKTDVKGKHANPLFNYLKAAKKGMLSEEIKWNFTKFLVNRKGEVIKRYAPATKPETIEADVIEELKADA

SEQ ID NO: 31171 - protein, 453 aa, Bacillus sp. KSM-K16
MYETLLAVQKEHVFTGATKAVAYRKQQLQKLKTMLQTYEKELLSALRADLNKQEPEARMVEMAFLHQEIDLALESIDEWVKPMKVKTPTSHAGSKSWVATEPYGSVLIISPWNYPIQLTFAPLIGALAAGNAAVLKPSELTPRTSSIMAAAVRATFPKELVTVVEGDAKTAETLLNLPFDSIFFTGSAAVGKIVLEKAAKHMTPCTLELGGKSPVIVDGEAKLKLAAKRIAWGKFLNAGQTCIAPDYALVDEDVYEPFLEQLKTQTYTLFSDKTKEGTYTQIVNDKHFERLRRYLDNGHIALGGQISPQARLMSPTILTNVPWDAPIMQEEIFGPILPVFRYKTPAEAIQKVRSLPNPLALYVFSENERVQRLFTEQLSFGGGCINDTLMHAANPYLPFGGKGASGIGAYHGYESFRTFSHQKSLLKQSTTFDVPFRYKQGKIANTFIRNICK

SEQ ID NO: 31172 - protein, 434 aa, Bacillus sp. KSM-K16
MNRKTSESLYQEAQHVIVGGVNSPSRAYKGVGGGTPVFMERGEGAYFYDVDGNRYIDYLAAYGPIITGHAHPVITKAIQDQAAKGVLFGTPTRLENEFAQELTNAIPSLEKVRFVNSGTEAVMTTIRVARAYTGKEKIIKFAGCYHGHSDLVLVAAGSGPSTLGTPDSAGVTAATASEVITVPFNDIEAFKEALAHWGSETAAVLVEPIVGNFGIVEPEPGFLEAVNDLAHSAGALVIYDEVITAFRFMYGGAQDYLNVKPDMTALGKIIGGGLPIGAYGGRMDIMEQVAPLGPAYQAGTMAGNPASMSAGIACLEVLRTEGVYEKLDELGARLEEGLYLAAAKANVPISINRLKGALTVYFTDEPVIDYEGAKRSNGDQFSVFFKAMLNEGIHLAPSKYEAWFLTIAHTKNDIDETIEAAYRSFKTVAAGFYS

SEQ ID NO: 31173 - protein, 435 aa, Bacillus sp. KSM-K16
MKTIVLGASHGGIEAVEALRMMCPEVNVQWYDKGDFSSTSAKDLESIQQQGVTIFSNTEITKVEPGKHQVEIFDHATGETRKEGYDKIILSPGAKPFILPVPGHHLQNIGTMSSRQDLFNMRKHAADPNIKNVVIVGAGYIGTGAASLFAESGKKVTLMDINNRPLSSYLDKEFTDVLEKEMKDRDVELVLGNSITEFVGDENDRVIEVVTTKGTYSADLVILSAGNRPNTEWLRGAVELWPDGRIKTDEYMRTSDPDIFAIGDATTVWYNPGKMRMNVSLGTNARRQAHYAVKNLFEAIHPLPGVQGSSGAHIFDYYFATTGLNDKTAKKLGIEIKSVYLEQETPLFSPETIVMFKLVYDPTTLEILGGQIMSKVDLTATINTVSLAIQTGCTLEQLAYADFFFQPELNTPWNVINSAGLKALLQENYYRKSSV

SEQ ID NO: 31174 - protein, 469 aa, Bacillus sp. KSM-K16
MKLFINGEWVSEELDVFDVVNPATGEVVGSVPKGGAKEAKVAADGAYESLPAWAERSAYERSAILEAWHDLIAEQKEELARLMTMEQGKPINEARGEIAYANSFIKWYAEEGKRIYGETIPASSPDKRLFVVKQPVGVVAAITPWNFPAAMITRKVAPALAAGCTVLIKPASQTPLTALKLAELAEKAGLPKGVLHVVVGSTSDISKAWQEDERVRKLTFTGSTEIGRTLMSEAGQTVKKISLELGGHAPVLVFEDADIDNAVQETIASKFRNGGQTCVCANRIYVHESIAEAFITKMKQAVEQLKVGNGLNEETDIGPLIDEEAVDKVLTHIRDAKDKGAEVLTGGNSSDGLFIEPTVIAGVTDDMACMSEETFGPLAPISTFKTEEEVVKRANDTIYGLAAYLFTTDLSRGIRVAEKLDYGVVGLNDGGPSVAQAPFGGFKQSGIGREGGHEGLEEFLESKYVSLKM

SEQ ID NO: 31175 - protein, 390 aa, Bacillus sp. KSM-K16
MAMDIQQAKMMEQLPSQFFAKLVNKAQRLAQEHNDLINLGQGNHDQPTPAFIVEALREASSEPQFHRYGPFRGYPFLKEAIAAYYKQQYGVELDPETEVAIVPGTKTAIVELCQCLLNKGDMALVPDPGYPDYLSGIAITGAIAKPMPLLRNNRFLPDYHELSSDVLDKAKMMFLNYPNNPTGATADARFFADTVAVARSHCIPVIHDFAYGAIGFNGTPRSFLQQEGAKDVGVELFTMSKLYNMAGWRVGFVLGNKEIVAMLEELQDHYHCSLFGGLQAASACALQSDQSSVHELVGLYKERSEALWEAAQEIGWQVEQPSGSFFAWFPVPKGYTSEEFSELLLDKAHLVVAPGNGFGQYGEGYVRIGLLADKTTLREAIARVGNLNLF

SEQ ID NO: 31176 - protein, 509 aa, Bacillus sp. KSM-K16
MTFEQTKLAKETEIFKGGHTKYHQQNAKKGKLFARERLQLLLDDGLTTEDGLFANCEADGLPADGVICGMGTIDGKPVCVMANDSTVKAGSWGARTVEKIIRIQETAEKLSVPLLYLVDSAGARITDQVEMFPGRRGAGRIFSNQVKLSGRIPQVCILFGPSAAGGAYIPAFCDVVIMVDGNASMYLGSPRMAQMVIGEDVTLEEMGGASMHCSVSGCGDILAKNEEDAISQARAYLSYLPPSYKEKPPSKEARPPKDVPKTIEDLIPQNQNAPFNMYDLLERLVDNDSFFEIKRNFAPELITGFARLNGQAIGIVANQPKAKGGVLFPDSADKAARFITLCDAFHLPLLFLADIPGFMIGTKVERAGIIRHGAKMIAAMAEATVPKISVIVRKAYGAGLYAMAGPAFDPDCCLALPQAQIAVMGPEAAVNAVYANKIAELGEQERKAFIEEKREAYKRDIDVYRLASELVIDGVVNGNDLRQELGQRFAFYESKRMVFSERKHPVYPV

SEQ ID NO: 31177 - protein, 291 aa, Bacillus sp. KSM-K16
MKKVGFLGPKGTFTEMAAYSLFPKEELVPLKTIPKVLDLAFAKGIDYAVVPIENAIEGTVNITLDYLIHHKPMPIVASISLEIAQHLLFSPNKDRETFVPKKVVSHPQAIAQCHQFLQKNYPEIEIEYADSTGSAAAWLAENPNADACVIANAQAASTYGLAVAQGDIHDFEHNRTRFIVLTAKKEQAPHIVGPEHTGDKTTLMVTLPSDFAGALHQVLSAFAWRKLNLSKIESRPTKTGLGNYFFLIDIDQLMDDVLVPGAIAELTALGCKVEVLGSYATYSSKATASIN

SEQ ID NO: 31178 - protein, 320 aa, Bacillus sp. KSM-K16
MNQFLQKWLPAMTPLAVIAGVLANQMLAPAAFLVPWIFACMSFANSITIHPREIKQVFRFPRSFFLTFVSLQLILPFCAYIAGILLFPDDVWTQTGLLLAFSIPTGIVSLMWISIYKGNRSLALCLILANTLVAPIFIPLTLAVFLGTELPLDTFGIFMGVFWMVVAPSLAALAINATKPAWVDVIHVVGAPFTKLGLLAVILLNSSVAAPYFLALDIKLAMIVATVLALAIIGYLTGLYFAKATGSPKEDQVSMMLLSGMRNIGVGAAIAIVYFPPAATLPVIAGTLFQQILAASFGKWQSLAPKRSTNQYNAAKNRDA

SEQ ID NO: 31179 - protein, 372 aa, Bacillus sp. KSM-K16
MSKRDYYEVLGVDRNASVEEVKKAYRKLARKYHPDVNKEEDAEAKFKEVKEAYDTLSDPQKKARYDQFGHADPNQGFGGAGASGDFGGFSDIFDMFFGGGGGRRNPNAPRQGDDLQYTMTLEFKEAVFGKETEIEIPREETCGTCHGSGAKPGTKPDTCSHCGGSGQLNVEQNTPFGRVVNRRVCNYCEGTGKIIKQKCATCSGKGKVRKRKKINIQVPAGIDNGQQLRVAGQGEAGANGGPPGDLYVVFQVKPHEFFERDGEDIYCEVPLTFPQVALGDEIEVPTLTGKVKLKIPAGTQTGTSFRLRGKGVPNVHGRGQGDQHVQVRVVTPKNLTENEKELMREFAGMSGGRPEEQNDGFFDKLRRAFKGD

SEQ ID NO: 31180 - protein, 301 aa, Bacillus sp. KSM-K16
MKVGFIGLGNMGMPMSKNLLESGYEVVGYDINETSLLAFEQAGGKRARDLADIVLASELIFTSLPSSEAVENVYLGEKGVFASAPSSILFVDTSTVAPELVMRIGQAAEEKGLSFLAAPVSGGVVGAENRTLTFMVGGPKKLLESVSDHLMTLGSHVFHISESYDSGINAKLINNLLIGFYTAGVAEALALAKKSDLNLDFLFNVLNVSYGQSRIYERNYKSFMATGNYEPGFALKLLNKDLRFAMDLAKERGVKLPISEALVELYADAERAGLGEKDMAVLFERIGEQTISFKAEGVAKR

SEQ ID NO: 31181 - protein, 506 aa, Bacillus sp. KSM-K16
MAYQQPNTEGALVHFKERYDNFIGGEWVAPVNGRYFENRSPVTGKPFCEVARSSAEDVELALDAAHNAKASWGKMPAAQRANLLNKVADRIEENLEMLAVAETWDNGKPIRETLNADIPLAVDHFRYFAGVIRAQEGTLSQIDENTVAYHFQEPLGVVGQIIPWNFPILMAVWKLAPALAAGNCVVLKPAEQTPASIFVLLELLSDLLPPGVVNVVSGFGLEAGKPLASSPRIAKIAFTGETTTGRLIMEYASANLIPVTLELGGKSPNIFFRDVMEKEDDFLDKAIEGFVLFALNQGEVCTCPSRALIDETIYDAFIEKALQRVAAIKQGNPLDPETMMGAQASEEQLEKILSYLAIGKEEGAEVLAGGNQRQLSGDYSGGYYVEPTVFKGTNNMRIFQEEIFGPVVSVATFKDADEALRIANDSLYGLGAGVWTRNINTAYRFGRQIEAGRVWVNCYHAYPAHAAFGGYKKSGVGRETHLMMLNHYQQTKNMLVSYNDDSQGFF

SEQ ID NO: 31182 - protein, 459 aa, Bacillus sp. KSM-K16
MKIIVIGCTHAGTTAVKNLLRLHPDADITVYERNDTVSFLSCGIALHVGGVVEHAEDLFYSSPQELAALGASMHVLHDVINVDNENKKIRVRNLQTGEQFTDKYDKLVFTTGSAPVIPSIPGVGLKNIQLCKNYYQAQQIIKKATNAQKIAVIGAGYIGIELVEAFATNGKDVTLIEGANRILNKYLDHEFTDKIETTLREHHVTLALGEKVESFIGNSAGGVQAVQTSKQTHEADLVLLCVGFKPLTDLIKDKVDTLENGALLVNEYMQTSDPNIFAAGDNCAVFHNSANHMAYIPLATNATKMGTLVAYNIKRPTFAYKGTQGTSGLKLYDLNIASTGLTEEAAAIYGLDVRSFTFTDHERPTFMPSAEEVRIKLVFEQESLRIVGAQVMSKTDQTHLMNTVSVCIQQQMTVTDLAFADFFFQPHYSKPIHLLNSLALNILEQREPMQKTAEVRVST

SEQ ID NO: 31183 - protein, 269 aa, Bacillus sp. KSM-K16
MNKRLRDAVKKGNLFIPFITAGDPVREATIALALSLQRSGADVLELGIPYSDPLADGPVIQNASKRALAGGMTLAKAMALVPEMRKEGLTIPVIVFTYANPLLQFGFERFCETACDYGIDGLLVPDLPFEESETLANECEKQGLALISLVAPTSQQRIKAIASRAQGFLYCVSSLGVTGARKTLHPQVEAFLKLVKEASPVPFVVGFGISSYEQVEEMGRHADGVVIGSAIVEQIGLRCEALKQAESRDEAVKEIEQYVNSLLHPAPTY

SEQ ID NO: 31184 - protein, 264 aa, Bacillus sp. KSM-K16
MTRIVIAGPRGNMGQEAVKLCLREESFELVAVVDSKNDGKQLKGLQEFQQGDVPVYTDMARCFAEHEPDVLIDLTAPAFGRKHMEVAFEHGVRPVVGTTGFSDEDIRDLTKLAEAKELGAIIAPNFAIGAILMMKFAQTAARYMNDVEIIEQHHDRKLDAPSGTAVKTAQLIAEVRAPKKQGHEQEREEMAGARGADFDGMKIHSVRLPGRVAHQEVLFGGVGQTLSIRHDSLNRESFMPGVKLAVEQVVKLSTLVYGLENLID

SEQ ID NO: 31185 - protein, 469 aa, Bacillus sp. KSM-K16
MAKQNIGVVGVGVMGRSLALNLESKGFSVSLYDVSEERINEILDHNKGKRLVGTFSLEEFVHSLEKPRKIMLMVQAGQVTDQVIDSVIPLLDKKDILIDGGNTYYTDTIRRSQTAAEHGIHFIGTGVSGGEEGALKGPSIMPGGQKEAYELVKPMFEKIAAQVNGEPCTTYIGPDGAGHYVKMVHNGIEYGDMQLICEAYSLLVNVLGLNAEDLHSVFKEWNEGELDSYLIEITADIFTKVDEETGKPMVDVILDTAGQKGTGKWTSKSSLDLGVPLPVITESVFARFLSAMKEERVKASQILSGPEKKQFTGDKQELIERIRQALYFSKVLSYAQGFSQLKSMSLEMNWNLQYGEIAKIFRGGCIIRAAFLQNITDAFERDANLDNLLLDPYFENISRKYQQALREVVALAVEYGIPVPGFSSAISYYDSYRSERLPANLLQAQRDYFGAHTYQRIDKEGVFHTNWLD

SEQ ID NO: 31186 - protein, 308 aa, Bacillus sp. KSM-K16
MEVYRHIHELIGSTPMLELTAFPLPRRVRLFAKLEYTNPGGSIKDRLGIKLLKEAIATGKITPKGTLIEPTAGNTGIALALAAIGTDVKVICVVPKAFSIEKQQLMRALGAVIVHTPSEHGMKGAIAKAKALEQELDDAYCPQQFSNKANPLAYYETLGPEIVHELDGKVDVFVAGAGTGGTFSGTAAYLKEVIPGIRTVVVEPEGSILNGGEPGPHRTEGIGMEFIPDFVNRSLFEAIYTISDNQAFKRTRELAEHQGVLVGSSSGAALEAALREAEMADEGAHIVTVFPDGAERYLSKGIYEEEPL

SEQ ID NO: 31187 - protein, 494 aa, Bacillus sp. KSM-K16
MGKPTGFLEYKREAPQKKDPFERTKNWQEFQLFMPEDKLRQQGARCMDCAIPFCQAGTTMAGSGEIGCPVYNLIPEWNDLVYRGKWREALDRLHKTNNFPEFTGRVCPAPCEGSCTVALNGDPVTIKSIEYHIVERGFQEGWIQPEPPKTRTGKHVAVVGSGPAGLAAAAQLNKAGHTVTVFERDDRIGGLLTYGIPDVKLANEVVERRVQLLEAEGITFKTEVEIGVDITAEELETSFDAVILATGATKPREVQAPGKELNGIHYAMDFLTANTKSLLNSQLADGEFISAKGKHVIVIGGGDTGADCITTSIRHGAASVIQFDINKQKGAMRSGDNVWPLYPIIHTVEDAHKEAMAVYGKDPRSYMLQTKAFFGNQDGQVTGLQTVEVTTELKNGQKIRTEIPGTERTWKADLILLAIGFTGPEQELLQQLGIETTSRTTVKAPYGKYTTSKPGIFAAGDNRRGQSLVVWAIHEGREAARECDRYLMGSTRLP

SEQ ID NO: 31188 - protein, 388 aa, Bacillus sp. KSM-K16
MEMFSKSVKKGVAVFALAAVTISLISIFFVQSWRYTEAGKVPPKTAVLLHAVNNRLLPEGKLEAPAFLAVKAPPTIERHQVTVPTRDGEDIPATVYQPIAAGPHPIIVYYHGGAFLEGYGDLDTHDNIIRSLAARTGAIVVAPAYRLAPTYAFPTAVNDSYDALTWAYEHADVLDGDRDRLAVAGDSAGGNLAAAVAIMSGEEGGPALSGQALLYPLATFEDTKFPSRDMYASGFYFLSRAVMEMAQQSYAPNEADWTSPYTSPLNAEDVSMMPSTLVITGEFDPLRDEGEALAKRLYNEGIYVQAQRFNGVMHGFISFYEVMERGDKGLQSAAAFLKEALNKELPEPQNSQPFAVEVIDGRDSWRDEAEAYVIGVYLLFKHMIQVFE

SEQ ID NO: 31189 - protein, 449 aa, Bacillus sp. KSM-K16
MPKFTKEDIVRQAQDNNVRFIRLQFTDLLGTIKNVEIPVDQLSKALDNKMMFDGSSIEGFVRIEESDMYLYPDLDTWVVFPWTPEKGKVARLICDIYQPGKPGEEPKPFEGDPRGILKRVLKEAQELGFTDFNIGPEPEFFLFKNDEKGEPTLELNDRGGYFDLAPTDLGENCRRDIVLELEDMGFEIEASHHEVAPGQHEIDFKYADAVSTCDNIQTFKLVVKTIARKHGLHATFMPKPLFGVNGSGMHLNMSLFTQEGNAFYDKNTESQLSKTAMQFLGGILKHAEGFTAITNPIVNSYKRLVPGYEAPVYIAWSMRNRSPLVRIPSSRGVSTRIEVRSPDPSANPYLAMAVMLASGLDGIKKKINPPEATDRNIYIMSKEERLDEGIKDLPSTLKEAIDSLLKDEVLVKALGEHALEHFVEAKEIEWDMFRTQVHPWEREQFMQNY

SEQ ID NO: 31190 - protein, 215 aa, Bacillus sp. KSM-K16
MIKVAPSILAGDFSRMGETVQACDNAGADWIHVDVMDGQFVPPITFGHQMVEAIRPYTDLPLDVHLMVEQPEKQIAFFQQAGADCLSVHVEASAHLHRTVAAIKEAGMKAGIVLNPGTPAYAAEPVLADVDYVLQMTVNPGFGGQSFIPGALANIKKLRAMIDERQLPVDIQVDGGINPTTAQQCVQAGATILVAGSAVFKEADLAKAIAQIRGQ

SEQ ID NO: 31191 - protein, 299 aa, Bacillus sp. KSM-K16
MKVGFIGLGTMGLPMTRHLVEAGYETYVVSRSRGPIEKALAFGAVEASSPKALMETVDIVMTCLPLPSTIHDVYDGPNGLIAGASAGKIVIDHSTVDRATNEWASSRLKEKGASFLDAPISGGPMGAEAGNLTIMCGGEEDAYERALPVLKAFGDYIVRVGETGSGTTVKLLNNMLIGVHQSALAECYVMAEKAGVDPAVAYEVIKRSAGFSKSMDWAINAILDRQFEARFSINLLHKDIGLALKLADDIGMPLDVVKLGAEKVAKAKEKYGDQDVSAIIRPLEEATETIVKRHKKESH

SEQ ID NO: 31192 - protein, 468 aa, Bacillus sp. KSM-K16
MVVGDFAQEVDTLVVGSGPGGYVAAIRAAQLGQKVTIVEKGSLGGVCLNVGCIPSKALIQAGHRAHLAKSSEDIGIRAENVAIDFEKVQEWKGSVVKKLTGGVEGLLKGNKVEIIRGEAYFSGEDTVKIMDEKSSSTYKFKHCIIATGSSPIEIPNFKYTDRVINSTGALALKEVPKKLVVIGGGYIGIELTGAYSNLGSEVVVLEGTKQILPGFEKQMAKLVERKLKKNGVTFHTEAMAKGVEETDNGVKVTAEIKGEEKVIEADYVLVTVGRKPNTEEIGLEGIGVEMDDRGYIKVDKQGRTSVKNIFAIGDIVPGPALAHKASYEAKVAAEAISGEPSEVDYLAIPAVCFSEPELATVGYNEAQAKEAGYDVKVAKFPFAANGRALSLNDADGFMKLVTRKEDGLVIGGQIAGPNASDMIAEIGLAIEAGMTAEDIALTIHAHPTLGEITMEAAEVALGTPIHTL

SEQ ID NO: 31193 - protein, 403 aa, Bacillus sp. KSM-K16
MDWIARDNAAIMGTYGRLPLVIDRGEGNYLIDENGKSYLDLITGLAVNVVGHSHPEVIKALQEQGQKFLHISNLYVNKPAVELAEQLSEATLGGKVFFANSGAEATEAAVKLIHKWSMAQKTAKRGIVVLKNSFHGRTLGALKLTRQKGVYQDFPKHDLPVYEVERENVDELRAVIKKNKPAALLMEPVLGSGGVIPLSHSFLQEAQALCNQEGMLFCMDEIQTGMGRTGKLFAYMHADLSPDVVLFAKGVGGGLPLGGIIVKQDWSGLFSPGDHGTTFAPSPLSCALGLAVLRVLQQQGVLTASQQTAAYLHDTLTKLQREFPNILEAFRGKGMMIGLPTKLTAENTKKLQQMMMEQGVLIDVTQQTIVRLLPPLTLTKAEVDTFAGHFRNALAEIDGVVAS

SEQ ID NO: 31194 - protein, 340 aa, Bacillus sp. KSM-K16
MPNLMDSFQLKELTLKNRVVMSPMCQYSATGKDGMPTDWHLHHYTSRAIGGVGLIIVEMTNVEPNGRISDYCLGLWSDAHRDAFKPIVDAAHQYGAKIAIQIAHAGRKAEDAPEPVAPSAQAFDETYKTPRALSENEIAEMVQTFKAAARRAVEAGFDAIELHGAHGYLIHQFLSPYTNTRTDRYGKDRTLFAKEVIRAVKSVIPDSMPLLMRISATEYVDGGYDIEEAIRFSQILKDEGVDVFDVSSGGEGPIGSRGLPGSHAGYQTPLAKQIKQALSVPVIAVGRLENPVLANAVIGNEEADLVAVGRGLLANPYWALGAASELQLPVEAPTQYKAGF

SEQ ID NO: 31195 - protein, 473 aa, Bacillus sp. KSM-K16
MAENYDLVIVGGGIGGYVSAIRAAQEGLKTALVEQALLGGTCLHKGCIPSKALLRSAEVLRTAKEASVFGVATGPVAFDFAGAQKRKQEIVDRLAQGVKALMSKGKIDVYEGRGRMLGPSIFSPSPGTISVDLANGDNQMLIGKNVILATGSVPRPLPHTPFDGKQILSSDDVLQLKELPASMVIVGGGVIGIEWASMLVDFGVSVTVVEASETILPTADQAVAAEMEKQLKARGVVFYTNAQLDEQTVATTSSGIKATVHQNQEEHTIEADKMLVAIGRVANVSDIGIDNTDIALAHGCIAVNEYGQTKESHIYAVGDCVGGLQLAHVAAHEGIAAVSHIIGKQVEPVDPLAVPSCVYSFPEAAQVGMTETQAREAGHAVKIGTFPFAMNGKALIHGEAGGFVKLIADKDTSDLLGVHIIGTHATDLISEAALAKFLDAADFELAETVHPHPTLAEAIGEAALAVDGYAIHK

SEQ ID NO: 31196 - protein, 388 aa, Bacillus sp. KSM-K16
MSYLFPTYSKKSLRIKEGRGAWLQTEDGKDYLDFMAGIAVCNLGHRHPKVVAALHQQVDRLWHASNLFHYDVQEEAAKQLVQASACDYVFFTNSGTEANEAAIKLARKATGKNHIVSMKQSFHGRTLGSMAATGQDGIKSGFGPMLPSFSYAQFNDMASLHEAVSEETAAIMVEIVQGEGGVHVMTASFAEAMVALCKEQNLLLIVDEIQTGMGRTGKLFAYEHYGLDPDIVTVAKGLGNGFPIGAMLGKASLKEAFGIGSHGSTFGGNPLAAATAIAVLAELSADGFLPEVEEKAERFVAYLKGELSGIAIVKDIRHKGFLIGIETAIPALDLIAACEQQGLLLLPAGSHVTRLLPPLTVSESEWRKAVAIIKQAATIYERENSFSS

SEQ ID NO: 31197 - protein, 499 aa, Bacillus sp. KSM-K16
MERNKRLAAERARLASGGGTKKQQAQKQAGKQTARERIGMLLDRESFTEHLAFASGSGGEAGDGVIVGYGTISGRLVCVYAQDFTVSGGSLGAMHAKKICAIMDLAYDMQAPLIALIDSGGARIQEGAKALAGYGDIFKRNVRYSGAIPQLSVMLGPCAGGAVYSPALTDAIFMVDQMSQMVITGPKVLKAATGAEVKMEDLGGARMHSEKSGVAHFCAKTEAELFVLVRQFLSYLPNNGAKKPCHKRVSEKVSAHLPRDSKTVYDMVPIICGLADENSFFEWSKRYARNLITAFIRLDGQPVGVVANNPKHLAGCIDMDASDKCARFVRFCDCFHIPLLVLEDVSGFIPGVEQESRGLIRHGAKIIYAFAEATVPKITVIVRKAYGGAYVALNSKALGADFVYAWPGAEIAVMGPAGAAAVLHQKDIQASNDPAKALLQFEENYREKVADPFSAAKEALIDDVIEPDETRQRLIESFSILACKDERANWQKKHGNMPL

SEQ ID NO: 31198 - protein, 430 aa, Bacillus sp. KSM-K16
MGNWTKSIEAFKEAQPLMPGGVNSPVRAFKSVGMNPVYMKEGKGAKIKDIDGNEYIDYVLSWGPLILGHANDVVVEELKKATELGTSFGAPHEYETRLAKLVIERVPSIDVVRMVNSGTEATMSALRLARGYTGRNKILKFVGCYHGHGDSLLIKAGSGVATLGLPDSPGVPESVAQNTLTVHYNDVESVRYVFETFGDDLAAVIVEPVAGNMGVVPPEPGFLETLRTWTEENGTLLIFDEVMTGFRVGYTCAQGEFGVTPDLTCLGKVIGGGLPVGAFGGKREIMEQIAPSGPIYQAGTLSGNPLAMTAGYYTLSQLTKADYSEFARKAERLEAGLSAAAKQHGIPHSINRAGSMIGLFFTDERVYNFEKAQTSDLDLFAAYFRGMLAEGISLAPSQFEGLFLSTAHSNEDIEATIAAAERVFQAIATK

SEQ ID NO: 31199 - protein, 280 aa, Bacillus sp. KSM-K16
MLKDMFSKKKRYATIPSERAKQEVPEGIMTKCPSCRTIMYTKDLKKNLSVCRTCGHHHRMSARERIDSIIDDGTFKEAFASVKGGNPLQFPGYEEKLESDRKKTGLNEAVVTGEGKINGYPVVIAVMDPNFRMASMGSAVGEKLTRAIELATETSVPLLIFAASGGARMQEGMLSLMQMAKTSAALERLNRAGGLYISVMTNPTTGGVSASFASLGDYNFAEPKALIGFAGRRIIEQTIRQELPEDFQTAEFLLEHGQLDRVIPRLEMKETLTKLLAMHQ

SEQ ID NO: 31200 - protein, 399 aa, Bacillus sp. KSM-K16
MLQHGGRLEDIRQAQEWGIETSVVQVDDSKLFRRQNAIIQSLSAGIAQLLKKNRITFFQGEATIDGSQQLVCDGHLIQSENLLLATGGKPFIPPIAQLETIDYMTTDTFFQQTSLPKSLVIIGGGVIAVELAFAVSPFGTKVTILEVASDILQTEDEQARAVVKKQLQQRGVEIETNVVIENVGQGLVRTANAAFPFERLLVAAGRRPNTELADALHLQKDANNRFIEVNPYYETSKKGIYAIGDVIGKYELAHAASAEGIAAVEHMAGIKQQPIDELGIPRCVYTDPEIASFGLSEKEAKERGYDVKVSFSANAANGKALAEGDTSGFVKLITEKKYGELLGAVIVGKHATELIGELLATRVSEGTISELQQLIHAHPTIAEVIGESALAFSKRAIHQ

SEQ ID NO: 31201 - protein, 310 aa, Bacillus sp. KSM-K16
MRVVDNIADLIGQTPLVRLNKLPDSEGASVYLKLEMNNPSGSVKDRAAFSMIIQAEKDGHLQPGSTIIEPTSGNTGIGLAMNAAARGYRAILVMPDTMSQERINLLKAYGAEVVLTEGDKKMPGAIEKAKELAESIPGSFMPMQFENEANPDAHRRTTAIEIKQDLDAIGATLSGFVAASGTGGTITGTGEVLKTYYPDALIHVVEPAGSPVLSGGKPGPHKLVGTSPGFVPPILNTAIYDQIRRIEDEDAYKTAKDLARLEGILVGPSSGAACFAALEMAKTLDKGDHVVAIACDTGERYLSTDLYQSE

SEQ ID NO: 31202 - protein, 451 aa, Bacillus sp. KSM-K16
MAHIQFDYSKALSFFGEHEVAYMREAVRAAHKALHEKTGQGNDFLGWIDLPVDYDKEEFARIQKAAEKIRHDSDVLLVVGIGGSYLGARAAIEALNHSFFNQLPKEKRNAPQVIFVGQNISSTYLSDVLDLLDGKDVSVNVISKSGTTTEPAIAFRVFRDYLEKKYGKEEARKRIYATTDKERGALKTLANEEGYESFVIPDDVGGRFSVLTAVGLLPIAVSGLAIEDMMKGAADAREAFSTGELSENAAYQYAAIRNILYNKGKTIELLVNYEPHLHYVSEWWKQLFGESEGKDQKGIYPASVDFSTDLHSMGQYVQDGRRNLFETVLHVEAVDKHITIEEAESDLDGLNYLAGKTMDFVNKQAFKGTMLAHTDGNVPNLVVSIPKLDEYSFGYLVYFFEKAVAMSGYLLGVNPFDQPGVEAYKKNMFALLGKPGFEEEKNKLESRLTDN

SEQ ID NO: 31203 - protein, 426 aa, Bacillus sp. KSM-K16
MPQEWNDLAQTIPYRLAPSMAKDHPNLPVEKEEGCYYYGVDGKTYLDFTSGIAVTNVGHRHPKIVAAIQEEAGRFTHGPIGVIQYESILQLANELAEIMPGDLDCFFFGNSGTEAVEGALKLARHVTKRPYVISFNGCFHGRTLGSLSVSTSKAKYRKYQPAQGMAYQIPYYATGDTEEQAIAKLEDSFASLFAHQVSPDEVAAVIIEPVLGEGGYIVPPASWLQRIRTICDEHGMLLIFDEVQTGFGRTGEWFAAHTFGVVPDIMAIAKGIASGLPLSATVANHKLMQQWPLGSHATTFGGNPIACAAARATIAVIKEEQLLDNAKQVGAYAKQRLNAMQEKWPQIGAVRGIGMMFGIEIVDPKTGEKDGDIAAKILDLALEEGVLFYFCGNAGEVLRMIPPLTVTKAEIDEGLAKLDRAFTRLG

SEQ ID NO: 31204 - protein, 487 aa, Bacillus sp. KSM-K16
MAIKTEVVFGNYINGRWKQEAASPLASINPSDAEEVVGYVQNSTADVVDEAVEVAKGALLSWRKLTGAERGHYLYQAANQLESRLDEIAETLAREMGKTLPEAKGETARGVAILRYYAGEGLRADGEVIPSTDSEALMFTKRVPLGVVGVITPWNFPIAIPVWKIAPALIYGNTVVFKPATEAAVTAAKVVECFAQAGLPKGVLNLVTGSGKVIGNALVAHEHVHGLTFTGSEQTGKQIGKAAAARGAKYQLEMGGKNPVIVAEDADLHVAVDATISGAFRSTGQKCTATSRVIVAEAILQDFQELLLEKTKQITIGKALDDGVWMGPCASEAQLRTVLDYIEIGKKEGAKLLCGGKRVTDGNRAAGYFVEPTIFTNVNRHMRIAQEEIFGPVIALITAKNMEEAIEIANDSRYGLSASIFTTNIEKMLLFIDEMDAGLVRVNAESAGVELQAPFGGMKASSSHSREQGQAAKEFYTSIKTVFVKGR

SEQ ID NO: 31205 - protein, 429 aa, Bacillus sp. KSM-K16
MTIISDVYAREVLDSRGNPTVEVEVHLESGVMGRALVPSGASTGEYEAVELRDGGDRYMGKGVQKAVDNVNEKIAPELIGENALDQIGIDRLMIELDGTENKGNFGANAILGVSMAVAHAAANALDIPLYVYLGGFNAKQLPVPMMNIINGGEHADNNVDIQEFMVMPVGAESFKEALRMGAEIFHNLKSVLKAKGYNTAVGDEGGFAPNLSSNEEALATIIEAIEKAGYKPGEQVKLAMDVASSELYSKEDGKYHLAGEGKVLSSEEMVSFYEELVSKYPIISIEDGLDENDWEGHKLLTERLGDKVQLVGDDLFVTNTKKLAEGIEKGIGNSILIKVNQIGTLTETFDAIEMAKRAGYTAVISHRSGETEDATIADIAVATNAGQIKTGAPSRTDRVAKYNQLLRIEDELADLAQYNGLKSFYNLSK

SEQ ID NO: 31206 - protein, 510 aa, Bacillus sp. KSM-K16
MSKKPVALIILDGFGLREEEKGNAVAHAQKPNFDRYWNEFPHATLRADGENVGLPEGQMGNSEVGHLNIGAGRIVYQSLTRVNLSIREGDFFKNETFIKAMDHVKEKQSALHIYGLLSDGGIHSHIDHIYALLDMAKQQNVERVYVHGFLDGRDVGPTSAEVYLKGLQDKFDEVGLGKLATVHGRYYAMDRDKRWDRVEKSYRAMVYGEGPSYKNGLELLDDSYKNNIVDEFVIPSVITEEDGTPVATVKDDDAVIFCNFRPDRAIQLSQVFTNEDFRGFDRGEKMPKRLHFVCLTKFSETVKGFVAFKPTNLDNTLGEVLSQQNYTQLRIAETEKYPHVTFFFSGGREDEFPGEERILINSPKVATYDLKPEMSAYEVTDALVKEIEGEKHDVIILNFANPDMVGHSGMLEPTVKAIEAVDECLGRVVDALLQKGGAAIITADHGNADEVVTLDGKPMTAHTTNKVPVIVTEKGITLREDGILADLAPTVLDLLGADKPKEMTGKTLKQ

SEQ ID NO: 31207 - protein, 251 aa, Bacillus sp. KSM-K16
MRKPIIAGNWKMNKTIGEAVDFVEAVKANVPAQATVDSVVCAPALFLDRLLQAVKGTELKIGAQTMHFEDNGAFTGEISPKALSDMGVHYVIIGHSERREMFAETDETVNKKVHAAFAHHLVPIMCCGETAEEREAGKMEAVVKEQVENGLAGLSEEQVKQTVIAYEPIWAIGTGKSATEKDANEACAYVRQTVAANFSEEAAEAIRIQYGGSVKPGNIKDYMAQPDIDGALVGGASLDADSFLELVGAAK

SEQ ID NO: 31208 - protein, 394 aa, Bacillus sp. KSM-K16
MNKKTLYDYDFAGKTVFCRVDFNVPMKDGKITDETRIQAALPTIKYLSEQGARVLLASHLGRPKGEVVESLRLAPVATRLSELLGKEVQAVQEAHGPVAKQAVEGLEDGGVLLLENVRFYPGEEKNDPELAKAFASLADIFVNDAFGAAHRAHASTEGIAHYLPSAAGFLMEKELDVLGKALSNPERPFTAVIGGAKVKDKIGVIDNLLDKVDNLIIGGGLAYTFVKAQGYEVGKSLLEEDKLDLAKQFMEKAEQKGVKFYMPEDVIVADDFSDDANKKEVAISGIPADWEALDIGPKTRKTYEAVLKASKLVIWNGPMGVFELESFAGGTKAVANALAEASDTYSVIGGGDSAAAVEQFGLADKMSHISTGGGASLEFMEGKELPGVVALSEK

SEQ ID NO: 31209 - protein, 206 aa, Bacillus sp. KSM-K16
MKPIRFDKDGLVPAIVQDANSKTVLTLAYMNEESLQKTMETKETWFYSRSRQQLWHKGETSGNTQHVVDVRYDCDQDAVLVLVEPKGPACHTGAYSCFSQSLTGSTSKVEGDRFQILNDLEETIAKREAEMPEGAYTTYLFTEGVDKILKKVGEEAGEVIIAAKNRDPEELRWEVADLFYHVLVLLQEQKLPLDKVLETLKARHQS

SEQ ID NO: 31210 - protein, 230 aa, Bacillus sp. KSM-K16
MSLIKLNDVWKVYPNNVKALNGMTVQIEKGEFVYVVGPSGAGKSTFIRLIYREEKATKGDIFVNNINLSTLKHKEIPKLRRNIGVVFQDFKLLPSLTVHENIAFALEVIEEHPSDIKKRVNEVLNLVKLKSKAKFLPSELSGGEQQRVAIARAIANRPDVLIADEPTGNLDPETAWTIMDLLESIHSLGTTVIMATHNKEIVNTLKRRVIAIENGRIVRDEARGNYGYEV

SEQ ID NO: 31211 - protein, 328 aa, Bacillus sp. KSM-K16
MMENVFDYEDIQLIPAKCIVGSRAECDTSVELGGRTFKLPVVPANMQTIIDENIARYLAENDYFYIMHRFQPETRLAFVKDMHERGLYASISVGVKEEEYTFVQQLADQHVVPEYVTIDIAHGHSEAVINMIRHIKTHLPDSFVIAGNVGTPEAVRELEHAGADATKVGIGPGKVCITKIKTGFGTGGWQLAALRWCAKAASKPIIADGGIRTHGDIAKSVRFGATMVMIGSLFAGHEESPGDTIEKDGKLYKEYFGSASEYQKGERKNVEGKKMYVEHKGSLAETLLEMEQDLQSSISYAGGKRLDAIRNVDYVVVKNSIFNGDKIY

SEQ ID NO: 31212 - protein, 322 aa, Bacillus sp. KSM-K16
MMGNTFSFKKWLLIVLTTLMAIVVLLAALTVFIGYKVTNPTIRLLHTNPNNVGLDYEDVSFSNIVDNISLSGWWIPSDQQSLFQNEKAVIFSHGYGYNRTEMPFSSLELAAAMHEAGYHVFMFDFRNSGMSEKAPTTFGGNEKSDLLSAIRYVHDQQGIENIALVGWSMGAATSIMAGAEADEVKAVVADSPFSDLNEYAKNSFHYWTGLPKSLAAGTARAVEAIVPTFNLEDVRPIYAATQYNQEKGLFLIHSRKDGAIPYTESEAIHSHAAGSELWLPEKGGHIRSYFHYKAEYEERVLNFLDRTFKKYEPQIVEARYFT

SEQ ID NO: 31213 - protein, 316 aa, Bacillus sp. KSM-K16
MFDVITLGDAMISFSPNATGPLKFVHSFERRVGGAELNVAIGCSRLGLKTGWITRLGKDEFGQHIQTFARGEGVDVSETKLVDGYATSLNFKEIMANGAGRTLYYRNPSPTETLKPEDLNPSYFQQAKILHLTGIYPAVATGNMAVTKQAIKLAKENGVKVAFDPNIRLRLWSKEEARLALYPLLQEVDILLTGDEEMEIILGTSDPAEIIAETTKLGIDLVAIKRGENGSVGSYQGKVVEAAPVQAAKVVDTVGAGDGFDAGLLYGYLQGWPLERMLAFANTIGSMVVSIVGDNEGLPYLEEVQAQLGELERIER

SEQ ID NO: 31214 - protein, 234 aa, Bacillus sp. KSM-K16
MAEIMAELIGTMVLIIFGAGVVAGVTLKQSKGEGAGWIAISVGWGFAVALGVYVAGTVSDAHLNPAVTLGFAAIGQFPWAQVPGYIIGQLAGAFLGAVIVFLHYYPHWKATEDAGVKLGVFATGPAIRHLPANFLSELIGTAVLVFGLLAIGANTFSEGLNPIVVGLLIIAIGLSLGGTTGYAINPARDLGPRLAHALLPINKKGPSDWAYAWVPILGPFVGGIVGAVLYTLIF

SEQ ID NO: 31215 - protein, 278 aa, Bacillus sp. KSM-K16
MKEHNKVVLITGANSGIGLELTKNLLLQGWEVAALIRSDFPNEQPIIIDALKKNHLRVYKADLADFSSLRNALDEIKKSETKIDMLFNNAGVSFAEYKHSKQGRELHFEVNTLVPFIITMELKELLLKGQNKTIINTSSNSLLFLKQFDLNTIINPKTPFKKLIGPYANSKLALSLWTNGIAPELSSEGIKIRSVCPGPNKTRLTKGKGMPSYILLIRNLMFTPPSKGASRLYDAAFNNEITGIFINKGKETAIKLSGHEEEVLNRLYDIYKNEFLVL

SEQ ID NO: 31216 - protein, 494 aa, Bacillus sp. KSM-K16
METIGALAKKAMLQHADNVAVSDEDGTLTYGQLKKRACQLAHALLQSGLNKGDRVATLMSNRKEHIEIDAAIAFAGLVKVPVNYRLHPKEATYIIEHAGAGVVIGERQLLAGLSANVERIDVEEAYEPFLQMQSDDFPDVAVGEDDLFAIMYTSGTTGKPKGAMLTHRNMIAGALSLIQACEITYGDTIGHVAPLTHGTNFLAQTAWFYGLKQVVFKKFEPSGFIDELEKQQVTVMFMVPTLVNLMVHDPCFDPVKLRSLKSINMAGAPIAVPKLQKALTALGPKLAETYGLVEAPMAITIMPKQQLGARPSSCGATGPFAEVKIVAPDGEEAPVGDIGEVACRGSLVMKGYWQNETATAEAIKDGWFYTGDLGRLDDKGYLHLMDRAKDVIITGGLNVYPREVEEVLNQYPAVKETCVFGAPDEKWGERICAHVVLQAGAAPVTEAALIAHCTEHLARYKKPKVIEFVHELPKNSYGKIMRKTLRNQYKKAGV

SEQ ID NO: 31217 - protein, 346 aa, Bacillus sp. KSM-K16
MTNSTSVQALFQPFSVKNMNLSNRIVMAPMTRQFSPGGVPGPDVAAYYRRRAENGVGLIVTEGTVIEHPDSSNQENVPHIYGDKALNGWANVVAEVHKAGGRIIPQIWHMGARGHVGDYTENDVAAIVDAFAQAAAEAKRIGFDGIELHGAHQYLIDQFFWDQTNPRTDRYGGDMVERTRFAVEVIEACRRAVGPDFPIVLRFSQWKSSDYTAKLATTAAELEQFLAPLTDAGVDVFHCSTRRFWEPEFEGSDLNLAGWTKKLTGKPTITVGSVGLDSEFTKLFAEGKGAGVSNINGLIEKLEQGEFDLVAIGRALLADPAWASKIRDGRINELTPFSPDAVKTLY

SEQ ID NO: 31218 - protein, 212 aa, Bacillus sp. KSM-K16
MGNIEKNQAPEVLPDDWVKRAKKLSTTLISDGMDIPVEMNHLIKPFNIDRVLVGSAVTIEVEDGDNLAVHHAIYHSRPGHVLVVSANGNEKRAVIGELMVAAADALQLNGFIIDGLIRDVQTLSTSSFPVFGRGAIPAGPTKNGPGVINQPINCGGLKVEPGDFVMGDADGVIVLPRANVENALQLAEEKAKYEKARLESIANGNIKPKWLE

SEQ ID NO: 31219 - protein, 448 aa, Bacillus sp. KSM-K16
MERSESIPLNFQEVEPPLSTQEATDEATRCLYCYDAPCITACPTGIDIPSFIQKITTNNLTGSARTIMEANPIGASCARVCPTEELCEGACVLNQTSKPIMIGKLQRYATDWAIQNEKPLFTAGKRNGQKVAVVGGGPAGLSAARELALLGYAVTVYEAETEAGGLDTYGIVSFRLPKRISLWEVEQVKSLGVSIQTNTRIGVDLSLAELQQSFDAVVLAVGMANVPPLGIPGEELHGVYDAIDLVKATKSTTLPQQFQGKRGVVIGAGNTAIDGATCAVRLGAENVKVLYRRTEAEMTAYQFEYEFAKQDGVEFRWLVSPIAVLGDEKGRVTALKCAEMALTEADESGRRTPIPTGATFVIKTDFIIKAIGQARHRWLEDVGIATHNGVISIDHHYETSVKGVFACGDAIFGQGQGEAMVVAAAEQGKQVAYAIDKKRRSQRAETSA

SEQ ID NO: 31220 - protein, 450 aa, Bacillus sp. KSM-K16
MNTGMEPTLAKKDGQYVWHAMQRPGAAPLIADSGEGSWFTDTNGNRYMDGVSGLWCLNLGHGQTEIIEAATEQMNKLAYFPLSLGHQPAIALAEKLAALLGGGFRTFFANGGSDANETAFKIARQYHKQTGSPEKQKIISRYRGYHGNSLGALAATAQANRKIKYDAALPGFLHIPPPYAYRSSFGSAAEDDQQAADFLEQTILWEGPETIAAFIMEPIISGGGVIYPQSNDYYKRVRDICDRYQVLLILDEVVSGFGRTGKLFGFMHGDDDFKPDIITLAKGLTSGYLPLGATCVAENVYQAFDGKGETSHFRHISTYGGHPASCAVALKAIDIIEREQIVNRVETLGHTVLGKLKQLEQLSIVGEVRGIGFLYGIELVQDKQTKEPADDDTMKAVVTACQKQGLIIGKNSDTIPGGGNVLIIAPPLTSSEEDLAFLVDTVSSVLRTFA

SEQ ID NO: 31221 - protein, 477 aa, Bacillus sp. KSM-K16
MSNYKFPDGFLWGGAIAANQAEGAYLEGGKGLTIVDLLPTGEQRRAIMEGYVQSLIPEEGVYYPSHEAIDFYHRYKEDIKLFAEMGFKALRVSIAWARIFPTGEDEEPNEDGLLFYDRLFNELLAHNIEPVVTLAHFDVPVHLIEKYGSWRSRKLVGLFEMYAKTVFTRYKNKVKYWMTFNEINMLLHLPFLGAGLVFKEGDNKQQIQYQAAHHQLVASALAVKACHEIIPDAKIGCMLAAGSFYPYTCNPKDIFKGMEKDRESYFFIDVQSRGEYPPYAMRFFKDNQLDIAMEPGDTELLKAHTVDYIGFSYYSSRTTSTDPEVNKNQTTGNVFGSIVNPYLEKSEWGWTIDPLGFRITANQLYDRYQKPLFVVENGLGAVDEWNEEGQIDDSYRIDYLGSHLAALGEAIKDGVEIIGYTSWGPIDIVSASSGEMKKRYGYIYVDRDNEGNGTLNRAKKASFDWYKQVIATNGESL

SEQ ID NO: 31222 - protein, 283 aa, Bacillus sp. KSM-K16
MKTVGLIGCGAMGKGMATSLLSAGYTVYIYDDMSKWREPLEKQGACFVENSAAVAKKAKYVLLSLPSPNIVADTVAGKEGVLCHLQTGGFLLDLSTTDVQTTLAMEKAAAAKGIYYLDCPVSGGPAGADAGTLTIMVGGDKQAYFSVKPLLDILGDTILYVGDSGAGQTVKLCNNMLVAGITTLLSETMAVASDHGVSRRLLAQIIQQSSGHNRVLDVFGENLISGSYDNVLFYLKHMAKDLELYMALSQDSRKPQHAAGTVNQLYRSALHQGKGDKDATAVY

SEQ ID NO: 31223 - protein, 439 aa, Bacillus sp. KSM-K16
MKYIIIGGDAAGMSAAMQLVRKDAQADITVLERGEHYSYAQCGLPYWIGGEIESDRKLIARDADTYRIKHGIDARINHEVKAVDTKQKTVSGDGFCLAYDKLLIASGASPVIPDWENGDLKGIYTLKTIPDAKKIIAALGTEKKTVTVIGGGSIGLEVAENLAKANHHVRILERAKRLAMNFDKEMADYIHEKAIDEGIELELNHEIIGFSGDKDGHVTGIRTNLTECPTDIVIVAVGVRPNTDFLRNTDIHLNNNGAIRVNRYMETNVPDVYAAGDCATQYHRLINKDMYYPLGTHANKQGRIAGLNMCGNTRVFMGIVGTQIYQFFDLALARTGLSSREIEEIGYPYKCVQAKLPHVAGYYPTNETIHIRLQFHAETGVVLGGQFIGTKGVDKRCDVLATALYHGMTMQDLEELDLGYSPPFNSVWDPLQQTARRRP

SEQ ID NO: 31224 - protein, 292 aa, Bacillus sp. KSM-K16
MRFDEAYSGKVFIMSRASYEEADAVIYGMPMDWTVSFRPGSRFGPARIREASLGLEEYSPYADKHLEEINYFDAGDIPLPFGNAARSLDIVEEYVDSLLADGKFPLGLGGEHLLSWPIFKAMYRKYPDLAIIHIDAHADLREQYEGEALSHSTPIRKACELIGAENVYSFGIRSGMREEFAYAKEAGMHLYKFDVAEPLKNVLPHLSGRPVYITIDIDVLDPAHAPGTGTAEAGGITSKELLEAQMLLSQADIQIVGADLVEVAPAYDPTEQTAIAASKFVREMLLGWVHKR

SEQ ID NO: 31225 - protein, 275 aa, Bacillus sp. KSM-K16
MEFWFTEKQTERFGITMKIKRTLHTEKTDFQQLDMVETEEFGNMLLLDGMVMTTEKDEFVYHEMVTHVPLFTHPNPKHVLVVGGGDGGAIREILKHPSVEKATLVDIDGKVIEYSKTYLPTIACALEDERVDVKVADGFMHIAQSANEYDVIMVDSTEPVGPAAKLFERGFYEGISKALKEDGIFVAQTDNPWFHQELVSNVYKDVKEIFPITRLYTANIPTYPSGMWTFTIGSKKHDPLAVEATRFHDVQTKYYTPDIHRAAFVLPKFVQDLLK

SEQ ID NO: 31226 - protein, 421 aa, Bacillus sp. KSM-K16
METVLMDNLWLTISAILVLLMQGGFILLEAGSTRMKNAGHIAGKTIFTVGIASLVFWAVGYGFIYGDGNPFIGMADFFFGNYADGVGSVDFFFQLTFAAIALTIAFGGFAERGKLAAYAIFAVLFSAFVYPLVAHWIWSDQGWLANLGKQDFAGSTVVHLTGAMAALAATLMLKPRLGKYDKNGKVNDLFGHNQVYTALGVLILWVGWFGFNAGSTGGVADAFFGYVALNTQLAAGAGTIAALFLVWALNGKADVPTTLNGTLAGLVAITASCAFVAPWAAVLIGVIGGLIVVVSMNMFDKLKIDDPIFALSVHGVAGVWGTLSNGLFATPELAEMNGGLPGLFYGGGFEQLGVQLLSVVVCGVFAFVASYVLLFITKGLLGGNLRVTEEEEILGLDMSEHGSYGYPETVQSEKTSTQTGS

SEQ ID NO: 31227 - protein, 402 aa, Bacillus sp. KSM-K16
MKPIATGIETSKNRLGFQTACTHGGDHWNKSGHLSPPICQSTAFEFPTTSEGAVRAADIKADEFYGRWGSRNERELEALIAALEEADDALCASSGLGAISMITHAFLNPGDHFIAVHNCYSETKILHESLAEQLSVDVTFIDSSDIHHYKQAIQPNTKLVFAETPANPTLSLVDISKVATLVHEQSDAVFVVDSTFATPYNQKPLKHGADIVVHSATKYLGGHSDVVAGVCAGSTELIDKVRHKYSFHGPHLDPFGAWLLCRGIRTLGLRMEKHNENALKLAQFLETHPKIRQVFYPFSESHPQYKLATKQMTGGGGMICFELKDGMDGGLGLISNVKLNKMAVSLGGYASTITHPASMTHNLLPREEREKGGITDGMIRFSVGIEEYEDIRDDLSQALDKI

SEQ ID NO: 31228 - protein, 452 aa, Bacillus sp. KSM-K16
MTTQAPTRESLIETIRETIEKKNVELLHMQFVDLEGMLKHVTITAEQLDQAVNGKTMFDGSSITGFTPINQSDLYLSPDLTTFAVLPWTEEEGYSEARFLCSVKNPDGSDFEGDPRNILKKTVKRAADKGYSISVGPELEFFLFDTDEHGEPTMRTQDAGGYFEPSPKDDGEKVRLAIYKALRMMGFTIEASHHEVAVGQHEINFKYSDALGSADAATTYKWVVKTVAKQFGLHATFMPKPLGGANGNGMHVNMSLFDIEKQENSFYNEDDKNALSKTAYHFIAGLLDNVKDFVAITNPLVNSYKRLVPGYEAPCYIAWSASNRSALVRIPATRGPGTRVEIRCPDPSANPYLAFAVIASAGLDGVENEIECPASVDADIFSMSSAEIKERAIENLPTSLEDAINRFETGAIGRKTLGDHAFEEYIELKRSEWDDFRTSVHPWEVASYQSKF

SEQ ID NO: 31229 - protein, 237 aa, Bacillus sp. KSM-K16
MNKIIPTTEEAMAFIKDGSTLVVGGFGLCGIPEHLIAAVKNSGASNLTVVSNNCGVDDFGLGQLLENKQISKMVASYVGENKRFEQQFLNGELEVELVPQGTLAERLRAGGAGIPAFYTATGVDTPVAEGKEEKTFDGKRYIMERGIVGDVALVKAWKADPFGNLVYRKTSRNFNPLVAAAGKVTIVEVEELVDLGELDPDQIHTPGIYVQHIFVGDSFEKRIERRTVATVEGGNGQ

SEQ ID NO: 31230 - protein, 364 aa, Bacillus sp. KSM-K16
MKTQVDNKVRAYIGETPVVLSRILEERQSILSELVDLVTGQDVSNILIVGSGSSYHSAVAVQAFVEKSLQMAVKVQYPTRFTNEVIAPEKGTLVIGISQGGKSLSTLRAISKAQEGGLKTVGITATKDSELAKRPDLFVPIACGEEQAGAKTKGVAATMLTLLLLGLEVGKKQGYYEEQAYQEWIRKIEATIENLPVVIASAESWVNQYMNEFSVAPQLMVIGYGPHYAIALEGGLKILETVRIPALGYEMEEYMHGIYNCINEDNHLIFLASEGAAEEQRRLLKMRKFLGEHTLKTYVIGGKDIQRESGRDLLMPLVNDPILSIFEYLIPLQLIAALVPLKKGINPAIPKFTSFHQQMGSKLQ

SEQ ID NO: 31231 - protein, 455 aa, Mycobacterium tuberculosis
MSAVALPRVSGGHDEHGHLEEFRTDPIGLMQRVRDELGDVGTFQLAGKQVVLLSGSHANEFFFRAGDDDLDQAKAYPFMTPIFGEGVVFDASPERRKEMLHNAALRGEQMKGHAATIEDQVRRMIADWGEAGEIDLLDFFAELTIYTSSACLIGKKFRDQLDGRFAKLYHELERGTDPLAYVDPYLPIESFRRRDEARNGLVALVADIMNGRIANPPTDKSDRDMLDVLIAVKAETGTPRFSADEITGMFISMMFAGHHTSSGTASWTLIELMRHRDAYAAVIDELDELYGDGRSVSFHALRQIPQLENVLKETLRLHPPLIILMRVAKGEFEVQGHRIHEGDLVAASPAISNRIPEDFPDPHDFVPARYEQPRQEDLLNRWTWIPFGAGRHRCVGAAFAIMQIKAIFSVLLREYEFEMAQPPESYRNDHSKMVVQLAQPAAVRYRRRTGVHHHH

SEQ ID NO: 31232 - protein, 367 aa, Pyrococcus furiosus DSM 3638
AHHHHHHGSKVVIVGNGPGGFELAKQLSQTYEVTVIDKEPVPYYSKPMLSHYIAGFIPRNRLFPYSLDWYRKRGIEIRLAEEAKLIDRGRKVVITEKGEVPYDTLVLATGARAREPQIKGKEYLLTLRTIFDADRIKESIENSGEAIIIGGGFIGLELAGNLAEAGYHVKLIHRGAMFLGLDEELSNMIKDMLEETGVKFFLNSELLEANEEGVLTNSGFIEGKVKICAIGIVPNVDLARRSGIHTGRGILIDDNFRTSAKDVYAIGDCAEYSGIIAGTAKAAMEQARVLADILKGEPRRYNFKFRSTVFKFGKLQIAIIGNTKGEGKWIEDNTKVFYENGKIIGAVVFNDIRKATKLEKEILDFYS

SEQ ID NO: 31233 - protein, 273 aa, Panax ginseng
PYYVAPEVLLKHYGPEADVWTAGVILYILLGGVPPFWAETQQGIFDAVLKGHIDFESDPWPLISDSAKDLIRKMLCSRPSDRLTAHEVLCHPWICENGVAPDRALDPAVLSRLKQFSAMNKLKKMALRVIAESLSEEEIAGLKEMFKAMDTDNSGAITFDELKAGLRKYGSTLKDTEIRDLMDAADVDNSGTIDYGEFVAATIHLNKLEREEHLMAAFQYFDKDGSGYITVDELQQACAEHNMTDVFLEDIIREVDQDNDGRIDYGEFVAMMK

SEQ ID NO: 31234 - protein, 227 aa, Cicer arietinum
PEVLKRSYGPEVDVWSAGVILYILLCGVPPFWAETEQGVALAILRGVLDFKREPWPQISDSAKSLVRQMLEPDPKKRLTAEQVLEHPWLQNAKKASNVPLGDIVRTRLKRFSLMNRFKKRALRVIADHLSLEEVEIIKDMFTLMDTDKDGRITYEELKAGLQKVGSQLAEPEIKLLMDVADVDGNGVLDYGEFVAVTIHLQRMENDEHFRKAFKFFDKDGSGYIELS

SEQ ID NO: 31235 - protein, 443 aa, Anaerobranca gottschalkii
MQQEILYFIMVDRFFQGIKDKEFDDIDKSHPRKFHGGDIKGIIEKLDYIQELGATALWITPIFKNDPDGYHGYWAQDFFSVDPHFGILEDFKELVQKAHRKGLKVILDIVVNHTGKTHPLLKEKPHWFHPLVPIKDWDNQKEVEEKCLGMLPDLNQDLPEVSSYLINMCKWWIVQTGLDGFRIDTVKHVPREFWRKFCQEMKGVKEDIILLGEVWHPDPCYLAPYQKDGINSLVDFPLYYAITKVFAKDEPMDKISSILLQDHLYQNPYLLGTFIDNHDVPRFLSVVKDRGKERLKLALDFLFSVRGVPIIYYGTETGMDGGDDPHNRKDMDFEGDLELRKYVKDLITLRKKYLSLSLGSLKVLKVTDDGMVFIRECGEEQVVIFINNSFDSQTFVVRLPDELQRKSWKLVWGKGTYQYSYEIASCIIPPKSSAYFQLFAPEK

SEQ ID NO: 31236 - protein, 385 aa, Lithospermum erythrorhizon
MSIPSSKLLFTPYQLGKHLLSHRIVMSPMTRNRSFDAMPQKHAILYYSQRTSPGGFIVTEATGVSDTAQGYPHTPGIWTKEQTEAWKPIVDAVHAKGGVFFCQLWHVGRVSNKGFQPNGQDPISSTTKGFTPAVRASYVQEDWFSPPRALETDEIPKIIEDFVVSARNAIDAGFDGIELHGAHGYLLEQFLKDNVNDRTDKYGGSLENRCRFVLELVEAVVKEVGADKVGIKLAPFSDFMEAGDSDPAALGTYLVEALNKYGLLYLHVLEPRMKTTGETNNQSIDPMRKAFKGTFMVGGGYDKDLGEKALEEGRADLVVYGRPFVANPDLPKRFEVDAPLNEPDRNTFFSHDPVVGYTDYPFLEEATCLVPVFDTHCIFSIFLFN

SEQ ID NO: 31237 - protein, 366 aa, Lithospermum erythrorhizon
MASKKLLFTPYQLGKHLLSHRIVMSPMTRNRSFDAMPQKHAILYYSQRASKGGFILTEATGVSDTAQGYPHTPGIWTKEQPEAWKPIVDAVHAKGAVFFCQLWHVGRVSNKGFQPNGQDPISSTTKGFTPAVRASYVQEDWFSPPRALETDEIPKIIDDFRIAARNAIDAGFDGVELHGAHGYLLEQFLKDNVNDRTDKYGGSLENRCRFVLELVEAVVNEVGADKVGIKLAPFSDFMEAGDSDPATLGTYLAEALNKFGILYMHVLEPRMKTTGETNNESIDPMRKAFKGTFVVGGGYDKELGEKALEEGRADLVVYGRPFVSNPDLPKRFEIDAPLNEYDRNTFFTHDPVVGYTDYPFLEEATA

SEQ ID NO: 31238 - protein, 510 aa, Vigna radiata var. radiata
MMGLLTNLRGSRTDGAQQDSLPVLAPGGNPKRKWSNLMPLVVALVVIAEIAFLGRLDMAKNAAMVDSLADFFYRSRAVVEGDDLGLGLVASDRNSESYSCEEWLEREDAVTYSRDFSKEPIFVSGADQEWKSCSVGCKFGFSGDRKPDAAFGLPQPSGTASILRSMESAEYYAENNIAMARRRGYNIVMTTSLSSDVPVGYFSWAEYDMMAPVQPKTEAALAAAFISNCGARNFRLQALEALEKSNIKIDSYGGCHRNRDGRVNKVEALKHYKFSLAFENSNEEDYVTEKFFQSLVAGTVPVVVGAPNIQDFAPSPGSILHIKEIEDVESVAKTMRYLAENPEAYNQSLRWKYEGPSDSFKALVDMAAVHSSCRLCIHLATVSREKEENNPSLKRRPCKCTRGPETVYHIYVRERGRFEMESIYLRSSNLTLNAVKAAVVLKFTSLNLVPVWKTERPEVIRGGSALKLYKIYPIGLTQRQALYTFSFKGDADFRSHLENNPYAKFEVIFV

SEQ ID NO: 31239 - protein, 245 aa, Wolbachia sp. wRi
MIILSNLSCYAVFGIELEFYIEGIEKEYLFLNSIKNKIASLEFSCEKENSTHQYEIKSGCYTNSYNLIKHFELAKQSLTETAQKLGGNVSFKAKPYLDRAGSALNVHVNLVNSNNGNLFYINEQKYSDYLIHSIGGLCAMMKKHMLFFAPNDDSYLRFQYPDIHTPTTISWGVNNRTAAIRIPYFGNDFKRCRLEHRVPGADCDLEKVLTAIIEGMVFGIENKIAPPNRVYGIASDPQYEMERLI

SEQ ID NO: 31240 - protein, 410 aa, Schizosaccharomyces pombe
MDREDILKEFCNRNNIDVSQGRFFLESTNWNYELATALLHEVIPPEEDHGLQPSSDVSKVPEVTGSSSGISGGDQQPPRPLQRQQNTQGQGMKSGTASKKFATLRDLEGNDESAEEKSHLFTGGEKSGLSVEDGDPDPKKQLVRDILEKARQHTISPLDEQDSGPSSLASSWASVGQRLGTENEASGSTTPVTQSGPPRENPPTESQPEKPLRRTLYFWRNGFSVDDGPIYTYDDPANQEMLRYINSGRAPLHLLGVSMNQPIDVVVQHRMDEDYVAPFKPFSGKGQRLGSTYMQPRMSQMPGGLYTDTSTSSSVPINVKPNSTTPHASLQIDENKPTTRIQVRLSNGGRTVLTVNLSHTLHDIYEAVRAVSPGNFILSVPFPAKTLEDDPSVTVEAASLKNASLVQKSL

SEQ ID NO: 31241 - protein, 168 aa, Plantago lanceolata
MSRSRTNGNFIDKTFSIVANILLQIIPTTSGEKEAFTYYRDGMSAQSEGNYAEALQNYYEAMRLEMDPYDRSYILYNIGLIHTSNGEHTKALEYYFRALERNPFLPQAFNNMAVICHYRGEQAVREGDSEIAEAWFDQAAEYWKQAIALTPGNYIEAHNWLKITRRFE

SEQ ID NO: 31242 - protein, 168 aa, Plantago rigida
MSRSRTNGNFIDKTFSIVANILLQIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAVREGDSEIAEAWFDQAAEYWKQAIALTPGNYIEAHNWLKITRRFD

SEQ ID NO: 31243 - protein, 168 aa, Plantago rugelii
MSRSRTNGNFIDKTFSIVANILLQIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAVREGDSEIAEAWFDQAAEYWKQAIALTPGNYIEAHNWLKITRRFE

SEQ ID NO: 31244 - protein, 496 aa, Mycobacterium tuberculosis H37Rv
MSLLITSPATVAAAATHLAGIGSALSTANAAAAAPTTALSVAGADEVSVLIAALFEAYAQEYQALSAQALAFHDQFVQALNMGAVCYAAAETANATPLQALQTVQQNVLTVVNAPTQALLGRPIIGNGANGLPNTGQDGGPGGLLFGNGGNGGSGGVDQAGGNGGAAGLIGNGGSGGVGGPGIAGSAGGAGGAGGLLFGNGGPGGAGGIGTTGDGGPGGAGGNAIGLFGSGGTGGMGGVGGMGGVGNGGNAGNGGTAGLFGHGGAGGAGGIGSADGGLGGGGGNGRFMGNGGVGGAGGYGASGDGGNAGNGGLGGVFGDGGAGGTGGLGDVNGGLAGIGGNAGFVRNGGAGGNGQLGSGAVSSAGGMGGNGGLVFGNGGPGGLGGPGTSAGNGGMGGNAVGLFGQGGAGGAGGSGFGAGIPGGRGGDGGSGGLIGDGGTGGGAGAGDAAASAGGNGGNARLIGNGGDGGPGMFGGPGGAGGSGGTIFGFAGTPGPS

SEQ ID NO: 31245 - protein, 487 aa, Mycobacterium tuberculosis H37Rv
MSFVSVAPEIVVAAATDLAGIGSAISAANAAAAAPTTAVLAAGADEVSAAIAALFSGHAQAYQALSAQAAAFHQQFVQTLAGGAGAYAAAEAQVEQQLLAAINAPTQALLGRPLIGNGADGAPGTGQAGGAGGILYGNGGNGGSGAAGQAGGAGGPAGLIGHGGSGGAGGSGAAGGAGGHGGWLWGNGGVGGSGGAGVGAGVAGGHGGAGGAAGLWGAGGGGGNGGNGADANIVSGGDGGLGGAGGGGGWLYGDGGAGGHGGQGAIGLGGGAGGDGGQGGAGRGLWGTGGAGGHGGQGGGTGGPPLPGQAGMGAAGGAGGLIGNGGAGGDGGVGASGGVAGVGGAGGNAMLIGHGGAGGAGGDSSFANGAAGGAGGAGGHLFGNGGSGGHGGAVTAGNTGIGGAGGVGGDARLIGHGGAGGAGGDRAGALVGRDGGPGGNGGAGGQLYGNGGDGAPGTGGTLQAAVSGLVTALFGAPGQPGDTGQPG

SEQ ID NO: 31246 - protein, 383 aa, Mycobacterium tuberculosis H37Rv
MPAVQPWLYSNMPAIRGAVLDQIGVPRPYWRSKPISVVELHLDPPDRGEVLVRIEAAGVCHSDLSVVDGTRVRPVPILLGHEAAGIVEQVGDGVDGVAVGQRVVLVFLPRCGQCAACATDGRTPCEPGSAANKAGTLLGGGIRLSRGGRPVYHHLGVSGFATHVVVNRASVVPVPHEVPPTVAALLGCAVLTGGGAVLNVGDPQPGQSVAVVGLGGVGMAAVLTALTYTDVRVVAVDQLPEKLSAAKALGAHEIYTPQQATAGGVKAAVVVEAVGHPAALHTAIGLTAPGGRTITVGLPPPDVRISLSPLDFVTEGRSLIGSYLGSAVPSHDIPRFVSLWQSGRLPVESLVTSTIRLDDINEAMDHLADGIAVRQLISFTGDL

SEQ ID NO: 31247 - protein, 487 aa, Mycobacterium tuberculosis H37Rv
MPPLDITDERLTREDTGYHKGLHSRQLQMIALGGAIGTGLFLGAGGRLASAGPGLFLVYGICGIFVFLILRALGELVLHRPSSGSFVSYAREFYGEKVAFVAGWMYFLNWAMTGIVDTTAIAHYCHYWRAFQPIPQWTLALIALLVVLSMNLISVRLFGELEFWASLIKVIALVTFLIVGTVFLAGRYKIDGQETGVSLWSSHGGIVPTGLLPIVLVTSGVVFAYAAIELVGIAAGETAEPAKIMPRAINSVVLRIACFYVGSTVLLALLLPYTAYKEHVSPFVTFFSKIGIDAAGSVMNLVVLTAALSSLNAGLYSTGRILRSMAINGSGPRFTAPMSKTGVPYGGILLTAGIGLLGIILNAIKPSQAFEIVLHIAATGVIAAWATIVACQLRLHRMANAGQLQRPKFRMPLSPFSGYLTLAFLAGVLILMYFDEQHGPWMIAATVIGVPALIGGWYLVRNRVTAVAHHAIDHTKSVAVVHSADPI

SEQ ID NO: 31248 - protein, 249 aa, Mycobacterium tuberculosis H37Rv
MANTGSLVLLRHGESDWNALNLFTGWVDVGLTDKGQAEAVRSGELIAEHDLLPDVLYTSLLRRAITTAHLALDSADRLWIPVRRSWRLNERHYGALQGLDKAETKARYGEEQFMAWRRSYDTPPPPIERGSQFSQDADPRYADIGGGPLTECLADVVARFLPYFTDVIVGDLRVGKTVLIVAHGNSLRALVKHLDQMSDDEIVGLNIPTGIPLRYDLDSAMRPLVRGGTYLDPEAAAAGAAAVAGQGRG

SEQ ID NO: 31249 - protein, 434 aa, Mycobacterium tuberculosis H37Rv
MIAIGGVIGAGLFVGSGVVIRATGPAAFLTYALCGALIVLVMRMLGEMAAANPSTGAFADYAAKALGGWAGFSVGWLYWYFWVIVVGFEAVAGGKVLTYWIDAPLWLASLCLMMMMTATNLVSVSSFGEFEFWFAGVKVATIVGFLVLGTAFAFGLLPGHGMDFSNLSAHGGFFPDGVGAVFAAIVVAIFSMTGTEVVTIAAAEAPDPQRAVQRAMSTVVARIVIFFVGSVFLLTVILPWNSLELGASPYVAALRHMGIGGADQIMNAVVLTAVLSCLNSGLYTASRMLFVLAARQEAPAQLVKVNRRGVPTFAIMGSSVVGFLCVIMAWVSPATVFVFLLNSSGAVILFVYLLIALSQIVLRRQTSGQNLGVRMWLFPGLSIVTVTGIVAVLARMAFDYAARSQLWLSLLSWAVVVGCYLVTTLVRRPLNRPW

SEQ ID NO: 31250 - protein, 1306 aa, Mycobacterium tuberculosis H37Rv
MSFVIATPEMLTTAATDLAKIGSTITAANTAAAAVAKVLPASADEVSVAVAALFGTHAQEYQTVSAQVATFHDRFVQTLSAAASSYVAAEAVNVEQSLLAAVNAPTQALFGRPLIGNGADGSPGTGQAGGPGGILYGNGGNGGSGAPGQRGGAGGAAGLIGNGGNGGAGGVGTTGGAGGHGGAGGWLYGNGGAGGFGGAGAVGGNGGAGGTAGLFGVGGAGGAGGNGIAGVTGTSASTPGGSGTAGGAGGIGGNGGAGGAGGVLMGNGGNGGAGGEGGPGGAGGAGASGAHATNLGADGQAGGNGGNGGAGGTGGVGGPGGGHGLLGLGGSHGAGGAGGSGGDGGAPGDGGNGATGTWGHNLGAGGTGGNGGNPGAGGAGGAGGASVGGSAHGANGAPGTTSTSGGNGGDGGKGADAISSGQTGANGGRGGDGGQVGNGGAGGAGGRGGAGGLGFGSEAPGRPGGAGGTGGAGGNGGTQAGDGGTGGAGGAGGDGGSGGAGSIGFNASAPGAAGSPGGNGGNGGPGGAGGEGGAGGLALAASGQNGSQGAGGDGGAGGNGGTPGNGGHGAAGALGVNGGVGGAGGHGGDPGVGGAGGQGGSGSTPGANGAPGNTPTSGGNGGNGGRGADATGFGQTGASGGRGGDGGLVGNGGAGGAGGNGSKGLPGLGRLGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGNGGSGGTGGDPGDGGNGANGSVFTNNGIGGNGGNGGNAGPSGAGGSGGAGSTFGATGSSSSIHVNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGGTGGDGGRGAHGTLFSSLAGTGGTGGNGGTGGTGGTGGAGGAGGTGSTLGATGATGAAGRAGNGGVGGSGGLGSAFGPGGTGGMGGAGGTSTVSAGGDGGRGGFGGDGLDASSGGNGGDGGHGGDGFRTAGAGGRGGDGGKGADPGGLFPIPGAGGKGGTGGTGGTAHLGPLAIIGQSGQPGQFGSPGADGRGGAGGAGGGGGAGGSF

SEQ ID NO: 31251 - protein, 375 aa, Mycobacterium tuberculosis H37Rv
MKTKGALIWEFNQPWSVEEIEIGDPRKDEVKIQMEAAGMCRSDHHLVTGDIPMAGFPVLGGHEGAGIVTEVGPGVDDFAPGDHVVLAFIPSCGKCPSCQAGMRNLCDLGAGLLAGESVTDGSFRIQARGQNVYPMTLLGTFSPYMVVHRSSVVKIDPSVPFEVACLVGCGVTTGYGSAVRTADVRPGDDVAIVGLGGVGMAALQGAVSAGARYVFAVEPVEWKRDQALKFGATHVYPDINAALMGIAEVTYGLMAQKVIITVGKLDGADVDSYLTITAKGGTCVLTAIGSLVDTQVTLNLAMLTLLQKNIQGTIFGGGNPHYDIPKLLSMYKAGKLNLDDMVTTAYKLEQINDGYQDMLNGKNIRGVIRYTDDDR

SEQ ID NO: 31252 - protein, 499 aa, Mycobacterium tuberculosis H37Rv
MTAAQQDQAPMATPGCREGETYDVVVLGAGPVGQNVADRARAGGLRVAVVERELVGGECSYWACVPSKALLRPVIAISDARRVDGAREAVDGSINTAGVFGRRNRYVAHWDDTGQADWVSGIGATLIRGDGRLDGPRRVVVTKSSGESVALTARHAVVICTGSRPALPDLPGITEARPWTNRQATDNSTVPDRLAIVGAGGVGVEMATAWQGLGASVTLLARGSGLLPRMEPFVGELIGRGLADAGVDVRVGVSVRALGRPNPTGPVVLELDDGTELRVDEVLFATGRAPRTDDIGLETIGLTPGSWLDVDDTCRVRAVDDGWLYAAGDVNHRALLTHQGKYQARIAGTAIGARAAGRPLDTTSWGMHATTADHHAVPQAFFTDPEAAAVGLTADQAAQAGHRIKAIDVEIGDVVMGAKLFADGYTGRARMVVDVDRGHLLGVTMVGPGAAELLHSATVAVAGQVPIDRLWHAVPCFPTISELWLRLLESYRDSFYLLV

SEQ ID NO: 31253 - protein, 372 aa, Mycobacterium tuberculosis H37Rv
MRSRQTRDRYRLLPEGYQVTPGRNRHPGTMVGNTPVLWIPELSGTSDPDRGFWAKLEGFNPGGMKDRPALYMVECARARGDIAPGAAIVESTGGTLGLGLALAGKVYRHPVTLVTDPGLEPIIARMLTAYGAGVDMVTQPHPVGGWQQARKDRVAQLMAEYPGAWNPNQYGNPDNVGAYRSLALELVAQLGRIDVLVCSVGTGGHSAGVARVLREFNPDMRLIGVDTIGSTIFGQPASNRLMRGLGSSIYPRNVDYRAFDEVHWVAPPEAVWACRSLAATHYASGGWSVGAVALVAGWAARNLPADTTIAAVFPDGPQRYFDTIYNDAYCNEHELLGGQPPTEPDEIASPLDAVVTRWTRSTTVIDPTQVVS

SEQ ID NO: 31254 - protein, 463 aa, Mycobacterium tuberculosis H37Rv
MSYMIAVPDMLSSAAGDLASIGSSINASTRAAAAATTRLLPAAADEVSAHIAALFSGHGEGYQAIARQMAAFHDQFTLALTSSAGAYASAEATNVEQQVLGLINAPTQALLGRPLIGNGADGTAANPNGGAGGLLYGNGGNGFSQTTAGLTGGTGGSAGLIGNGGNGGAGGAGANGGAGGNGGWLYGSGGNGGAGGAGPAGAIGAPGVAGGAGGAGGTAGLFGNGGAGGAGGAGGAGGRGGDGGSAGWLSGNGGDAGTGGGGGNAGNGGNGGSAGWLSGNGGTGGGGGTAGAGGQGGNGNSGIDPGNGGQGADTGNAGNGGHGGSAAKLFGDGGAGGAGGMGSTGGTGGGGGFGGGTGGNGGNGHAGGAGGSGGTAGLLGSGGSGGTGGDGGNGGLGAGSGAKGNGGNGGDGGKGGDAQLIGNGGNGGNGGKGGTGLMPGINGTGGAGGSRGQISGNPGTPGQ

SEQ ID NO: 31255 - protein, 464 aa, Mycobacterium tuberculosis H37Rv
MRIAQHISELIGGTPLVRLNSVVPDGAGTVAAKVEYLNPGGSSKDRIAVKMIEAAEASGQLKPGGTIVEPTSGNTGVGLALVAQRRGYKCVFVCPDKVSEDKRNVLIAYGAEVVVCPTAVPPHDPASYYSVSDRLVRDIDGAWKPDQYANPEGPASHYVTTGPEIWADTEGKVTHFVAGIGTGGTITGAGRYLKEVSGGRVRIVGADPEGSVYSGGAGRPYLVEGVGEDFWPAAYDPSVPDEIIAVSDSDSFDMTRRLAREEAMLVGGSCGMAVVAALKVAEEAGPDALIVVLLPDGGRGYMSKIFNDAWMSSYGFLRSRLDGSTEQSTVGDVLRRKSGALPALVHTHPSETVRDAIGILREYGVSQMPVVGAEPPVMAGEVAGSVSERELLSAVFEGRAKLADAVSAHMSPPLRMIGAGELVSAAGKALRDWDALMVVEEGKPVGVITRYDLLGFLSEGAGRR

SEQ ID NO: 31256 - protein, 448 aa, Mycobacterium tuberculosis H37Rv
MGPPPAARRREGEPDNQDPAGLLTDKYELTMLAAALRDGSANRPTTFEVFARRLPTGRRYGVVAGTGRLLEALPQFRFDADACELLAQFLDPATVRYLREFRFRGDIDGYAEGELYFPGSPVLSVRGSFAECVLLETLVLSIFNHDTAIASAAARMVSAAGGRPLIEMGSRRTHERAAVAAARAAYIAGFAASSNLAAQRRYGVPAHGTAAHAFTMLHAQHGGPTELAERAAFRAQVEALGPGTTLLVDTYDVTTGVANAVAAAGAELGAIRIDSGELGVLARQAREQLDRLGATRTRIVVSGDLDEFSIAALRGEPVDSYGVGTSLVTGSGAPTANMVYKLVEVDGVPVQKRSSYKESPGGRKEALRRSRATGTITEELVHPAGRPPVIVEPHRVLTLPLVRAGQPVADTSLAAARQLVASGLRSLPGDGLKLAPGEPAIPTRTIPA

SEQ ID NO: 31257 - protein, 461 aa, Mycobacterium tuberculosis H37Rv
MATATTQRPLKGPAKRMSTWTMTREAITIGFDAGDGFLGRLRGSDITRFRCAGRRFVSISHPDYVDHVLHEARLKYVKSDEYGPIRATAGLNLLTDEGDSWARHRGALNSTFARRHLRGLVGLMIDPIADVTAARVPGAQFDMHQSMVETTLRVVANALFSQDFGPLVQSMHDLATRGLRRAEKLERLGLWGLMPRTVYDTLIWCIYSGVHLPPPLREMQEITLTLDRAINSVIDRRLAEPTNSADLLNVLLSADGGIWPRQRVRDEALTFMLAGHETTANAMSWFWYLMALNPQARDHMLTELDDVLGMRRPTADDLGKLAWTTACLQESQRYFSSVWIIAREAVDDDIIDGHRIRRGTTVVIPIHHIHHDPRWWPDPDRFDPGRFLRCPTDRPRCAYLPFGGGRRICIGQSFALMEMVLMAAIMSQHFTFDLAPGYHVELEATLTLRPKHGVHVIGRRR

SEQ ID NO: 31258 - protein, 491 aa, Mycobacterium tuberculosis H37Rv
MSNVMVVPGMLSAAAADVASIGAALSAANGAAAPTTAGVLAAGADEVSAAIASLFSGYARDYQALSAQMARFHQQFVQALTASVGSYAAAEAANASPLQALEQQVLAAINAPTQTLLGRPLIGNGADGLPGQNGGAGGLLWGNGGNGGAGDAAHPNGGNGGDAGMFGNGGAGGAGYSPAAGTGAAGGAGGAGGAGGWLSGNGGAGGNGGTGASGADGGGGLPPVPASPGGNGGGGDAGGAAGMFGTGGAGGTGGDGGAGGAGDSPNSGANGARGGDGGNGAAGGAGGRLFGNGGAGGNGGTAGQGGDGGTALGAGGIGGDGGTGGAGGTGGTAGIGGSSAGAGGAGGDGGAGGTGGGSSMIGGKGGTGGNGGVGGTGGASALTIGNGSSAGAGGAGGAGGTGGTGGYIESLDGKGQAGNGGNGGNGAAGGAGGGGTGAGGNGGAGGNGGDGGPSQGGGNPGFGGDGGTGGPGGVGVPDGIGGANGAQGKHG

SEQ ID NO: 31259 - protein, 1329 aa, Mycobacterium tuberculosis H37Rv
MSLVIVAPETVAAAALDVARIGSSIGAANAAAAGSTTSVLAAGADEVSAAIATLFGSHAREYQAISTQVAAFHDRFAQTLSAAVGSYVSAEATNAAPLATLEHNVLNALNAPTQALLGRPLIGDGAAGAPGTGQAGGAGGILWGNGGAGGSGAPGQVGGAGGAAGLFGTGGAGGAGGAGAAGGAGGSGGWLLGNGGVGGAGGQSLLGGATGGAGGNAGLFGVGGTGGPGGPGGPGGVGGTGGAGGLGGTLYGAGGHGGAGGPGPIGGVGGHGGVGGAAGLLGVGGHGGAGGHGAEGVAGAAGEDLSPHGTSGGVGGDAGDGGTGGRGGWLAGAGGAGGAGGVGGTGGAGGAGFSRALIVAGDNGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGANGANATTPGAKGGDGGHGGPGAQGGNGGQGGPGGLAGNLFGQNGIQGVGGSGGKGGAGGLAGDGGNGANGNFAFGDGNGGHGGNGGNPGAGGQGGSGGAGSTPGAKGAHGFTPTSGGDGGDGGNGGNSQVVGGNGGDGGNGGNGGSAGTGGNGGRGGDGAFGGMSANATNPGENGPNGNPGGNGGAGGAGGAGLNGGNGGAGGNGGLGGFGGNGAAGANGVAVGAPGQPGGAGGHGGAGGNGGAGGNGGQGVVSDGAGGAGGAGGDGGAPGDGANGGNGQGAGAFAGGGGGRGGDGGNAGNAGAGGPGGTGSTAGKAGPAGSILHDGGNGGHGGHGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGGTGGQGANGGLTGGRGGTGGNGGNGNTGGTGGAGGTGGTGHNGSQPGMGGNGGAGGFGGNGFAGVGGRGGMGGSGGTGGTGDAGPFGTGTGGTGGHGGQGGGGGFSILLGLGGLGGLGSPGSIATGTAGGAGGGGGFGGLGGGEFV

SEQ ID NO: 31260 - protein, 370 aa, Mycobacterium tuberculosis H37Rv
MSFVVANTEFVSGAAGNLARLGSMISAANSAAAAQTTAVAAAGADEVSAAVAALFGAHGQTYQVLSAQAAAFHSQFVQALSGGAQAYAAAEATNFGPLQPLFDVINAPTLALLNRPLIGNGADGTAANPNGQAGGLLIGNGGNGFSPAAGPGGNGGAAGLLGHGGNGGVGALGANGGAGGTGGWLFGNGGAGGNSGGGGGAGGIGGSAVLFGAGGAGGISPNGMGAGGSGGNGGLFFGNGGAGASSFLGGGGAGGRAFLFGDGGAGGAALSAGSAGRGGDAGFFYGNGGAGGSGAGGASSAHGGAGGQAGLFGNGGEGGDGGALGGNGGNGGNAQLIGNGGDGGDGGGAGAPGLGGRGGLLLGLPGANGT

SEQ ID NO: 31261 - protein, 115 aa, Mycobacterium tuberculosis H37Rv
MTLDPKIAARLKRNADGLVTAVVQERGSGDVLMVAWMNDEALARTLQTREATYYSRSRAEQWVKGATSGHTQHVHSVRLDCDGDAVLLTVDQVGGACHTGDHSCFDAAVLLEPDD

SEQ ID NO: 31262 - protein, 1011 aa, Mycobacterium tuberculosis H37Rv
MSFLLVEPDLVTAAAANLAGIRSALSEAAAAASTPTTALASAGADEVSAAVSRLFGAYGQQFQALNARAATFHAEFVSLLNGGAAAYTGAEAASVSSMQALLDAVNAPTQTLLGRPLIGNGADGVAGTGSNAGGNGGPGGILYGNGGNGGAGGNGGAAGLIGNGGAGGAGGAGGAGGAGGAGGTGGLLYGNGGAGGNGGSAAAAGGAGGNALLFGNGGNGGSGASGGAAGHAGTIFGNGGNAGAGSGLAGADGGLFGNGGDGGSSTSKAGGAGGNALFGNGGDGGSSTVAAGGAGGNTLVGNGGAGGAGGTSGLTGSGVAGGAGGSVGLWGSGGAGGDGGAATSLLGVGMNAGAGGAGGNAGLLYGNGGAGGAGGNGGDTTVPLFDSGVGGAGGAGGNASLFGNGGTGGVGGKGGTSSDLASATSGAGGAGGAGGVGGLLYGNGGNGGAGGIGGAAINILANAGAGGAGGAAGSSFIGNGGNGGAGGAGGAAALFSSGVGGAGGSGGTALLLGSGGAGGNGGTGGANSGSLFASPGGTGGAGGHGGAGGLIWGNGGAGGNGGNGGTTADGALEGGTGGIGGTGGSAIAFGNGGQGGAGGTGGDHSGGNGIGGKGGASGNGGNAGQVFGDGGTGGTGGAGGAGSGTKAGGTGSDGGHGGNATLIGNGGDGGAGGAGGAGSPAGAPGNGGTGGTGGVLFGQSGSSGPPGAAALAFPSLSSSVPILGPYEDLIANTVANLASIGNTWLADPAPFLQQYLANQFGYGQLTLTALTDATRDFAIGLAGIPPSLQSALQALAAGDVSGAVTDVLGAVVKVFVSGVDASDLSNILLLGPVGDLFPILSIPGAMSQNFTNVVMTVTDTTIAFSIDTTNLTGVMTFGLPLAMTLNAVGSPITTAIAFAESTTAFVSAVQAGNLQAAAAALVGAPANVANGFLNGEARLPLALPTSATGGIPVTVEVPVGGILAPLQPFQATAVIPVIGPVTVTLEGTPAGGIVPALVNYAPTQLAQAIAP

SEQ ID NO: 31263 - protein, 498 aa, Mycobacterium tuberculosis H37Rv
MSFVVTIPEALAAVATDLAGIGSTIGTANAAAAVPTTTVLAAAADEVSAAMAALFSGHAQAYQALSAQAALFHEQFVRALTAGAGSYAAAEAASAAPLEGVLDVINAPALALLGRPLIGNGANGAPGTGANGGDGGILIGNGGAGGSGAAGMPGGNGGAAGLFGNGGAGGAGGNVASGTAGFGGAGGAGGLLYGAGGAGGAGGRAGGGVGGIGGAGGAGGNGGLLFGAGGAGGVGGLAADAGDGGAGGDGGLFFGVGGAGGAGGTGTNVTGGAGGAGGNGGLLFGAGGVGGVGGDGVAFLGTAPGGPGGAGGAGGLFGVGGAGGAGGIGLVGNGGAGGSGGSALLWGDGGAGGAGGVGSTTGGAGGAGGNAGLLVGAGGAGGAGALGGGATGVGGAGGNGGTAGLLFGAGGAGGFGFGGAGGAGGLGGKAGLIGDGGDGGAGGNGTGAKGGDGGAGGGAILVGNGGNGGNAGSGTPNGSAGTGGAGGLLGKNGMNGLP

SEQ ID NO: 31264 - protein, 485 aa, Mycobacterium tuberculosis H37Rv
MSSSESPAGIAQIGVTGLAVMGSNIARNFARHGYTVAVHNRSVAKTDALLKEHSSDGKFVRSETIPEFLAALEKPRRVLIMVKAGEATDADAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 31265 - protein, 1327 aa, Mycobacterium tuberculosis H37Rv
MRCGIVVNVTGPPPTIDRRYHDAVIVGLDNVVDKATRVHAAAWTKFLDDYLTRRPQRTGEDHCPLTHDDYRRFLAGKPDGVADFLAARGIRLPPGSPTDLTDDTVYGLQNLERQTFLQLLNTGVPEGKSIASFARRLQVAGVRVAAHTSHRNYGHTLDATGLAEVFAVFVDGAVTAELGLPAEPNPAGLIETAKRLGANPGRCVVIDSCQTGLRAGRNGGFALVIAVDAHGDAENLLSSGADAVVADLAAVTVGSGDAAISTIPDALQVYSQLKRLLTGRRPAVFLDFDGTLSDIVERPEAATLVDGAAEALRALAAQCPVAVISGRDLADVRNRVKVDGLWLAGSHGFELVAPDGSHHQNAAATAAIDGLAEAAAQLADALREIAGAVVEHKRFAVAVHYRNVADDSVDNLIAAVRRLGHAAGLRVTTGRKVVELRPDIAWDKGKALDWIGERLGPAEVGPDLRLPIYIGDDLTDEDAFDAVRFTGVGIVVRHNEHGDRRSAATFRLECPYTVCQFLSQLACDLQEAVQHDDPWTLVFHGYDPGQERLREALCAVGNGYLGSRGCAPESAESEAHYPGTYVAGVYNQLTDHIEGCTVDNESLVNLPNWLSLTFRIDGGAWFNVDTVELLSYRQTFDLRRATLTRSLRFRDAGGRVTTMTQERFASMNRPNLVALQTRIESENWSGTVDFRSLVDGGVHNTLVDRYRQLSSQHLTTAEIEVLADSVLLRTQTSQSGIAIAVAARSTLWRDGQRVDAQYRVARDTNRGGHDIQVTLSAGQSVTLEKVATIFTSRDAATLTAAISAQRCLGEAGRYAELCQQHVRAWARLWERCAIDLTGNTEELRLVRLHLLHLLQTISPHTAELDAGVPARGLNGEAYRGHVFWDALFVAPVLSLRMPKVARSLLDYRYRRLPAARRAAHRAGHLGAMYPWQSGSDGSEVSQQLHLNPRSGRWTPDPSDRAHHVGLAVAYNAWHYYQVTGDRQYLVDCGAELLVEIARFWVGLAKLDDSRGRYLIRGVIGPDEFHSGYPGNEYDGIDNNAYTNVMAVWVILRAMEALDLLPLTDRRHLIEKLGLTTQERDQWDDVSRRMFVPFHDGVISQFEGYSELAELDWDHYRHRYGNIQRLDRILEAEGDSVNNYQASKQADALMLLYLLSSDELIGLLARLGYRFAPTQIPGTVDYYLARTSDGSTLSAVVHAWVLARANRSNAMEYFRQVLRSDIADVQGGTTQEGIHLAAMAGSIDLLQRCYSGLELRDDRLVLSPQWPEALGPLEFPFVYRRHQLSLRISGRSATLTAESGDAEPIEVECRGHVQRLRCGHTIEVGCSR

SEQ ID NO: 31266 - protein, 256 aa, Mycobacterium tuberculosis H37Rv
MIGDGANGGPGQPGGPGGLLYGNGGHGGAGAAGQDRGAGNSAGLIGNGGAGGAGGNGGIGGAGAPGGLGGDGGKGGFADEFTGGFAQGGRGGFGGNGNTGASGGMGGAGGAGGAGGAGGLLIGDGGAGGAGGIGGAGGVGGGGGAGGTGGGGVASAFGGGNAFGGRGGDGGDGGDGGTGGAGGARGAGGAGGAGGWLSGHSGAHGAMGSGGEGGAGGGGGARGEAGAGGGTSTGTNPGKAGAPGTQGDSGDPGPPG

SEQ ID NO: 31267 - protein, 489 aa, Mycobacterium tuberculosis H37Rv
MSAASQRVGAFGEEAGYHKGLKPRQLQMIGIGGAIGTGLFLGAGGRLAKAGPGLFLVYGVCGVFVFLILRALGELVLHRPSSGSFVSYAREFFGEKAAYAVGWMYFLHWAMTSIVDTTAIATYLQRWTIFTVVPQWILALIALTVVLSMNLISVEWFGELEFWAALIKVLALMAFLVVGTVFLAGRYPVDGHSTGLSLWNNHGGLFPTSWLPLLIVTSGVVFAYSAVELVGTAAGETAEPEKIMPRAINSVVARIAIFYVGSVALLALLLPYTAYKAGESPFVTFFSKIGFHGAGDLMNIVVLTAALSSLNAGLYSTGRVMHSIAMSGSAPRFTARMSKSGVPYGGIVLTAVITLFGVALNAFKPGEAFEIVLNMSALGIIAGWATIVLCQLRLHKLANAGIMQRPRFRMPFSPYSGYLTLLFLLVVLVTMASDKPIGTWTVATLIIVIPALTAGWYLVRKRVMAVARERLGHTGPFPAVANPPVRSRD

SEQ ID NO: 31268 - protein, 310 aa, Mycobacterium tuberculosis H37Rv
MSIAEDITQLIGRTPLVRLRRVTDGAVADIVAKLEFFNPANSVKDRIGVAMLQAAEQAGLIKPDTIILEPTSGNTGIALAMVCAARGYRCVLTMPETMSLERRMLLRAYGAELILTPGADGMSGAIAKAEELAKTDQRYFVPQQFENPANPAIHRVTTAEEVWRDTDGKVDIVVAGVGTGGTITGVAQVIKERKPSARFVAVEPAASPVLSGGQKGPHPIQGIGAGFVPPVLDQDLVDEIITVGNEDALNVARRLAREEGLLVGISSGAATVAALQVARRPENAGKLIVVVLPDFGERYLSTPLFADVAD

SEQ ID NO: 31269 - protein, 351 aa, Mycobacterium tuberculosis H37Rv
MTYAIVVADATKRYGDFVALDHVDFVVPTGSLTALLGPSGSGKSTLLRTIAGLDQPDTGTITINGRDVTRVPPQRRGIGFVFQHYAAFKHLTVRDNVAFGLKIRKRPKAEIKAKVDNLLQVVGLSGFQSRYPNQLSGGQRQRMALARALAVDPEVLLLDEPFGALDAKVREELRAWLRRLHDEVHVTTVLVTHDQAEALDVADRIAVLHKGRIEQVGSPTDVYDAPANAFVMSFLGAVSTLNGSLVRPHDIRVGRTPNMAVAAADGTAGSTGVLRAVVDRVVVLGFEVRVELTSAATGGAFTAQITRGDAEALALREGDTVYVRATRVPPIAGGVSGVDDAGVERVKVTST

SEQ ID NO: 31270 - protein, 1660 aa, Mycobacterium tuberculosis H37Rv
MSYVIATPEMMATAAFDLARIGSQVSAASAVAAMPTTEVVAAGADEVSAGIAALFSAHAQEYQALSAQAAAFHDQFVHTLTAAARWYTATEIANAAAMRVVLGAVNAPTQTLLGRPLIGDGAHGTAPGQPGGAGGLLFGNGGNGAAGAVGQVGGAGGAAGLFGIGGAGGAGGAGAPGGTGGTGGWLAGGGGVGGMGGAGGGAGGAGGNAGLFGNGGAGGAGGAGGGAGGAGGNAGWFGHGGAGGVGGVGAAGANGATPGQDGAAGVAGSDDGAGGDGLAGSDGGDGGAGGVGGNGGRGGWLLGNGGAGGVGGVGGAGGAGAAGGAGGAGATGINGPAGISAAGGDGGAGGNGGAGGNGGVGGAGGAGGSAGLLGYVGRAGDGGAGGGGGLGGAPGDGGAGGNGGSWLAAGDGGAGGHGGDPGLGGAGGAGGASGGAGARAGANGLAAGNDGPVSGGNGGKGGNGAHAPVAGGHGGNGGAGGNGGLVGDGGAGGHGGDGAAGAGYADMTAIFLGSSGTPGEDGGNGGAGGAGGAGGAHAGDGGAGGAGGNGGAGGAGGNGAHGFNAVLVSDGGNGGDGGAGGRGGDGGAGGAGGDAPAGRAGSQGVGGDGGAGGAGGAPGNGGSGGRGDMAFKDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDALALGQPGGNGGQGDAGQAGGAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGIGITVGGAGGAGGNGGDPGAGGRGGLGGDSGNGTSAANGVDASKHGPLTGGDGGVGGNGAKAAAAGGDGGQGGDGGNAGLFGDGGAGGDGADGTAAEALGGDGGAGGAGGKGGDAGDIGDGGDGGKGGDGAHGALGGLTVAGGNGGAGGAGGAGGAGGAFLGDGGNGGAGGQGGAGRGGSPGGGGGVGGHGGAGGDAGMNGGGGTGGQGGNGAAGGAGWSPDSDLKGFDGFDGGSGGAGGDGGAGGAGGTQTGDGGDGGAGGLGGAGGVGGNGVDGFDINETTGRDGGDGGDGGYGGWGGAGGNGGAGGSAPAGEVGNRGVGGDGGDGGSGGDAGNGGLGGDGFTYLADFDGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNVT

SEQ ID NO: 31271 - protein, 459 aa, Mycobacterium tuberculosis H37Rv
METYDIAIIGTGSGNSILDERYASKRAAICEQGTFGGTCLNVGCIPTKMFVYAAEVAKTIRGASRYGIDAHIDRVRWDDVVSRVFGRIDPIALSGEDYRRCAPNIDVYRTHTRFGPVQADGRYLLRTDAGEEFTAEQVVIAAGSRPVIPPAILASGVDYHTSDTVMRIAELPEHIVIVGSGFIAAEFAHVFSALGVRVTLVIRGSCLLRHCDDTICERFTRIASTKWELRTHRNVVDGQQRGSGVALRLDDGCTINADLLLVATGRVSNADLLDAEQAGVDVEDGRVIVDEYQRTSARGVFALGDVSSPYLLKHVANHEARVVQHNLLCDWEDTQSMIVTDHRYVPAAVFTDPQIAAVGLTENQAVAKGLDISVKIQDYGDVAYGWAMEDTSGIVKLITERGSGRLLGAHIMGYQASSLIQPLIQAMSFGLTAAEMARGQYWIHPALPEVVENALLGLR

SEQ ID NO: 31272 - protein, 484 aa, Mycobacterium tuberculosis H37Rv
AQASPAAHGGSGGAGGNGGAGSAGNGGAGGAGGNGGAGGNGGGGDAGNAGSGGNGGKGGDGVGPGSTGGAGGKGGAGANGGSSNGNARGGNAGNGGHGGAGGSGDTGGAGGAGGQGGFGGTGGSGSGIGGGAGGNGGNGGAGGTGVVLGGKGGDGGNGDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGGGGGAGGAGGSGFFGGKGGFGGDGGQGGPNGGGTVGTVAGGGGNGGVGGRGGDGVFAGAGGQGGLGGQGGNGGGSTGGNGGLGGAGGGGGNAPDGGFGGNGGKGGQGGIGGGTQSATGLGGDGGDGGDGGNGGNSGAKAGGAGGKGQAGQPNSGTEPGFGGDGGLGGAGATP

SEQ ID NO: 31273 - protein, 1538 aa, Mycobacterium tuberculosis H37Rv
MVMSLMVAPELVAAAAADLTGIGQAISAANAAAAGPTTQVLAAAGDEVSAAIAALFGTHAQEYQALSARVATFHEQFVRSLTAAGSAYATAEAANASPLQALEQQVLGAINAPTQLWLGRPLIGDGVHGAPGTGQPGGAGGLLWGNGGNGGSGAAGQVGGPGGAAGLFGNGGSGGSGGAGAAGGVGGSGGWLNGNGGAGGAGGTGANGGAGGNAWLFGAGGSGGAGTNGGVGGSGGFVYGNGGAGGIGGIGGIGGNGGDAGLFGNGGAGGAGAAGLPGAAGLNGGDGSDGGNGGTGGNGGRGGLLVGNGGAGGAGGVGGDGGKGGAGDPSFAVNNGAGGNGGHGGNPGVGGAGGAGGLLAGAHGAAGATPTSGGNGGDGGIGATANSPLQAGGAGGNGGHGGLVGNGGTGGAGGAGHAGSTGATGTALQPTGGNGTNGGAGGHGGNGGNGGAQHGDGGVGGKGGAGGSGGAGGNGFDAATLGSPGADGGMGGNGGKGGDGGKAGDGGAGAAGDVTLAVNQGAGGDGGNGGEVGVGGKGGAGGVSANPALNGSAGANGTAPTSGGNGGNGGAGATPTVAGENGGAGGNGGHGGSVGNGGAGGAGGNGVAGTGLALNGGNGGNGGIGGNGGSAAGTGGDGGKGGNGGAGANGQDFSASANGANGGQGGNGGNGGIGGKGGDAFATFAKAGNGGAGGNGGNVGVAGQGGAGGKGAIPAMKGATGADGTAPTSGGDGGNGGNGASPTVAGGNGGDGGKGGSGGNVGNGGNGGAGGNGAAGQAGTPGPTSGDSGTSGTDGGAGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNSGAMLPGGGTVGNPGTGGNGGNGGNAGVGGTGGKAGTGSLTGLDGTDGITPNGGNGGNGGNGGKGGTAGNGSGAAGGNGGNGGSGLNGGDAGNGGNGGGALNQAGFFGTGGKGGNGGNGGAGMINGGLGGFGGAGGGGAVDVAATTGGAGGNGGAGGFASTGLGGPGGAGGPGGAGDFASGVGGVGGAGGDGGAGGVGGFGGQGGIGGEGRTGGNGGSGGDGGGGISLGGNGGLGGNGGVSETGFGGAGGNGGYGGPGGPEGNGGLGGNGGAGGNGGVSTTGGDGGAGGKGGNGGDGGNVGLGGDAGSGGAGGNGGIGTDAGGAGGAGGAGGNGGSSKSTTTGNAGSGGAGGNGGTGLNGAGGAGGAGGNAGVAGVSFGNAVGGDGGNGGNGGHGGDGTTGGAGGKGGNGSSGAASGSGVVNVTAGHGGNGGNGGNGGNGSAGAGGQGGAGGSAGNGGHGGGATGGDGGNGGNGGNSGNSTGVAGLAGGAAGAGGNGGGTSSAAGHGGSGGSGGSGTTGGAGAAGGNGGAGAGGGSLSTGQSGGPRRQRWCRWQRRRWLGRQRRRRWCRWQRRCRRQRWRWRCRQRRLRRQWRQGRRRCRPWLHRRRGRQGRRWRQRRFQQRQRSRWQRR

SEQ ID NO: 31274 - protein, 1381 aa, Mycobacterium tuberculosis H37Rv
MSFVLVSPETVAAVATDLKRIGASLAHENASAAASTTAVVSAAADEVSTAVAALFSQHAQGYQAAAAQVAAFHSRFVQALTAGAGAYAFAEAANASPLQSAMGAVSASAQTLLSRPLIGNGANATTPGGNGGDGGWLFGSGGNGAPGAAGQSGGNGGSAGLWGNGGAGGAGGSGGAAGGNGGNGGWLFGAGGTGGIGGTGAPGAMGGTGGNGGNGALLIGGGGLGGAGGMGGTGGGTGGTGGNGGNGALLIGAGGVGGAGGIGGQGTGAGGAAGAGGTGGNGGAGGLFMNGGDGGAGGQGGDGAAGDAAASAGGTGGKGGQGGDGGTGGAGGAGPVLFGHGGAGGMGGQGGTGGMGGAGGDGTTVIAAGTGGEGGTGGAAGAGGAAGARGALTSGGLAGGVGAGGTGGTGGTGGNGADAAAVVGFGANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTVGAQFVPATSLPTPNGGAGGNGGTGSNGGAPGPAGAPGPTTGGNAGSQGIGGDGGNGGDGGKGGDGADAVNVVFMPTEPQAATGTAGSAGDPTGGNGGPGTPGSPMVAPPPPTPITQVQQGGDGGAGGTGSTNANDGTATGGKGGEGGVGSILGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGDGGNGVIAGGGGTGGNGGASGAGGAGGTGGFAGNGNAGGNGGTGGASEDGDNGNAGSGATGGTGGNGGTGGDGGAAGLGGVA

SEQ ID NO: 31275 - protein, 1901 aa, Mycobacterium tuberculosis H37Rv
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSAGGAAGAVGVGGTGGQGGAGGAGAAGADAPASTGLTGGTGFAGGAGGVGGQGGNAIAGGINGSGGAGGTGGQGGAGGMGGSGADNASGIGADGGAGGTGGNAGAGGAGGAAGTGGTGGVVGAAGKAGIGGTGGQGGAGGAGSAGTDATATGATGGTGFSGGAGGAGGAGGNTGVGGTNGSGGQGGTGGAGGAGGAGGVGADNPTGIGGTGGTGGKGGAGGAGGQGGSSGAGGTNGSGGAGGTGGQGGAGGAGGAGADNPTGIGGAGGTGGTGGAAGAGGAGGAIGTGGTGGAVGSVGNAGIGGTGGTGGVGGAGGAGAAAAAGSSATGGAGFAGGAGGEGGAGGNSGVGGTNGSGGAGGAGGKGGTGGAGGSGADNPTGAGFAGGAGGTGGAAGAGGAGGATGTGGTGGVVGATGSAGIGGAGGRGGDGGDGASGLGLGLSGFDGGQGGQGGAGGSAGAGGINGAGGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGRGGDGGDGASGLGLGLSGFDGGQGGQGGAGGSAGAGGINGAGGAGGNGGDGGDGATGAAGLGDNGGVGGDGGAGGAAGNGGNAGVGLTAKAGDGGAAGNGGNGGAGGAGGAGDNNFNGGQGGAGGQGGQGGLGGASTTSINANGGAGGNGGTGGKGGAGGAGTLGVGGSGGTGGDGGDAGSGGGGGFGGAAGKAGGGGNGGVGGDGGEGASGLGLGLSGFDGGQGGQGGAGGSAGAGGINGAGGAGGTGGAGGDGAPATLIGGPDGGDGGQGGIGGDGGNAGFGAGVPGDGGDGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGDGDGFIGGSGGTGGTGGDAGVGGLANTGGTAGNAGIGGAGGRGGDGGAGDSGALSQDGNGFAGGQGGQGGVGGNAGAGGINGAGGTGGTGGAGGDGQNGTTGVASEGGAGGQGGDGGQGGIGGAGGNAGFGAGVPGDGGIGGTGGAGGAGGAGADGDPSIDGGQGGAGGHGGQGGKGGLNSTGLASAASGDGGNGGAGGAGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDGS

SEQ ID NO: 31276 - protein, 1079 aa, Mycobacterium tuberculosis H37Rv
PQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGAAGGNGGTGGAGGSGIDGVGGGTGGTGGNGGNGAIGGAGGDAGGSGNSGGNGGIGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGDGGSGGAGGTGGAGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGNGGTGGEGGEVGGAGGTGGAAGNGGDGGTGGTGGGDGGAGGTGGTGGTGGLGDPRVGGSGGDGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGGV

SEQ ID NO: 31277 - protein, 1489 aa, Mycobacterium tuberculosis H37Rv
MSFVLIAPEFVTAAAGDLTNLGSSISAANASAASATTQVLAAGADEVSARIAALFGGFGLEYQAISAQVAAYHQRFVQALSTGAGAYASAEAAAAEQIVLGVINAPTQALLGRPLIGDGANATTPGGAGGAGGLLFGNGGAGAAGAPGQAGGPGGPAGLWGNGGPGGAGGSGGGTGGAGGAGGWLFGVGGAGGVGGAGGGTGGAGGPGGLIWGGGGAGGVGGAGGGTGGAGGRAELLFGAGGAGGAGTDGGPGATGGTGGHGGVGGDGGWLAPGGAGGAGGQGGAGGAGSDGGALGGTGGTGGTGGAGGAGGRGALLLGAGGQGGLGGAGGQGGTGGAGGDGVLGGVGGTGGKGGVGGVAGLGGAGGAAGQLFSASGAAGNAGVGGAGGQGGDGGAGGAGADADQPGATGGTGFAGGAGGAGGAGGSSGAGGTNGSGGAGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGAGGSSGAGGTNGSGGAGGTGGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGKAGGSSSAGGTNSSGSAGGTGRQSGTGGAGGAGADNPTGIGGTGGDGGTGGAAGAGGAGGAAGTGGTGGMIGTTGNAGVGGAGGSSGAGGTNGSGGAGGTDGQGGAGGAGGAGADNPTGIGGTGGDGGTGGAAGAGGAGGAAGTGGTGGMIGTTGNAGVGGAGGQGGDGGAGGAGADADQPGATGGTGFAGGAGGAGGSGGSSCAGGTNGSGGAGGTCGQVVAGGAGISFSNGSNGGTGGTGGVGGTGGDGGNAGTGAGDPGKGGTGGTGGTGGSGGAGGSGGANFNGGTGGTGGTGGKGGLNTDGLSSATSGTGGTGGTGGKGGTGGAGDDSAGGTGGTGGAGGNAGAGGLANTGGTAGNAGIGGDGGQGGNGGQGDSGSGLGGQPGFAGGAGGKGGAGGSSGAGGTNGSGGAGGAGGQGGAGGAGISFSNGSNGGTGGTGGVGGTGGDGGNAGTGAGDPGKGGTGGTGGTGGSGGAGGSGGANFNGGTGGTGGTGGTGGKGGMGGIAGDGGPGGDGGNAGVGGKGGTNGNGGSGGTGGTGGAGGNAGAGGLANTGGTAGNAGIGGDGGQGGNGGQGDSGSGLGGQPGFAGGPGGKGGAGGNAGTGGTNGSGAGGAGGQGGAGGAGISFSNGSNGGTGGTGGVGGTGGDGGNAGTGAGDPGKGGTGGTGGTGGSGGAGGSGGANFNGGTGGTGGTGGTGGKGGMGGIAGDGGPGGDGGNAGVGGKGGTNGNGGSGGTGGTGGPGGSGGAPTGSGTGGKGGAGGDGGDGADGGAATGVGDGGDGGNGGNGGNGGTGVGSPGGLGGAGGTGGLGGAGAGGGADGDDGDDGQPGNNGS

SEQ ID NO: 31278 - protein, 439 aa, Mycobacterium tuberculosis H37Rv
MSFVIAVPEFLSAAATDLANLGSTISAANAAASIPTTGVLAAGADDVSAAIAALFGAHAQAYQTISAQAATFHAQFVQTLSAGAGAYANAEAANVQQSLLNAINAPTQALLGRPLIGDGADGTAPGQNGGAGGLLYGNGGNGAAGVNAGIAGGSGGAAGLIGNGGSGGAGGAGAAGGSGGQGGLLYGNGGAGGNGGAATIPGGNGGAGGAGGNAWLFGNGGAGGLGAAGAAGAAGVNPLTVPAGQGSMGNNGEPGGPGQPGTEFGQTGGTGGTGGTGLSVGGTGGTGGTGGTGGAGGSGGRGGLLVGDGGAGGIGGTGGEGGIGARGGTGGQGGMGGAGQPGVGGDAGDGGNGGIGGDGGAGGDGGAGGAGGAGGLFGVSGSSGLGGAAGSGGNGGGGGEPGVAGSPGVGPAGRGGDGNLGQFGPEGAPGQPGQPGQPG

SEQ ID NO: 31279 - protein, 293 aa, Populus alba x Populus tremula
MDPDSRDPPIEYREGYALSGKIMLSAILILFFVIIVMVLLHLYARWYLTRARQRQVRRVRNRRTHLVFYVDSPQNPNNVTSHVTRGLEETVKNSLPVFVYPRKTHQDSIECAVCLSEFEENERGRVLPKCNHSFHTECIDMWFHSHSTCPLCRSPVEPVAENPVPEGSNFGISEAGSGLCTSCQHEEDHLGSASTSSFNGGRKPVGLIGVTIDVPRRNGNFEDESNTESPSASHSFRSPMSRMLSFKRMLSRERRGTVSPTVANSVSCGGGSGTTEFDIEQGRDESMPQQTRC

SEQ ID NO: 31280 - protein, 365 aa, Pseudomonas stutzeri
MSEADQLKALRVRIDSLDERILDLISERARCAQEVARVKTASWPKAEEAVFYRPEREAWVLKHIMELNKGPLDNEEMARLFREIMSSCLALEQPLRVAYLGPEGTFSQAAALKHFGHSVISKPMAAIDEVFREVVAGAVNFGVVPVENSTEGAVNHTLDSFLEHDIVICGEVELRIHHHLLVGETTKTDRITRIYSHAQSLAQCRKWLDAHYPNVERVAVSSNADAAKRVKSEWNSAAIAGDMAAQLYGLSKLAEKIEDRPVNSTRFLIIGSQEVPPTGDDKTSIIVSMRNKPGALHELLMPFHSNGIDLTRIETRPSRSGKWTYVFFIDCMGHHQDPLIKNVLEKIGHEAVALKVLGSYPKAVL

SEQ ID NO: 31281 - protein, 499 aa, Nicotiana tabacum
MQFFNFFSLFLFVSFLFLFKKWKNSNSQTKRLPPGPWKLPILGSMLHMLGGLPHHVLRDLAKKYGPIMHLQLGEVSLVVISSPGMAKEVLKTHDLAFANRPLLVAAKIFSYNCMDIALSPYGNYWRQMRKICLLELLSAKNVKSFNSIRQDEVHRMIKFFRSSPGKPVNVTKRISLFTNSMTCRSAFGQEYKEQDEFVQLVKKVSNLIEGFDVADIFPSLKFLHVLTGMKAKVMNTHNELDAILENIINEHKKTSKSDGESGGEGIIGVLLRLMKEGGLQFPITNDNIKAIISDIFGGGTETSSTTINWAMVEMMKNPSVFSKAQAEVREILRGKETFGEIDVEEFKYLKMVIKETFRLHPPLPLLLPRECREEIDLNGYTIPLKTKVVVNAWAMGRDPKYWDDVESFKPERFEHNSMDYIGNNYEYLPFGSGRRICPGISFGLANVYFPLAQLLNHFDWKLPTGINPRNCDLTEAAGAACARKNDLHLIATAYQHCEE

SEQ ID NO: 31282 - protein, 253 aa, Pinus taeda
MRSMELVKSIALASLLTFIWLLTGAHGYGGWESAHATFYGGSDASGTMGGACGYGNLYSQGYGTNTAALSTALFNDGLSCGACYEMRCNDDPQWCLPGTVTVTATNFCPPNNALPNDNGGWCNPPLQHFDMAEPAFLKIAKYRGGIVPILYTRVPCLRKGGIRFTVNGHSYFNLVLITNVGGAGDVHAVSIKGSRSGWQPMSRNWGQNWQSNSYLNGQSLSFQVTTSDGRTVVSNNVAPSNWQFGQTFEGSQV

SEQ ID NO: 31283 - protein, 415 aa, Candida boidinii
MSLSSKLSVKDLDCTGKRVFIRVDFNVPLDGDKITNNQRIVAALPTIKYVLEQKPKAIILASHLGRPNGEVNPKFSLKPVAAELESLLGEKVEFLKDCVGPEVESAVNSAAPGSVILLENLRFHIEEEGSAKKDGVKVKADKADVEKFRKQLTSLADVYVNDAFGTAHRAHSSMVGFELPQRAAGFLMAKELEYFAKALENPVRPFLAILGGAKVSDKIQLIDNLLDKVDILIIGGGMAFTFNKIAQNMEIGKSLFDEAGAATVPDLLAKAKKNNVKIVLPVDFVTADKFDAAANTGYATVEQGIPAEWQGLDCGEKSIKLFTETIGEAKTIVWNGPPGVFEFEKFAKGTHAMLDACVKSCAAGNTVIIGGGDTATVAKKFGGADKLSHVSTGGGASLELLEGKELPGVVFLSNK

SEQ ID NO: 31284 - protein, 159 aa, Corynebacterium glutamicum
MTSIHDISVTLNDGTETTMADWAGHLLLIVNVASKCGLTPQYEGLQKLYEEYQDRGFFVIGVPCNQFNGQEPGTDAEVCAFAQNQYDVTFPLLSKTEVNGEGTHPLYKVLKEATDGSEIEWNFEKFLVDAEGNTIKRFAPRTEPSAAEVVEAIEENLPI

SEQ ID NO: 31285 - protein, 473 aa, Corynebacterium glutamicum
MPTKYDLAIIGSGGGAFAAAIRASTLGKSVVMIERGTLGGTCVNTGCVPSKALIAAAGARHVAVDAATRFPGIATTADPVDMPALIAGKQALVESLRGEKYADVADSYGWQVLRGDASFVGTPDAPVLDVAGADRSVETIEAHHYLVATGSRPWAPPIDGLEETGYLTSTTAMELTEVPESLLVLGGGYVALEQAQLFARLGSQVTLLVRSRLASKEEPEVSKALQEVFADEGIRVVSRAVPTRVSRGTGGEAVVTAAVSGGSQEFRADQVLVALGRRPVTDGLNLDAVGVKTGDSGEVVVSDRLQSSNPRIWAAGDVTGHPEFVYVAAHHGTLVAENAFADADRSVDYARLPRVTFTGPAIGAVGMTEKDVLAAGIRCDCRVLPLHHVPRALVNRDTRGFIKIVVNAETNEILGLTAVAKDAGELAAAGVHVLGRTVAEVADAWAPYLTMAEGIRIAAKAFTTDPSLLSCCA

SEQ ID NO: 31286 - protein, 469 aa, Corynebacterium glutamicum
MTEHYDVVVLGAGPGGYVSAIRAAQLGKKVAVIEKQYWGGICLNVGCIPSKSLIKNAEVAHTFTHEKKTFGINGEVTFNYEDAHKRSRGVSDKIVGGVHYLMKKNKITEIHGLGNFKDAKTIEVTDGKDAGKTVTFDDCIIATGSVVNTLRGVEFSKNVVSFEEQILDPVAPKKMVIVGAGAIGMEFAYVLGNYGVDVTVIEFMDRVLPNEDAEVSKVIAKAYKKMGVKLLPGHATTAVRDNGDSVEVDYQKKGSDKTETLTVDRVMVSVGFRPRVEGFGLENTGVKLTERGAIDIDDYMRTNVPGIYAIGDVTAKLQLAHVAEAQGIVAAETIAGAETQALGDYMMMPRATFCNPQVASFGYTEEQAKQKWPDREIKVASFPFSANGKAVGLAETDGFAKIVADAEFGELLGGHLVGANASELINELVLAQNWDLTTEEISRSVHIHPTLSEAVKEAAHGISGHMINF

SEQ ID NO: 31287 - protein, 374 aa, Corynebacterium glutamicum
MKIDAYVVEEINAPLVRETLTIDDPGPGEVLVKVVATGVCHTDLNTQSGDMPLPLPGVLGHEGSGVVEAVGAGVTEVEPGDHVIMGWPYCGTCRNCVRGEHRYCLNIGAELLAGVRLHGPDAGSSAYTRADGTALSGHFFGQSSFATYSLTRANAVVKVDKDIDLALLGPLACGITTGAGAVFNTAQPGPGESIVIIGAGAVGLAAVMAARNTPAATIIAMDLQDSRLELARELGATHTVNTREKDIVEAVTEICGGPADYVLDCTGSIKVIEQAADAVGLMGTFILVGGAPAEARFSLDHMRTLFGKTVVGTLGGSSNSRTLIPGLINLYRQGRFPFDKLITTYGFDELDQAIHDAHEGGTIKAVLRVDKTNQ

SEQ ID NO: 31288 - protein, 493 aa, Corynebacterium glutamicum
MTVTTPTTYSAIVADQLYIGGWREGTSERIATTTNPFNDETIATIRQASPDDVDAAYEIAKESQAVWAALAPKERVHILTKAADWIEENQEAVIELIRVESGSTAIKATIETSLAVGSLREAATFPTRITGQILPSNTPGKANYVFREALGVVGVISPWNFPFALSMRSVAPALACGNAVVVKPASDTPLTGGLLLGKIFEAAGLPEGVLNIVVGSGSEIGDHFVEHPIPRLISFTGSTPVGKQVGATATGGKHIKKVALELGGNAPLVVLEDADLDQAVGAAAMGKFLHQGQICMAVNRIIVQAPLYDEFVEAFAKRVQTLAYGDQCDDATVVGPVINDSQLHSVTKKIERARIEGAREVVSGPIEGRVIAPHVFADVTPAMELFREEIFGPVVGIIKAKDEAHALELANDTEFGLSSAVYTRDLARGLNFARQVEAGMTHVNDITVNDEAHVMFGGEKNSGLGRFNGEWAIEEFTTTHWVGVAPGQAQFPF

SEQ ID NO: 31289 - protein, 334 aa, Thermococcus kodakaraensis
MKFGILYTPIFLEHRPDGYHPENPARLKRAVEGLKKAGLWKNVIEPEAVQEKELLKVHDEEYVELVKELGRSFNYLDPDTYVSPGTFNAALHAFGAVKKAVELAFEDKGLYLALVRPPGHHAGRKGRAFNAPTLGFCIFNNAAYASKLLEGLTGKALVIDFDAHHGNGTQEILWNDPNAVHIDLHERDIYPVSGYEYEVGGKGAEGTKVNIPMPHYSGDDDYIYAWNEVVLPIVAQFKPKVIVISAGFDGFHGDGLTTLRLSEAFYAYAGTTLSKYPLVVVLEGGYSVGLEKGLPVFMAGYLSGERFEVSVRPSFETLSIMERVKEILGEWWEF

SEQ ID NO: 31290 - protein, 288 aa, Thermococcus kodakaraensis
MGYNEQERAFIEWYPRGYGVGFKVKRRLFETQTEYQRLEIYETEGFGKLLVLDGTVQLVEVGEESYHEVLVHPVMLAHPNPRKVLVIGGGDGGTLREVLRHDTVEKAIMVEIDEGVVEASYLYLDVAKDLLDRLIKKEEPRAELIIGDGVKYLRETDERFDVIIVDSTDPVGPAKLLFSEEFYRDAYEKLNEKGLYVTQAGSVYLFTNELLDAYKAMKKVFDRVYYFSFPVIGYASPWSFLVGVKGDVDFTRIDLERAKKLDLYYYDPERHETLFQMPRYVRKLLEGQ

SEQ ID NO: 31291 - protein, 457 aa, Thermococcus kodakaraensis
MGWFEEYFEFEKYGTDMKTEILAGVTTFLTMAYILFVNPSILSDAMGKEAFNSLVAVTALAAGFTTIFMGIYAKKPFALAPGMGLNAYFAYTVAPKYGWKVALAAVFVEGLIFIVLSVTKVRSAIIHAIPTGQKYAIGAGIGLFLTLIGLNDVGLLTAKVTAPAGSEFVINGEVNLIGKLAFTGLNAQALTTKAGLLFVFGLLLTGILIALRIKGALLISILTTSFLGWITGAAPWPESLFSMPDISYTFMKMDLHGLLNAGALGVVFAFFMVDFFDTLGTVTGLSAKAGFLTEDGKVPDAEKVLLTDAIGTTFGAVLGTSTVTTYIESAAGIEEGGRTGMTALVTGFLFLAIGLFIAPLAGAIPAFATAPALVIVGYYMLTALKEVDFSDPTEALPAFLVLVTIPYTYSIADGIGVGFISYTILKVFSGRWKEVHPLMYVLTIVFVAYFAYLGGVF

SEQ ID NO: 31292 - protein, 334 aa, Thermococcus kodakaraensis
MVRVRLVGIRKSFEGFTLEIPELEVESGEMMTLLGPSGCGKTTTLRIIAGLEKPDSGRVFFDETDVTNLEPGKRNIGIVFQDYALFPHMTVFENVAFGLEMRKLPRDEIKKKVEWALELVGLKGFENRYPEQLSGGQQQRVALARALVIEPQVLLLDEPLSNLDAKIRERLRGEIRRIQKELGITTIYVTHDQEEAMAVSDRIAVMNSGRIEGIGKPLELYYHPKTEFVAKFLGLSNILELEAENGIARLGTLEFKTGRDGKVRVFFRPENVLVKPGKGARVIDYDLLPGRIRLRLGIGGETITAERFLNELPFSPEDIPKEVSVEVLSYSVLE

SEQ ID NO: 31293 - protein, 226 aa, Thermococcus kodakaraensis
MKVKKHRFPGVYIVIDDDGSEKIATKNLVPGQRVYGERVVKFEGEEYRIWNPTRSKLGAAILNGLKNFPIKPGSTVLYLGVASGTTASHVSDIVGWEGKVFGVEFSPRVLRELVPLVEERRNIVPILGDATKPEGYRALVPKVDVIFEDVAQPTQAKILIDNAKVYLKSGGYGMISVKSRSIDVTKEPEQVFKEVEKELSTYFEVVERLSLEPYEKDHALFVVRKP

SEQ ID NO: 31294 - protein, 420 aa, Thermococcus kodakaraensis
MKAYIAENVRGIYAFDESGKLIGSKPFSGKPEVSLDKLLKGEPSDELIEFLDELGSEGYTEFVVEDSELSRNLKELGYNATAEFPNIAGEKLRSSPEEFLGENWFDEYFSVGVALTRLRIQEQSGARDKMIIQAIEALDDIDKVINLLVSRLREWYGLHFPELDELLPKHPQYVAFVKEIGPRENATREKLEKLGFSEGKIEKILEAAEKSMGAPLGKFDSAIIQKLASEIHDLYKLREQIEDYLETAMDEVAPNLKALVGAKLAARLMSLAGGLKELAMMPASTIQVLGAEKALFRHLRTGAKPPKHGVIFQYPAINRSPWWQRGKIARALAGKLAIAARVDYFSGEYIGEELKKELEQRIQEIKEKYPNPPKRKAKPEKKKKEKKKFKGKGKGKHEKGKGFGGKKDKKKKKKGKGGKR

SEQ ID NO: 31295 - protein, 486 aa, Thermococcus kodakaraensis
MGKFEQKLVNALKGYTFDDVLLIPQATEVEPKDVDVSTQITPNVRLNIPILSAAMDTVTEWEMAVAMAREGGLGVIHRNMSIEEQVEQVKRVKRAERFIVEDVISIKPDESLDYALFLMERNGVDGLPVVDDEGRVVGVITKKDIAAKQGSKVSEVMTGEVITVPETVTAEEAVQIMFDHRIDRLPVVDGEGRLVGIITMSDLAKRRKYRNAVRDENGDLLVAAAVGPFDLERAKALDNAGADVIVVDTAHAHNLKAIKAMKEIRNAVDADLIVGNIANPKAVDDLTFADAVKVGIGPGSICTTRVVAGVGVPQITAIALVADKAQEYGLHVIADGGIRYSGDIVKAIAAGADAVMLGSLLAGTKEAPGKEVVMNGRRYKQYRGMGSLGAMMKGGAERYYQKGHMKTKKFVPEGVEGVVPYKGPVGEVLYQLIGGLRAGMGYVGARNIPELKEKGEFVIITHAGYIESHPHDILITNEAPNYPLGK

SEQ ID NO: 31296 - protein, 273 aa, Thermococcus kodakaraensis
MLFGIPESKNPNLLLLGIRWDGSSSYRKGARDGPKAIREATSSELYNSYTENLVNLAERWRYRDLGDVEGKSFAEVLERVRKLVGENYSGERFLFLGGDHSITYATFRALREASGKEFGLIYFDAHPDLYPHYEGDPYSHACPVRRLVEEGWVRGENVVQVGIRAPTPEQLDFAEREGILIYSASEVWKGAEVEVPFERAYLSFDLDVLDPAFAPGVGNPEPGGLSTRELIELIKSIDAEVVAFDVVELNPRYDVSNVTAFAAAKIIREVLGR

SEQ ID NO: 31297 - protein, 209 aa, Thermococcus kodakaraensis
MSIEELVEKVDWEKNGGVVPVVVQDTEGEVLTLAYMDREALRRTLETGYAHYYSRSQGRVRMKGEVSGNLQVVREIRVDCDSDALLLKVEPKGPACHTGNYSCFYRKLGEPERVLPMDYSLTILRELEELIRKRKESPVEGSYTSRLFREGRERIYKKFGEEAVEVLVAENREALIYETADMLYHLLVLLAYNDVSLGEVMAELRRRRK

SEQ ID NO: 31298 - protein, 251 aa, Thermococcus kodakaraensis
MFEKGSLIPYLTAGDPSVEKTLEFLLAVEEFAGLIELGIPFSDPMADGKTIQESHYRALRNGFKLDDTFRILREFRRHSSTPVILMTYYNPVFRTGVKKFLGEAKASGADGILVVDLPVSHAGEFLDAAKEEGLKTVFLAAPNTPDERLREIDKASTGFVYLISLYGTTGARDRLPETAFEFVRRARKICNNKLAVGFGVSRREQVEELLKAGADGVVVGSALIELISRSENPVEELRRKVAELSGYSRAL

SEQ ID NO: 31299 - protein, 362 aa, Thermococcus kodakaraensis
MPLYRKRLRLVRGEGVYVWDEKGRRYLDLIAGIGVNVLGHAHPEWVLDMSRQLEKIVVAGPMFEHDEREEMLEELSHWVDYEYVYMGNSGTEAVEAAIKFARLATGRSEIVAMTNAFHGRTLGSLSATWKKKYREGFGPLVPGFKHIPFNNVEAAKEAITKETAAVIFEPIQGEGGIVPADEEFVKTLRDLTEDVGALLIADEVQSGLRTGKFLAIEHYGVRPDIVTMGKGIGNGFPVSLTLTDLEIPRGKHGSTFGGNPLACRAVATTLRILRRDRLVEKAGEKFMEFSGERVVKTRGRGLMIGIVLRRPAGNYVKALQERGILVNTAGNRVIRLLPPLIIEGDTLEEARKEIEGVLNDIL

SEQ ID NO: 31300 - protein, 439 aa, Thermococcus kodakaraensis
MKIVVVGSGTAGSNFALFMRKLDRKAEITVIGKEPTMQYSPCALPHVVSGTIEKPEDIIVFPNEFYEKQKINLMLNTEAKAIDRERKVVVTDKGEVPYDKLVLAVGSKAFIPPIKGVENEGVFTLKSLDDVRRIKAYIAERKPKKAVVIGAGLIGLEGAEAFAKLGMEVLIVELMDRLMPTMLDKDTAKLVQAEMEKYGVSFRFGVGVSEIIGSPVRAVKIGDEEVPADLVLVATGVRANTDLAKQAGLEVNRGIVVNEHLQTSDPEVYAIGDCAEVIDAVTGKRTLSQLGTSAVRMAKVAAEHIAGKDVSFRPVFNTAITELFGLEIGTFGITEERAKKEDIEVAVGKFKGSTKPEYYPGGKPITVKLIFRKSDRKLIGGQIVGGERVWGRIMTLSALAQKGATVEDVAYLETAYAPPISPTIDPITVAAEMAQRKLR

SEQ ID NO: 31301 - protein, 478 aa, Thermococcus kodakaraensis
MRLPGQKTKIIATLGPASLNEKTITAMVRAGMSVARINFAHGDLKQHEKSIKLVRKVSERLNRPVAILGDLPGVKIRVGEIEGGSVTLRRWQTVTLTTRDVIGNEAVIPVEFKDFPRLVSKGDVIYLSDGFIALRVEDVRDQDVICKVLVGGTLFSRKGINIPKARLAIEAITEKDLEFLEFSLEHGVDAVGISFVGSAYDVLKARRFVEERNGKLFLIAKIERPDAVRNFDEILRAADGVMVARGDLGVEMPIEKLPILQKKLIQKANCAGKPVITATQMLESMTHEKLPTRAEVTDVANAILDGTDAVMLSEETAVGKYPVETVKMMARIAKTTEAYRDSKWAERTVEWKMSELRGTRPTKGTIKDAITRSIIEALNSIDIKYILTPTRMGQTARLIARFKPKQWVLAFVTDEWVKNTLMFSYGVYPFLVEDTSEEEILRVITGLGLVDEGDTVLLTKGTPIGKTAGTNTIRIFNV

SEQ ID NO: 31302 - protein, 353 aa, Thermococcus kodakaraensis
MVDVRLENVVKEFDGVQAVKGINLHIKHGELFTLLGPSGCGKTTTLRMIAGLDYPTSGKIYFGDQEVTYLPSYERGAVLVFQNYALWPHMTVFDNVAYGLKLKKVPKEEIKKKVEWALELVKLKGFENRYPTQLSGGQQQRVAIARALVVEPKVLLLDEPLSNLDAKLRLEMRSEIRRIQRELGITVIYVTHDQEEAMAISDRIAVMNVGTVEQVGTPRDIYERPQSEFVASFMGKTNVIPAKVVERDGNKVTVEFESFRLDGLYYDGDKDDVVLVIRPERIKLHPVENAVSIEGTVDLVEYYGFFTEVVGLFGDTRIIARTISDREVQGLRPTQPVTFYINREDIIVLPKQL

SEQ ID NO: 31303 - protein, 348 aa, Thermococcus kodakaraensis
MRFYICREKGEPKPFRIAIIGAGPAGLSAAGYLACRGYEVHVYEKMPEGGGMVAFGIPETRIPIRTVRGGVRDLERLGVNFHFRTKVVYDSPRELGDEWAEHFVSLERLLGEFDAILIATGAWRPRKLKVPGADLPGVYDALSLLHHIKMARIGYYSWEGIPDLKGKHIVVIGAGYTAVDVAIEGRLLGAEKITMVYRRGLEHSYAKTEIRKLIEEGVEFIEFATPVRIIGDERVQGVEFAKTRIEEGSVITTDERFILDADIVAYAIGQLPTSPIREVVCANEEILKEAGIFFAGDVVAPRNIGTAMREGKERAKEIEEWLLKKAPKKVFPVPVAARLISEVANGKC

SEQ ID NO: 31304 - protein, 507 aa, Thermococcus kodakaraensis
MVEPFVPEGEIFEGIFRQNEGIPEFATYVNGEWVFTGKTAEVRSPIDGSLIARVSLSDMALSNRAVAAAYSAGRHEIRDTPGEKRLEAFLKVAELIRDSFDDFVTALVLDAGKPLSNARGEVTATIERLEKTTMEFGRLIGDYIPGDWSAESLGSEGIVKREPYGVVLAISPYNYPLFISTAKIVPALLAGNAVLLKPSSQDPLAPLLLSRVLQLAGIPESAYHLLTVPGALMDSILADRRIRAVTFTGSTEVGEHILSMGGIKFYHMELGGKDPAVVLDDAPLEETVEKLVKGMVSYSGQRCDAIRLIIAEEGIYEQLKRELVAALSKIEPENPLEDEDAIMGPLINERSAEKIEEVYRDALEKGAVPLTGFKRKGAYVWPVLLEASREVLPGLRAFQEDVFGPLTILVKVSNEDEAVELANSSRFGLDAAVFSGDDSRARKVARRLEVGAVFINEFPRHGIGYYPFGGMKDSGIGREGIGYSIETLTTTKTIVRNYRGRGVWDYI

SEQ ID NO: 31305 - protein, 262 aa, Thermococcus kodakaraensis
MIEAENVHFAYNGKEVLRGIDFEMGQEIVALVGPNGSGKTTLAKHFNGLLKPSKGRVLVDGLDTREHTVAELSRLVGYVFQNPEHMFFEETVFNEVAFGPRNLGLSEEEVEERVKWALKSVGLEGFEDRTPYSLSGGEKQRLAIACVLAMKPKYLILDEPTTGLDARAEEEVVEVIRSLHESGHGILLITHDMDLVVRLAERVVLLHGGRKLFDGPVEEFFTAFDVEKYGLERPEVVELGERLGVGFVRSIEEILAKLGGEV

SEQ ID NO: 31306 - protein, 224 aa, Thermococcus kodakaraensis
MNILIFGPPGSGKSTHSRTIMEKYGLVYISSGDLIRREIERKSSLGREMEAYLSRGDLIPDTIVNTLIISKLRRQRENFILDGYPRTPEQVISLENYLFDHGIKLDLALEIFIDEDTSVERISGRRICPNCGAVYHVKYNPPKVPGICDVCGSELIQRADDREEVVRKRYRIYSKNMEPIIKFYRAKGIYVRVDGDGPISEVWKRIQPLLDYIHSREEKRKEHE

SEQ ID NO: 31307 - protein, 361 aa, Thermococcus kodakaraensis
MEIVIIGNGPGGVELAKELSGEHEVLIFEREEVPFYSKPMLSHYIAGLIEKEKLFIYPLDWYERKGINLKLGEEAKLIDRVRKVLVTDKGEYPYDILVIATGARAREPTVDGKEHLLTLRSIEDAEGIKALLEEHGEAVIIGGGFIGLELAGNLAKAGYGVKLIHRRDTFLGLDEELSSLIREKLEESGVEFHLGAELLKADENGLLTTRGYIEGKVKICAIGITPNVEIARRSGIHTGRGILIDDHFRTSAKDVYAIGDCAEYSGIICGTAKAAAGHAKVLANLLRGKEDRYPFELRSSVFKFGDLPIAIIGKTRGEGEWLDEHTKAFFQDGKLVGAVVIGDIRKAFSIEKELKKELYGA

SEQ ID NO: 31308 - protein, 278 aa, Thermococcus kodakaraensis
MKKVRIFNDLKWIGDDKVTAIGMGTWGIGGYESPDYSKDNESVEVLRHGLELGINLIDTAEFYGAGHSEELVGEAIKEFERDDIFIISKVWPTHFGYEEAKRAARASAKRLGTYIDLYLLHWPGDSWEKIKETLHALEELVDEGLIRYIGVSNFDLELLKRSQEAMKKYEIVANEVKYSLKDRWPETTGLLDYMKREGIALIAYTPLEKGTLARNECLAEIGKKYGKTAAQVALNYLIWEENVIAIPKAGNKAHLEENFGAMGWRLSKEDRENARGCV

SEQ ID NO: 31309 - protein, 288 aa, Thermococcus kodakaraensis
MEFLYTYETLKLEFPLVEPEKARFILLGVPFDGTTSYKAGARFGPTLIRQATLNLESYILDYDLDIAELPIADIGDIAVVAGDPRKTADRVRETLEELKKANPKAIPILLGGEHSQTLGAVEALKPASYVVFDAHLDLRNSYEDNPYNHACVARRISELGVKEAIFGIRSGTKEEVDFARERDIPWVHARDYSFDAFVDLVEALPEPVYLSIDIDVFDLSMVPSTGTPEAGGLRFWEVVEAIEWLVEKKEIAGFDIMEVAGEKLGDPTALTAAKLLFYSIGAMAKFGR

SEQ ID NO: 31310 - protein, 456 aa, Thermococcus kodakaraensis
MGKLFGTFGVRGIANEEITPEFALKIGMAFGTLLKREGRERPLVVVGRDTRVSGEMLKDALISGLLSTGCDVIDVGIAPTPAIQWATNHFNADGGAVITASHNPPEYNGIKLLEPNGMGLKKEREAIVEELFFSEDFHRAKWNEIGELRKEDIIKPYIEAIKNRVDVEAIKKRRPFVVVDTSNGAGSLTLPYLLRELGCKVVSVNAHPDGHFPARNPEPNEENLKGFMEIVKALGADFGVAQDGDADRAVFIDENGRFIQGDKTFALVADAVLRENGGGLLVTTIATSNLLDDIAKRNGAKVMRTKVGDLIVARALLENNGTIGGEENGGVIFPDFVLGRDGAMTTAKIVEIFAKSGKKFSELIDELPKYYQFKTKRHVEGDRKAIVAKVAELAEKKGYKIDTTDGTKIIFDDGWVLVRASGTEPIIRIFSEAKSEEKAREYLELGIKLLEEALKG

SEQ ID NO: 31311 - protein, 465 aa, Thermococcus kodakaraensis
MKTVLLAGGKGTRLWPLSRELMPKQFVRFLDDESLFQKTVERALLFSKPSEIFVVTNKDYRFRVMDDLREIRIELPADNILLEPVGKNTLPAIVWAVLKIEEKFGPSKVAVLPSDHLIETGEAYERAFENAERLADKFLVTFGIKPNRPHTGYGYIKPGERIEEGGRLLGYRVDEFKEKPDLETAKRYVESGYYWNSGMFAFSTSLFLEEVEKHAPEVLEAFESSSSIEEAYEKAPEISIDYGVMEKTEKAAVVPLNVKWSDLGSFDAIYEVLEKDDAGNAVQIRGKKGYHIGVNSKNNLIMTERLTATVGVSDLVIIDTGDALLVAHRGETQKVKEIYRALREMNDERAIVHRTAYRPWGSYTVLEEGDRYKIKRLTVLPGKKLSLQMHYHRSEHWVVVRGTAKVIVGDRELLLRPGESTFIPAGVKHRLENPGKVVLEVIETQIGEYLGEDDIVRFVDDFGRD

SEQ ID NO: 31312 - protein, 411 aa, Thermococcus kodakaraensis
MFRITDFTYEGKTVFLRADLNSPVEKGRITSDARFRAVLPTIQHLLDNGAKLVIATHQSRPYKGDYITTEEHAQILSRLLGQEVEYVEDIFGKYARERISSLKPGEAIILENLRFSAEEVFNRSIEECEKTFFVRKLAPLIDYVVNDAFATAHRSQPSLVGFARLKPMIMGKLMETEVDALSKAYESEERPRVYVLGGAKVDDSLRVAENVLRKGKADLILTGGLVGQIFTLAKGFDLGDANIEFLHRKGLLELVDWAEKILDEFYPYVRTPVDFAIDYKGERLEVDLLGGEKRLFDQYPILDIGSRTVEKYREILIGAKIIVANGPMGVFEREEFAVGTVGVFRAIGESPAFSVVGGGHSIASIYRYNITGISHISTGGGAMLSFFAGEELPVLKALKISYERFKDRVKE

SEQ ID NO: 31313 - protein, 443 aa, Thermococcus kodakaraensis
MTPEEVVERYSQVISRASHVTYVPIVPSRAENALVWDIEGRAYIDFLADAAVQNVGHNNPRVVEAVKKTADRLLHFTFIYGFPVEPLLLAEKLREIAPLEGAKVAFGLSGSDANDGAIKFARAYTGRRSIIGYLRSYYGSTYGAMSVTGLDFEVRSKVGQLSDVHFIPFPNCYRCPFGKEPGKCRMECVSFLKEKFEGEVHAEGTAALIAEAIQGDAGMVVPPENYFKKLKRILDEHGILLVVDEVQSGLGRTGKWFAIEHFGVEPEIITLAKPLGGGLPISAIVGRGEIMDSLPPLGHAFTMSGNPVASAAALAVIEEIEEKELLKRAQILGERAKRRLEKMKKKHELIGDVRGLGLMLGVDLVKDRETKERAYDEAKKVVWRAYELGLIVAFLQGNVLRIEPPLTIEEEVLDEGLDKLEEAIEDVEEGRVPDEVIEKVQGW

SEQ ID NO: 31314 - protein, 442 aa, Thermococcus kodakaraensis
MERKTVVVIGGGAAGMSTASRVKRLKPEWDVKVFEATEWVSHAPCGIPYVVEGISPKEKLMHYPPEVFIKKRGIDLHLKAEVIEVEQGRVRVREEDGEKTYEWDYLVFANGASPQVPAIEGIDLPGVFTADLPPDAVAITEYLEKNPVENVVVIGTGYIAIEMAEAFVERGKNVTLIGRSERVLRKTFDKEITDIVEEKLRNHLNLRLEEVTLRIEGKERVERVVTDAGEYPADLVIVATGIKPNTELARGLGVRIGETGAIWTNDRMQTSVENVYAAGDVAETKHLITGRRVWMPLAPAGNKMGYVAGSNIAGKEIHFPGVLGTSITKFLDLEIGKTGLTEAEAMKEGYDVRTAFIKAGTRPHYYPGSKTIWLKGVVDNETNRLLGVQAVGGDILPRIDTAAAMITAGFTTKDVFFTDLAYAPPFAPVWDPLIVLARVLKF

SEQ ID NO: 31315 - protein, 481 aa, Thermococcus kodakaraensis
MPRRKLIKERVPTPERPPEERIKDFKEVNLGYTFELAVKEAERCLQCPYEYAPCIKGCPVHINIPGFISKLVEYRDDPDKAVKEALNVIWACNSLPATTGRVCPQEDQCEMNCVMGKVGDKINIGKLERFVADYAREKGIDEELLFEIIPKIEKKGQKVAIIGAGPAGLTAAGELAKLGYDVTIYEALHEPGGVLMYGIPEFRLPKEIVNKEIEKLRKLGVKILTDHVVGRTVTIEELLQEYDAVFIGSGAGTPRLINAPGINLNGIYTANEFLTRVNLMKAYLFPEYDTPVYVGKKVIVIGAGNTAMDAARSARRFGAEVTIAYRRGEEDVSAREEEVEHAKEEGIKFVYFVNPVEFIGDENGRVKAVKFEKMKALDERDARGKRKIVGTGEYVTLEADTVIIAIGKHPNRLIINTPGLKVERGKIVVDENLMTSIPGVFAGGDAIRGEATVILAMGDGRKAAKAIHEYLTKKRQEKANA

SEQ ID NO: 31316 - protein, 413 aa, Thermococcus kodakaraensis
MLSYDVVVIGGGPAGMAAAAKAKELGLNVLLLDENDYLGGILPQCIHPGFGLHYFKEELTGPEFASRLAKRLVELGVEYRTAARVLEIKNYSDLEKVVIFTSPAGVYQVWAKAIIYAAGARERHAFEIGIVGDRVAGIYTAGEAQTLMDIYGVLPGKEVVIVGSGDVGLIMARRFALEGAKVKAVVELMPYPGGLARNVMILRDFNIPLYLSHKVVEVRGKGRVQRVRVVKVDENFNEIPGSEFWIEVDTLVISAGLIPSVKKLKKIGVEIDPATGGPVVNDRLETSVPGIFVAGNSLLINDLVDYVAEQGELAAKSAKEFIENGGIESRKWVKVEKGQNVRLIAPHYLGGDRDVYLYLRVARPMENVELRIPEIGKKLRLPVVKPAEMIRLKLRAEEIQKASERLTVEVVRA

SEQ ID NO: 31317 - protein, 366 aa, Thermococcus kodakaraensis
MKPLHDPVYLTVAFEQAGETGLSDRGFDLKYSREENPTVRLLEKKVASIEGGTDSLAFNSGMAAISALYISTLKAGEEVVLPMEGYGTTIQLAEELRKFGVRVKLAYPSSEALNEAITENTRLVLTEVVTNPTLKVIDVPEVIRRAKEVGATVVVDNTFSPLIFKPLKVRADGVIHSLTKYIAGHNDVMGGALIWGDLDPENLWHWRRRLGSIIQPFEAWLVIRGLKTLELRFERQSRTAQTIAEFLSEHPKIEKVHYPGLKDDPYHPTARRIFSKPLFGGVLSFLHREGESGAKAFLMRLKRVFPSPSLGGVESLASYPVMSAAKTMPEERRRLLGITPGLIRLSVGVEDADLLIEDIDRALGGG

SEQ ID NO: 31318 - protein, 447 aa, Thermococcus kodakaraensis
MKYDVVVIGGSAGGLTAAISAKRFYPDKSVLVIKKEDVSMIPCGIPYIFGTLRSVEDDVLPTERFLKPLGIDVLVDEVTEINPKSKTLLTKSGREIGWEKLVLATGSRPQIPDIPGVELEGVYTVSKDYHYLKELKKRVEDAEKVVIIGGGFIALEVGDEIRKLGKDVTIVVRSRLLRNSFDPEFSEMIENRLKEVGINVVYGHVERLVGRERVEGVKLVEGGEIPADLVILSTGYRPNVELAVKTGLKVTRYGIWTDEYMRTSCPDIFAVGDCVEHRDFFTGKPFPLMLASTATFEARIAGANLFKLQIVRENRRTIGAYSTHVAGLTLAAAGLTEEAAKREGFEVIVGRATGPDRHPAKFEDTSMVTVKLIFSRDRGAILGAQLAGGKSVGEMINVLALAIQKRLTASELYTLQIATHPLLTASPVGYQILQAAEDALAKLRAGA

SEQ ID NO: 31319 - protein, 341 aa, Thermococcus kodakaraensis
MTVIENIVGRVTVLRGGRYSVEVDVITSSGFGRFAAPVDENPDLYIAEAHRAVSEVDEIIGPELIGFDATEQELIDSYLWEIDGTEDFSHIGANTALAVSVATAKAAASEKNLPLYTYLGGTFTTELPVPILEFASDSEFDYYVMVRDLMEITDVVDAVNGVLSNLKEATVEGYSEATEKASSELGLDVALGLAQKAPMDMEKLLTLVEDNNVAYLKPMGDEELFLELIAGTHGVFIDGEYLFRQKDILDRRYYNALSIKPINLGTLTDLYNLINDAKSERIVPILAEARFESSDEALAHMAVGFRCPAVVLRKDSIAKLNELIRIAEDLGERGRVITFEG

SEQ ID NO: 31320 - protein, 390 aa, Thermococcus kodakaraensis
MRDFYIAHEDDIKAGKTTDVYFIRTQKILREKGIKKRVFADVGTTSLPHGWKWGVLAGIEEVAKLLEGLPVNVYAMPEGTIFHPYEPVLQIEGYYDEFGIYETALLGMLSQASGIATAALRIKIAAKFKPVYSFGIRHMHPAIAPMIDRSAFIGGCDGVSGVLGAEMIGEKPVGTMPHALILTIGDQVKAWKYYDEVMPPEVPRTALVDTLCDEKFEALMAAEALGDRLNAVRLDTPSSRRGNFRKIVEEVRWELDLRGYNHVKIFLSGGLNEESLKELADVADAFGVGSAIASAKPVDFSLDIVEVEGKPITKRGKLSGRKQIYRCENGHYHRVPVEKKLEKCPVCGAKVEPLLKPLIENGKIVAELPKAKEIREYVLEQAKKLNLSID

SEQ ID NO: 31321 - protein, 481 aa, Thermococcus kodakaraensis
MAVRRKLIKERVPTPEVPVEERIKSFVEVNLGYDFASAVKEAERCLQCPVEYAPCIKGCPVHINIPGFISKLVEYRDNPDKAVREALRIIWNDNTLPAVTGRVCPQEDQCEGVCVMGKVGDPINIGKLERFVADYARKHGIEEELLCEFEERCTGELGKVAVVGAGPAGLTAAGELAKMGYKVTIFEALHKPGGVLAYGIPEFRLPKEILDQELAKLKRLGVEIRTDHVVGRTVTIEELLQEYDAVFIGTGAGTPKLLNVPGILLDRIYSANEFLTRVNLMKAYEFPEYDTPIAIGKKTIVIGAGNTAMDAARSALRLGSEVTIAYRRGREDMTARIEEIKHAEEEGVKFEFFLQPVEFIGDENGRVKAVKFEKMRPLDERDARGKRKIVGTGEYVTLEADTVIIAIGLEPNRIITETPGLKTNTNGTLVVDENLMTSIPGVFAGGDAIRGEATVILAMGDGKKAAKAIHEYIQAKRKANA

SEQ ID NO: 31322 - protein, 273 aa, Thermococcus kodakaraensis
MSFAKLEFFNPFSRSIKDRAVFNLVMKALKRGDINGTRRLFEATSGNVGIAMAAISNIFNVEFRAYLPKPTPDATVTLLKVLGAEVVKTDFEVIDREMIEFVRDEAEKAGAVNLNQFENDDNFEAHYRYTAREIDEQLRSIGVSPDVIVAGVGTSGHIAGIAKYFKERYDTKVIGVVPAKNEKIPGIKRLETRPKWFFDAGIDEVVEVTQREAIEGSIQVARREGILIGLSSGAVVSALEKVRDRYPGTAILILPDDAFKYVEVFEKYLRECQ

SEQ ID NO: 31323 - protein, 326 aa, Thermococcus kodakaraensis
MHATLREIKRTPEGIKTAQRAFEEFVTNSDFLLPREVVYTGCGSSHFLSQPLAMATTRLGGRGVALPCSELLYSREYYPVGKPELLVSISRSGETTEAVKALESLDVPKFALTAYESTLSRKADYALIVPTHEESVVMTHSFTAFYFAFLQLLNASFGLETYDAEMTSELTREALKNEGYIREITGEFDFRNVIFLGSGILYPIALEAMLKMKEMALFWSEAYQTFEVRHGFKSVADEGTLVVLLVNEPFDWHEKLTKEFQGQGARVLTIGNGDTGADYFIDLPKVDELLTPILHLPIIQLLSYYKAIKRGLNPDQPRFLSKVVKW

SEQ ID NO: 31324 - protein, 443 aa, Thermococcus kodakaraensis
MNEIKGIERAVQVEVPRPRFLLLAFTDINGSLKGMEIPMERYEEAVEDGVSFDGSSIPGFEGIEDSDLIFKADPSTYAEIPWEGIGRVYGYIYKGDEPYQADPRGILKRVLERLEKEGLKAHIGPEPEFYIFKKNGTWELHIPDSGGYFDLVGLDKAREIRREIALYMPYLGLKPEVLHHEVGKAQHEIDFRYDEALRTADNIVSFKHVVKAVAELHGYYATFMPKPIYGFPGNGMHLHISLWKDGENVFIGEDGLSDTALHFIGGILKHAKALAALTNPTVNSYKRLVPGYEAPVYISWGYRNRSALIRVPAFKGSGARIEYRCPDPSANPYLALAGILMVGLDGIKKKVEPDSYVETNVYEMDDAERERLGIDTLPGSLGEALEELKKDKTVREALGGAYKNFIDYKEREWEEYIEYLSSRDIPIDTKKVTEWELERYFYV

SEQ ID NO: 31325 - protein, 412 aa, Thermococcus kodakaraensis
MLSMFPEKFLFGTSTAAHQVEGDNKWNDWWYYEEMGKLPYKSGKACNHWELYREDIELMAELGYNAYRFSIEWSRLFPEEGKFNEDAFNRYREIIELLLEKGITPNVTLHHFTSPLWFMRKGGFLKEENLKYWEGYVDKAAELLKGVKLVATFNEPLVYVTMGYLTAYWPPFIKSPFKSFRVAANLLKAHAIAYELLHGKFQVGIVKHIRVMLPERKGDEKAAQKADNLFNWYFLDAIWSGKYRGAFKTYSVPESDADFIGVNYYTASTVRRSLNPLKMFFEAKDAEIGERRTQMGWSVYPEGVYLALRRASEYGRPLYVTENGIATLDDEWRKEFIIQHLRQVLRAIEDGLDVRGYFYWSLMDNYEWREGFEPRFGLIEVDFETFERRPRGSAYLYGEIARTKKLPGEEDP

SEQ ID NO: 31326 - protein, 445 aa, Thermococcus kodakaraensis
MRDLRRKVSIALLVLMAVFLMADQNLLPPNYQLIMEEFGISEAKMGLVSSIFVATSALITIIWGFLSDIKQRKKLLVIGVLLGEIPCFLTAYVTNYWQLLAMRFLTGIGIGSIIPIGYSLIADMFEESKRGRGYAYMETAFGFGTLLGMIMAGMIAGWRLPFILAAVPNFILAPLFYFIAEEPKRGEGEKELREVLEKGYEYRYRISWEAVKKSFETKTNQLIFLQGIIGTVPWGIIMYWLISFLQVTRGMDKTTSTFVLLIIGISSVLGSLMGGFLGDYFEARWRGGRAILTGAAIFIGMLASIGIILYPLPSQLTAKDWAFIAVYSLLFIQFVSYAGPNVRAIVSQVNLPEDRGTIFGLFNILDNVGKATGPLLGGLMIEWLRGMGYSKPLAYQYTLLIGALFWIPCALTWLWIKKTYPEDRDAVKAILKKRAEELLSKAPAN

SEQ ID NO: 31327 - protein, 480 aa, Thermococcus kodakaraensis
MRIEDVYIWDINAKWLGISPVQLMENAGAGVARTIEERFGKGLKVAVFSGTGNNGGDGFVATRHLSFENDVTLFLVGDEAKIRSEEAKHNWEILKKLDFVKIRILKDSSYIKSLDLSEFDVIVDALLGAGTKGEPREPIRSAIEKINEYSGKAKIVSVDLPSGYPSDIRVKCDFAVTFQWDKEEYGGFERVIVKIGYPKELYHLVGPGDAKFALRKKGEHKGQNGKLLVIGGSEDYFGAPYLAAKAASYLVDLVYLAMPEYSARRINDPNVILRPFERRNFRKEDVEDVLAIADGVDAVVIGPGIGQRAETKEFVVEFLRWCEKPVVIDADALKAVAEDLDVLKGKNFVLTPHAGEFRILFGEKPEGSLEEKAKLVVEKAKGVGGTVLLKGAYDIISDGKGWKYNKTGNRGMTTGGTGDVLAGLVGALLALGNSPLRAASAGAFLNGLAGDMVKEEMGENFTALDVAEKVPQAVKWVLEF

SEQ ID NO: 31328 - protein, 351 aa, Thermococcus kodakaraensis
MEGIRFAFLCREKPEPTGKKVAVIGAGPAGLAATGYLVCQGHEVHVYDKLPEPGGLMLFGIPEFRIPIYRVREGYKELEKVYNVKFFTRTKVCFGNPKESGDEFVERRIEFEEILKNYDAVLIATGTWNAYVPTIPGSDLEGVYPALEYLFRIKSAKLGHMDWSEVPPVEGRKVLVVGAGHSAVDAALESINLGAEKVYMSYRRTIREAPAGAYEINLLQQRGVKWLERTMPVRIIGENGRVRAVELVKTELSEPDETGRRRPIPIEGSNFQIEVDYMVCAVGQMPTPPFSKEMGIALDRKGRIVVDSRHMTSREGVFAAGDVVLGPSKVGRAVKDGLYAAESIHLWLMGR

SEQ ID NO: 31329 - protein, 445 aa, Thermococcus kodakaraensis
MVVRPNVKELPGPKAKEVIERNFKYLAMTTQDPENLPIVIERGEGIRVYDVDGNVFYDFASGVGVINVGHSHPRVVEAIKKQAEKFTHYSLTDFFYENAIILAEKLIELAPGDIERKVVYGNSGAEANEAAMKLVKYGTGRKQFLAFYHAFHGRTQAVLSLTASKWVQQDGFFPTMPGVTHIPYPNPYRNTWGIDGYEEPDELTNRVLDFIEEYVFRHVPPHEIGAIFFEPIQGEGGYVVPPKGFFKALKKFADEYGILLADDEVQMGIGRTGKFWAIEHFGVEPDLIQFGKAIGGGLPLAGVIHRADITFDKPGRHATTFGGNPVAIAAGIEVVEIVKELLPHVQEVGDYLHKYLEEFKEKYEVIGDARGLGLAQAVEIVKSKETKEKYPELRDRIVKESAKRGLVLLGCGDNSIRFIPPLIVTKEEIDVAMEIFEEALKAALK

SEQ ID NO: 31330 - protein, 430 aa, Thermococcus kodakaraensis
MENPFEITNVIAREILDSRGNPTVEVEVYTPISMGRAAVPSGASTGTHEALELRDGGSRYHGKGVRRAVENVNKIIAPEIIGMDVTWQRDIDTLMLELDGTENKSNLGANAILGVSLAVAKAAANALGLPLYQYIGGTNAYVMPVPMSNVINGGVHAGNELDFQEFMIMPVGADSFREAIRWVSETYHVLKKVIMEKYGRNAVNVGDEGGFAPPMKEVTEPLDVLIKAIEEAGYKPGDEIAFALDAASSEFFDGEKGKYVVAGKEYDKGELLELYRELVTTYPIVSIEDPFHEEDWEGFVMITKELGSKVQIVGDDLFVTNPKRIRKGIEMGAANALLLKVNQIGTLSEAIDAAYTSFRAGYGVVVSHRSGETEDATIADLAVALNAGQIKTGAPARSDRNAKYNQLIRIEEELEGIAVYPGKKFRNPFL

SEQ ID NO: 31331 - protein, 407 aa, Arabidopsis thaliana
MFRDSFLFARTIGCFGCFGSSGSRNQQSPKPYDDDTHSCDSDVTSTARGEEEEDEEEVEQKSRSKRSEEILKYRLDNGLICRHIPVRETNELIRGEDENGDKTINEYVRVCKIGSGSYGKVVLYRSTLDGQYYAIKAFHKSHLLRLRVAPSETAMSDVLREVMIMKILEHPNIVNLIEVIDDPETDHFYMVLEYVDGKWVYDGSGPPGALGEKTARKYLRDIVTGLMYLHAHDVIHGDIKPDNLLVTSSGTVKIGDFSVSQVFKDDDDQLRRSPGTPVFTAPECCLVSGITYSGRAADTWAVGVTLYCMILGQYPFLADTLQDTYDKIVNNPLIIPDGLNPLLRDLIEGLLCKDPSQRMTLKNVSEHPWVIGEDGHVPEYFCWCKRNAASKIEEGEANGISETSDPN

SEQ ID NO: 31332 - protein, 149 aa, Bacillus cereus
KSFIDKGALVPDEVTIGIVRERLSQEDCVRGFLLDGFPRTVAQASALEEIMKDLGKKIDYVLNINVDSGLLLKRLTGRRICKECGATYHLEFNAPAKADVCDKCGGELYQRSDDNEETVANRLDVNIKQTKPLLDFYEELGYLQSINGE

SEQ ID NO: 31333 - protein, 149 aa, Bacillus cereus
KSFIDKGALVPDEVTIGIVRERLSQEDCVRGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGE

SEQ ID NO: 31334 - protein, 149 aa, Bacillus cereus
KSFIDKGALVPDEVTIGIVRERLSQDDCVRGFLLDGFPRTVAQASALEEIMKDLGKKIDYVLNINVDSGLLLKRLTGRRICKECGATYHLEFNPPAKADVCDKCGGELYQRSDDNEETVANRLDVNIKQTKPLLDFYEELGYLQSINGE

SEQ ID NO: 31335 - protein, 341 aa, Aegilops tauschii
MERYEVIKDIGSGNFGVAKLVRDVRTKELFAVKFIERGHKIDENVQREIMNHRSLRHPNIVRFKEVVLTPTHLAIVMEYAAGGELFERICGSGKFNENEARFFFQQLLSGVSYCHSMQICHRDLKLENTLLDGSEAPRLKICDFGYSKSSVLHSQPKSTVGTPAYIAPEVLSRREYDGKVADVWSCGITLYVMLVGAYPFEDPDEPKNFRKTITRILSVQYSVPDYVRISMECRHLLSRIFVANPEQRITIQEIKNHPWFLKNLPIEMTDEYQMSLHMVGVNAPPQTLEEIMAIIQEARIPGDGSKFAGQLSVPGLGSMELDDIDDVDVDVEDSGDFVCAL

SEQ ID NO: 31336 - protein, 206 aa, Nicotiana tabacum
MSATGEVENPAVEQPPAEAPTAENQPPATKKSVKEKKPRAPREKKPKSAKTVTHPPYFQMIKEALLALNEKGGSSPYAIAKYTEDKHKDELPANFRKILGLQLKNSAAKGKLMKIKASYKLSEAGKKERITASTKKVPKADSKKKPRSTRSATATAKKTEVPKKAKLTQKPKKVGAKKAKKSAPAKAKQPKSIKSPAAKRAKKVAA

SEQ ID NO: 31337 - protein, 148 aa, Oryza sativa
DGLVGIPKCGKAIGALKGHLDYSFASAWHPDGNILATGSQDTTCRLWDIRNLSESVAVLGGRMGSIRCIKFSSDGRFLATAEPVDFVHIYDSYADYGRSHEIDLFGEIAGLSFSPDAEALYVGIADPTYGGLIEFNRRHQHHYLNCMW

SEQ ID NO: 31338 - protein, 511 aa, Gossypium hirsutum
MMAVLFVYLGFMVFGIIVLRFLYRFIDNNGLPRNWPFVGMIPTLLLNIHRPHDKVAQVLRRSNGTFFYRGLWFTNTSFLATSDPENVRYILSSNSSVYLKGPEWLKQFDIFGEALFNSDGEAWKCHRRVFHAFLNHPQYRQSLSKVLHQRIEEALVKVLEYVSGREMVVNLQDLLAGHAFDIGCITGVGFDPGLLSIEFPENRFQKAMSDTLEAAFYRYVVPDSLWKLQSWPQIGKGKKRSDAWKALDDLLTQFISTQRHKSTKSVASSGSNEEHDFNFLNCYLTGHEITGPTPKESLIRDNLIHFLFASDGTYSLTLTWFFYLISKAPVVENKIREEIKRHLSMKQVEGSLQIPSNYDELSKLTYLHAALCETLRLYPPIPFDFRTCTKQEYLPSGHRVDQNTRIIIGIHAMGRMESLWGEDCYAFKPERWIGEDGKIKRESPTKFSAFLAGPRICPGKEVSFLLMKATATAIIHNYNVHVVEGQNIGPKNSVVYQMKKGLMVRIKKRWS

SEQ ID NO: 31339 - protein, 318 aa, Silene latifolia
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMQTGLKGSMEPLLEEADIDKDGRISLAEFRRLLRSASMSS

SEQ ID NO: 31340 - protein, 318 aa, Silene latifolia
NFLFKSPKEDSPLKATDFGLSDFINRSRKFTDIVGSAYYVAPEVLKRKSGPESDVWSIGVIMYILLCGRRPFWDKTEDGIFKEVLRNKPDFRRKPWPSISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 31341 - protein, 318 aa, Silene dioica
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 31342 - protein, 318 aa, Silene dioica
NFLFKSPKEESPLKATDFGLSDFINRSRKFTDIVGSAYYVAPEVLKRKSGPESDVWSIGVIMYILVCGRRPFWDKTEDGIFKEVLRNKPDFRRKPWPSISNTAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGRISLAEFRRLLRSASMSS

SEQ ID NO: 31343 - protein, 318 aa, Silene diclinis
NFLFKSPKEDSPLKATDFGLSDFIKPSRKFTDIVGSAYYVAPEVLKRKSGPESDVWSIGVITYILLCGRRPFWDKTEDGIFKEVLRNKPDFRRKPWPSISNSAKDFVRKLLVKDPFVRPTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFNEFVAATLHVHQLHELDNEKWQELSQRAFEKFDVDKDGYITPDELRMHTGLKGSMEPLLEEADIDKDGRISLAEFRRLLRSASMSS

SEQ ID NO: 31344 - protein, 318 aa, Silene diclinis
NFLFKSSKEDSPLKATDFGLSDFINPGRKFHDIVGSAYYVAPEVLKRRSGPESDVWSIGVITYILLCGRRPFWDKTEDGIFKEVLRGKPDFGRKPWPTISNSAKDFVRKLLVKDPLVRLTAAQALSHQWVREGGNALDIPIDISVLHNMRQFVKYSRMKQFALRALASTLNDDELANLRDQFDAIDVDKSGTISLEEMRQALAKDLPWKLKDSRVMEIVEAIDSNTDGFVDFTEFVAATLHVHQLHELDNEKWQELSQRAFEKFDVDKDGYITPDELRMHTGLKGSMEPLLEEADIDKDGKISLAEFRRLLRSASMSS

SEQ ID NO: 31345 - protein, 318 aa, Silene vulgaris
NFLFKSSKEDSPLKATDFGLSDFINPSRKFTDIVGSAYYVAPEVLKRKSGPESDVWSIGVITYILLCGRRPFWDKTEDGIFKEVLRNKPDFRRKPWPSISNSAKDFVRKLLVKDPLVRLTAAQALSHQWVREGGSALDIPIDISVLHNMRQFVKYSRMKQFALRALASTLNDDELANLRDQFDAIDVDKSGTISLDEMRQALAKDLPWKLKDSRVMEIVEAIDSNTDGFVDFTEFVAATLHVHQLHELDNEKWQELSQRAFEKFDVDKDGYITPEELRMHTGLKGSMEPLLEEADIDKDGRISLAEFRRLLRSASVSS

SEQ ID NO: 31346 - protein, 507 aa, Populus tremula x Populus tremuloides
MACSASDLAPLLSSTVNSTEAATYLCSQFTSISNHLSDTSYAVNNTYLLFSAYLVFAMQLGFAMLCAGSVRAKNTMNIMLTNVLDAAAGGLSYYLFGYAFAFGSPSNGFIGRHFFGLGDFPSPQADYSFFLYQWAFAIAAAGITSGSIAERTQFVAYLIYSTFLTGFVYPVVSHWLWSGDGWANPAKSDNNLLFGSGAIDFAGSGVVHMVGGIAGLWGALIEGPRIGRFDHNGRSVALRGHSASLVVLGSFLLWFGWYGFNPGSFLIILKSYGGGAGGYYGQWSAVGRTAVTTTLAGSTAALTTLFGKRLLSGHWNVIDVCNGLLRGFAAITAGCSVVEPWAAIICGFVAAWVLIGCNKLAEKLQYDDPLEAAQLHGGCGMWGLLFTGLFAKKAYVNEVYSNKPGRPYGLFMGGGGKLLAAQIIEILVIVGWVSATMGPLFYGLHKLKLLRISSEDEMAGMDLTRHGGFAYAYDAEDDVSGKPSFMMRKVLPANNTTPNENSPSINV

SEQ ID NO: 31347 - protein, 476 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQGEIHHVVNPDPYRGVFGSDGSLYAKDVQDHIEYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDADFLVDALDYSISRL

SEQ ID NO: 31348 - protein, 511 aa, Liquidambar styraciflua
MDSSLHEALQPLPMTLFFIIPLLLLLGLVSRLRQRLPYPPGPKGLPVIGNMLMMDQLTHRGLAKLAKQYGGLFHLKMGFLHMVAVSTPDMARQVLQVQDNIFSNRPATIAISYLTYDRADMAFAHYGPFWRQMRKLCVMKLFSRKRAESWESVRDEVDSAVRVVASNIGSTVNIGELVFALTKNITYRAAFGTISHEDQDEFVAILQEFSQLFGAFNIADFIPWLKWVPQGINVRLNKARGALDGFIDKIIDDHIQKGSKNSEEVDTDMVDDLLAFYGEEAKVSESDDLQNSIKLTKDNIKAIMDVMFGGTETVASAIEWAMTELMKSPEDLKKVQQELAVVVGLDRRVEEKDFEKLTYLKCVLKEVLRLHPPIPLLLHETAEDAEVGGYYIPAKSRVMINACAIGRDKNSWADPDTFRPSRFLKDGVPDFKGNNFEFIPFGSGRRSCPGMQLGLYALETTVAHLLHCFTWELPDGMKPSELEMNDVFGLTAPRAIRLTAVPSPRLLCPLY

SEQ ID NO: 31349 - protein, 377 aa, Lilium hybrid cv. 'Acapulco'
MENAKGPVVVTGASGYVGSWLVMKLLQYGYTIRATVRDPRDLRKTKPLLDIPGADERLTIWKADLSEDASFDEAINGCTGVYHVATPMDFDSKDPENEVFQPTINGVLGIMKSCKKAGTVKRVIFTSSAGTVNVQENQMPEYDESSWSDVDFCRRVKMTGWMYFVSKTLAEKAAWEFAKENDIQLISIIPTLVVGPFITSTMPPSMLTALSLITGNEAHYSILKQIQLVHLDDVCKAHIFLFENPEASGRYICSSYDATIYDLARKIKDRYPKYAIPQKFEGIDDQIKPVHFSSKKLMDLGFKYQYTFEEMFDEGIRSCIEKKLIPHQTQERYYVHDELDLGCSKMTNDKLDLGGSKLNSMDEMVRGHNERVSVALQ

SEQ ID NO: 31350 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTVCTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMSDVSAAASFRTGALNLNTWFLFKQYACCFGVELTMNNTAALYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 31351 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYNEMKKNGAMADVSAAASFRTGALNLNTWFLFIQYACCFGVELTMNNAAALYFKEKFSLTTEEAAAIASIFGWMNLFARGAGGFLSDKANARMGMRGRLWTHTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPQPDTEKTQDVNA

SEQ ID NO: 31352 - protein, 482 aa, Cylindrotheca fusiformis
MSGTDVATGAPAEWKKYQEYSLDVDPDQDDRATEIKLCNFSRPHMRAFHFSWIGFFIAFFIWFAIAPLLSEIQDTLDLDKKEVWTSSIVGVGGTIFMRFLLGPFCDKIGPRVLFTFVLCFASIPTACTGFVNSATSLAVLRLFIGTAGGTFVMCQYWTSRMFTKQVVGTANALVGGWGNLGGGVTQLVMGSALFPLFKEIFKNEPDPAETAWRWVSIVPAVVAFAIGLLIFFYSDDAPKGNYHEMKKNGAMADVSAAASFRTGALNLNTWFLFIQYACCFGVELTMNNAAVLYFKEKFSLTTEEAAAIASIFGWMNLFARGAGGFLSDKANARMGMRGRLWTQTILLACEGALVLVFANTGSLTGAIVVMVFFSLFVQAAEGSSYGIVPYVDPPATGAIAGIIGAGGNTGAVAFGMGFRQLDYKDAFIIMGAVICASSVLSVFICIPGSSRMIGGEADDVGAKDPTLSVPEPDTQKTQDVNA

SEQ ID NO: 31353 - protein, 245 aa, Guillardia theta
KPIVGGNWKCNLDKAGVSALVTSLNGMDCTDCEVVVAPVAVHLGSVVDNVKAPIEVSGQNCNFKGNGAYTGEVSADQLVDMGAKWVILGHSERREYFKEDNEMLRQKLEYALSKGLKVIFCIGEKLEERNANKTLDVCKSQLEPVKDLLKPETVVIAYEPVWAIGTGVTATPEQAQETHKQIRDYLATVNADMASKIRIQYGGSANAANAPTLSACPDIDGFLVGGASLKPEFADIIKAIAAAKK

SEQ ID NO: 31354 - protein, 207 aa, Guillardia theta
WKFFGNLMDCEQYQPFLCGEESFGTGSNHIREKDGMWAVLAWLQILASKNPDQSKPLVTVEDIVRAHWSKYGRNYYVRYDYEGVELAQAENMMKYMSDMAGKWPADAFNGMEIETADVFKYNDPVDKSVSDNQGIRFIFKNGSRIVFRVSGTGVVGATIRLYLEKYEGPSGNLNAHPLETVKPIAELALKLSKLEEFTGRKAPSVMT

SEQ ID NO: 31355 - protein, 157 aa, Guillardia theta
KAARARCAARWPETNMAPKPRADSARWLELTQSGEFAKVAEPLFRLIARCINSPHFQVAERALFLWNNEYIVCLIAKSREVILPVLYPALEANTTKHWNSTVHGLTFNVQKLFMDMDARLWEECTQKHKMNMEKNAAAHLSRKQKWEQLERAVGVKG

SEQ ID NO: 31356 - protein, 279 aa, Populus tremula x Populus tremuloides
MSKEVIEEGHTRGKDYVDPPPAPLFDMGELKLWSFFRALIAEFIATLLFLYVTVATVIGHKKNQDACGGVGLLGIAWAFGGMIFILVYCTAGISGGHINPAVTFGLLLARKVSLIRAVGYMVAQCLGAVCGVGLVKAFMKPYYNSLGGGANTVAHGYSTGTALGAEIIGTFVLVNTVFSATDPKRSARDSHIPVLAPLPIGFAVFMVHLATIPITGTGINPARSFGAAVIINDKKAWDDHWIFWVGPFVGALAAAAYHQYILRAGAIKALGSFRSHPTN

SEQ ID NO: 31357 - protein, 279 aa, Populus tremula x Populus tremuloides
MSKEVSEVGQTHGKDYVDPPPALLLDLGELKLWSFYRSLIAEFIATLLFLYVTVATVIGHKSNKDPCDGVGLLGIAWAFGGMIFVLVYCTAGISGGHINPAVTFGLFLARKVSLIRAVAYMVAQCLGAICGVGLVKAFMKKKYNSLGGGANTVAMGYNTGTALGAEIIGTFVLVYTVFSATDPKRSARDSHIPVLAPLPIGFAVFMVHLATIPITGTGINPARSFGAAVIFNNEKAWDDHWIFWVGPFVGALAAAAYHQYILRAAAIKALGSFRSNPAN

SEQ ID NO: 31358 - protein, 285 aa, Populus tremula x Populus tremuloides
MGKDFEGGGELSAKDYHDPPPAPLIDAEEITQWSFYRAIIAEFVATLLFLYITVLTVIGYKNQTDVHKNGHECGGVGILGIAWAFGGMNFILVYCTAGISGRHINPAVTFGLFLARKVSLVRAILYMVAQCLWAICGCGLVKAFPKSYYTNHGGGTHGLAIRYSKGTGLGAEIIGTFVLVYTVFCATDPKRNARDSHVPVLAPLPIGFAVFMVHLATIPITGTGINPARSFGAAVIYNKEKAWDDHWIFWVGPFIGAAIAALYHQFILRAAAVKSLGSFRSSPNI

SEQ ID NO: 31359 - protein, 285 aa, Populus tremula x Populus tremuloides
MAKDMEVAEAGSFSAKDYHDPPPAPLFDAKELTKWSFYRALIAEFIATLLFLYITVLTVIGYKSQIDGSADSCGGVGILGIALAFGGMIFVLVYCTAGISGGHINPAVTFGLFLARKVSLIRAVMYMVAQCLGAICGVGLVKAFQKSYYKKYGGGANTLADGFSIGTGLGAEIIGTFVLVYTVFSATDPKRSARDSHVPVLAPLPIGFAVFMVHLATIPITGTGINPARSLGAAVIYNQDKAWDHHWIFWVGPFAGAAIAAFYHQFILRAGAVKALGSFRSAQRF

SEQ ID NO: 31360 - protein, 285 aa, Populus tremula x Populus tremuloides
MGKDIEVGGEFIAKDYHDPPPAPLIDAEELTQWSLYRAVIAEFIATLLFLYITVLTVIGYKSQTDTAKNGDVCGGVGVLGIAWAFGGMIFVLVYCTAGISGGHINPAVTFGLFLARKVSLVRAILYMVAQCLGAICGCGLVKAFQKSYYTKYGGGANGLASGFSKGTALGAEIIGTFVLVYTVFSATDPKRNARDSHVPVLAPLPIGFAVFMVHLATIPITGTGINPARSFGAAVIYNEDKAWDDHWIFWVGPFIGAAIAALYHQYVLRAAAVKALGSFRSSSNI

SEQ ID NO: 31361 - protein, 428 aa, Lactobacillus crispatus
MLKSVIENVHALEIFDSRGNPTVEVHVTLSNGVVGKAEVPSGASTGENEAVELRDGGSRLGGKGVSKAVNNVNTEINDALKGMDPYNQPKIDKTMIDLDGTPNKGRLGANAILGVSMAVAVAAANDARLPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKDDHKYHLEGKVLTDEELADYYDKLLDEFPELISMEDPYDENDVDGMVKFTKSHKDRIQIVLDDFICTNPALLTKAIKEGAGNASLIKLNQIGTVTETLETIRLSRKNGYNTMISHRSGETGDTFIADLAVAVNGGQLKTGAPARSERVEKYNRLLEIEEELGDGERLAFFPDDVDHD

SEQ ID NO: 31362 - protein, 156 aa, Rumex acetosa
GGVCGYGNLYSQGYGTNTAALSTALFNDGLSCGACFEMRCSGDPRWCIGGVITVTATNFCPPNFALSNDNGGWCNPPLQHFDLAEPAFLQIAQYHAGIVPVSFRRVPCGRKGGIRFTINGHSYFNLVLITNVGGAGDVHSVSIKGSRGGWQAMSRN

SEQ ID NO: 31363 - protein, 157 aa, Rumex acetosa
GACGYGNLYSQGYGVSTAALSTALFNNGGRCGACFEIKCDSDPSWCLPGNPSITVTATNFCPPNFAQASDNGGWCNPPREHFDLAQPSFLKLAQYKAGIIPVSYRRVPCRKQGGIRFTINGFRYFNLVVVTNVAGAGDVMRVRVKGSSTSWMSMSRN

SEQ ID NO: 31364 - protein, 156 aa, Rumex acetosa
GACGYGNLYSEGYGTSTAALSTALFNNGMSCGACFEIRCVNDGKWCLPGKSIVVTATNFCPPNNALPNNAGGWCNPPLQHFDLAQPVFQQIAQYRAGIVPVSYRRVPCNKKGGIRFTINGHSYFNLVLITNVGGAGDVHSVQVKGSRSGWQSMSRN

SEQ ID NO: 31365 - protein, 156 aa, Rumex acetosa
GGACGYGNLYSQGYGTNTAALSTAMFNNGLACGSCYEITCVADRKWCIPGSIMVTATNFCPPNNALPNNAGGWCNPPLHHFDLAQPVFQHIAQYKAGIVPVAYRRVPCRRRGGMRFTINGHSYFNLVLITNVGGAGDVHAVAIKGSRTRWQAMSRN

SEQ ID NO: 31366 - protein, 292 aa, Lycopersicon esculentum
NHDEAKARLKRIRGIEDVDEEFNDLVIASEASRKIEHPWRNLLQKKYRPHLTMAIMIPFFQQLTGINVIMFYAPVLFKTIGFGTDASLMSAVITGGINVIATIVSIYYVDKLGRRFLFLEGGIQMLFSQIAVAILIAIKFGVNGTPGELPKWYAIVVVIFICVYVAGFAWSWGPLGWLVPSEIFPLEIRSAAQSINVSVNMIFTFAVAQVFLTMLCHLKFGLFLFFAFFVVIMTVFIYFFLPETKNIPIEEMVIVWKEHWFWSKFMTEVDYPGTRNGTAVEMAKGGAGYKIV

SEQ ID NO: 31367 - protein, 235 aa, Lycopersicon esculentum
KRRNRPQLIMAIMMPTFQILTGINIILFYAPVLFQSMGFKRAASLYSSALTGAVLASSTLLSMATVDRWGRRVLLITGGIQMIICQVIVAIILGLKFGSDKELSRGYSIIVVVFICLFVAAFGYSWGPLGWTVPSEIFPLETRSAGQSITVTVNLFFTFAIAQSFLSLLCAMRFGIFLFFSCWIAVMTIFIYLFLPETKGVPIEEMMRLWEKHWFWKKIVSEDQQVKNTNGLNHA

SEQ ID NO: 31368 - protein, 300 aa, Schizosaccharomyces pombe
MNTTSEVIVGTGFQAIRQQLAQMHPELNFVEQLWLAYYKWFDNDVVATGLMSFLLHELIYFGRCIPWMIIDAMPYFRRWKIQPKKVPTLAEQWECTRLVLLSHFTVELPQIWLFDPMCATFGLSTSVPFPPVTKMIWQITLFFFLEDTWHYWAHRLFHYGIFYRFIHKVHHRYSAPFGLSAEYAHPLEIILLGAGTVFVPLMWCYFTHDLHLVTMYIWITLRLFQAVDSHAGYDFPWSLNKFLPIWAGADHHDYHHMAFKDNFSSSFRWWDAVLKTDQNYHQFKARRLAAKYEAESKKAK

SEQ ID NO: 31369 - protein, 1016 aa, Arabidopsis thaliana
MPSLASLVSLGGACASVSGTSSSDASYALVKRVSLSRRSVKGTKKWLCRYSVSSSTTTTTADFIADQNNNSVSIDSNSFRGSKDGDDSEVVLKQTPKPVLKPPVARVERGLGVNTAPWSKDLSNGGKFDGEEERNKVIESLGEVLDKAEKLEIPKPGNKEGGEAVKPSQPSANSSNSRNGSYANASDGGTRKTKTMKSVWRKGDAVAAVQKVVKESPKIFNRGVQTEPRTREEGEVNAKAGTPLAPPQPPFRPQPPVRPQPMLQGKPMVAPPVKKSPILKDLGMAAKPLVSEEVDSSVKSKERKPILVDKFASKKKGVDPAASQAVLAPTKPGKGPPSNKFRVEHRNKKNASASPRRRIVAEDDGDDDASISRSGRKGRKWSKASRKAVRLQAAKDAAPVKAEILEVEEEGMSIEDLAYNLAIGEGDILGYLYSKGIRPDGVHTLDREMVKMICRDYDVEVLDADSVKVEEMAKKRQTFDEEDLDKLEDRPPVITIMGHVDHGKTTLLDYIRKSKVAASEAGGITQGIGAYKVSVPVDGKLQSCVFLDTPGHEAFGAMRARGARVTDIAIIVVAADDGIRPQTNEAIAHAKAAAVPIVIAINKIDKEGASPDRVMQELSSIGLMPEDWGGDVPMVQISALKGENVDDLLETVMLVAELQELKANPHRNAKGIVIEAGLDKAKGPFATFIVQKGTLKRGDVVVCGEAFGKVRALFDHSGERVDEAGPSIPVQVIGLNNVPIAGDEFEIVSSLDVAREMAEARAVSLRDERISAKAGDGKVTLSSLASAVSAKKMSGLDLHQLNIILKVDVQGSIEAVRQALQVLPQENVTLKFLLQATGDVSNSDVDLASASEAIVFGFNVKASGSVKKAAENKGVEIRLYRVIYELIDDVRNAMEGLLESVEEQIPIGSAEVRATFSSGSGRVAGCMVNEGKFVKDCGIRVVRKGKTVHVGVLDSLKRVKENVKEVSAGLECGIGMDDYDDWIEGDIIEAFNAVQKRRTLEEASASMSAAIEEAGV

SEQ ID NO: 31370 - protein, 146 aa, Arabidopsis thaliana
MKATEEAKEAGALLSYDPNLREPLWPSPEEARTQIMSIWDKADIIKLLLVTLGEKGCRYYTKDFHGSVETFHVDAVDTTGAGDSFVGALLNQIVDDQSVLEEEERLRKVLRIANACGAITTTKKGAIPALPTDCEALSFLKRQVEQ

SEQ ID NO: 31371 - protein, 202 aa, Prunus dulcis
  misc_feature (50)..(50): Xaa can be any naturally occurring amino acid
MASYEKQYGATPTDEYGNPIRRTDEYGNPLGHHTTTTGTTAATTGAGGYXPHDFAATTAAGQGQGVHGHDYDRKEHHGVTGAVLHRSGSSSSSSSEDDGLGGSRKKKGLKEKIKKKLPGGTKTDTTYGGTGTTGQHHQEKGTMDKIKEKLPGTGGHRADDPYPSQTHTTATTTPYGGTAYTEEHQEKKGIMDKIKEKLPGQH

SEQ ID NO: 31372 - protein, 487 aa, Streptomyces coelicolor A3(2)
MADPKGFLNHGREVARTRPVDERVKDWNEVYVPGSLLPIISKQASRCMDCGIPFCHNGCPLGNLIPEWNDYAYREDWSAASERLHATNNFPEFTGRLCPAPCESACVLGINQPPVTIKNVEVSIIDKAWETGDVAPRIPERLSGKTVAVIGSGPAGLAAAQQLTRAGHTVAVYERADRVGGLLRYGIPEFKMEKRHINRRIEQMRAEGTRFRTGVEIGRDLKATDLKKRYDAVVIAAGSTTARDLPVPGRELNGIHQAMEYLPLANKVQEGDYVAPPITAEGKHVVVIGGGDTGADCVGTAHRQGAASVTQLEIMPRPGEERDAVRQPWPTFPMLYKVTSAHEEGGERVYAVSTTHFEGDEDGNVQWLHMSEVEFVDGKLTSKPGTERKIPAQLVTLAMGFTGTDKDNGLVDQFGLELDERGNIARDADFQTNVPGVFVAGDAGRGQSLIVWAIAEGRSAARGADRFLTGASDLPAPIRPTDRALAV

SEQ ID NO: 31373 - protein, 184 aa, Kluyveromyces lactis
MHTPRLPVLTLVKTPLNKSRMSVLNGLSWVTLKEELTSTKLMKSSPKKPNLLWTAVSRLSLCIGETLEEKQQNITLQVVQRQLQAVLEKVQDWTNVVVAYEPVWAIGTGLAATAEDAQDIHHSIREFLAEKLSRDVADSVRILYGGSANGKNAVTFKDKADVDGFLVGGASLKPEFVDIINSRV

SEQ ID NO: 31374 - protein, 379 aa, Schizosaccharomyces pombe
MVADTKLYDCLEVRPEASEAELKKAYRKLALKYHPDKNPNGEKKFKEISLAYEVLSDPQRRKLYDQYGITEGNAAPPPPGAEGGPGAGFGGFPGAGPGGARTFHFNMGGPGGAQFFSASDPNDIFERVFGHAFAGGGGMGGGMGGMGGMDDDMDMDGGFGTRTRGGGMPGGFANMFGGGGAGPHARRSHPSFGGSRPSQPPAQNEVITRPLNVSLEDLFTGCTKKMKISRHIIDASGQSVKADRILEIKVKPGWKAGTKIKFAGEGDEKPDGTVQDIQFVLAEKPHPVFTRSGDDLRMQVELSLKEALLGFSKQISTIDGKKLKVSSSLPTQPGYEITYPGFGMPLPKNPSQRGNMIIECKVKFPTELTPAQKTAAEAF

SEQ ID NO: 31375 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEESALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRSAVLPANLIQAQRDYFGAHTYKRIDKEGVFHTEWLD

SEQ ID NO: 31376 - protein, 355 aa, Colletotrichum lagenarium
MSRANAPNPSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 31377 - protein, 438 aa, Azospirillum brasilense
MTMINAYAPDSAGSLPERERALIARREKLLGPAYRLFYADPIHVVRGEGSSLYDAEGNRYLDAYNNVASVGHSRPEVVEAMAKQAAVLNTHTRYLTDGILDFAEAFLAEFPAELSHLMLTCTGSEANDLALRVARVHTGGTGVVIAHNAYHGVTSALAEMSPSLGAAVKLGDHVRVVPAPDGYRMPEAEVGAAFARSVEEAIADLREKGITPAALLVDTIFSSSGVFTDPAGFLAPAVEVMRKAGGVFIADEVQPGFGRLGTHMWGFARHGLVPDIVTVGKPMGNGHPVAGAVFRPEVIEAFGKSQRYFNTFGGNPVSCAVALAVLRVIKADRLQENALTVGTEMIDGLRALAAKHELIGDVRGSGLFIGVEMVRDRKLKTPASEETARVVNGMRQRRVLISATGQEGHILKIRPPLVFSSEDATLFLATLDEVLTAL

SEQ ID NO: 31378 - protein, 452 aa, Escherichia coli
MTQRRDLQALIDAAPVGKMQWRVIICCFLVVMLDGFDTAAIGFIAPDIRTHWQLTAGDLAPLFGAGLLGLTAGALLCGPLSDRFGRKRVIELCVFLFGALSLASAFSPDLQTLVFLRFLTGLGLGGAMPNTITMTSEYLPARRRGALVTLMFCGFTLGSAVGGIVSAQLVPVIGWHGILVLGGVLPLMLFVALLVVLPESPRWQVRRQLPQAVIAKTVSAITRERYVDTQFYLIESASVTKGSIRQLFMGRQLPITLMLWVVFFMSLLIIYLLSSWMPTLLNHRGIDLQHASWVTAAFQIGGTLGALALGVLMDKFNPFRVLALSYATGAICIVMIGLSQDGLWLMALAIFGTGIGISGSQVGLNALTATLYPTQSRATGVSWSNAVGRCGAIVGSLSGGVMMAMNFSFDTLFFIIAVPAAISAVMLTLLITVVRQSTSIPDSLPHAGVVNE

SEQ ID NO: 31379 - protein, 438 aa, Streptomyces coelicolor A3(2)
MSDVTTTDLYEVTMALSYLLEDMSRPATFSLFVRDLPSERGFLVSAGIEPALDYLSAFRVTPSDVEDFASALHRPYADLSPLCGMTFTGEVRAVPEGRVVFAGEPLLEVTAPLAEAQLVETFLLNQVSHQTAVASKAVRSVLAAAGRPVVDFSLRRTHGTSAGMQAARTAALTGFAGTSNVAAAVRWGLPASGTMAHSYVEAFPDEEAAFRAFARAHPGPVTFLVDTYDSVRGVRTAARVLRDLGRGPGCAVRLDSGDLGDLARRARAELDRSGLPGVRVVASGGLDEYGVDTLVRSGAPIDVYAVGTRVGTSADAPYLDSAYKLVEYDGRPVMKLSSAKVTSPGRKQVFRRPGGDDVIALRDEPGPAGAEPLLRTVMRDGRRLGPPDTLPQGHARLTADLAGLPADAVRVRAPRPARAVFSERLSELTADLSDRLRS

SEQ ID NO: 31380 - protein, 149 aa, Daucus carota
MASYGEGGYGGQKHHGSDEYGNPVRQTDEYGNPVQHTTGGTGMHGTGATTGAHGVGLSTGSDGQPRLNRSGSSSSSSSEDDGMGGRRKKVGMKQKIKGMLPGGHKEDQQTQTTTPVMGGSYGATGTGEQPEEKKGIMDKIKDKLPGGHH

SEQ ID NO: 31381 - protein, 286 aa, Selenomonas ruminantium
MEIWFSQMDTENVKTSVRVDRQLFSRQSEYQRINVFESREFGRMIVLDGEIIFSEADEFIYNEMVVHVPMAVHPCVKNVLIIGGGDGGVAKVLTQYPEIEAIDVVEPDEMFIEVSREFFPETARGFDDDRVKITNMDGLRFLRRCRDKYDLIINDSTDPFGHTEGLFTREFYGNCYRALHDDGIMVYQHGSPFYDEDEAAFRAMHRKAYQSFPVSRVYQASIPTCPAGIWMFGFASKKYHPLKDFDAQRWNERQLETWYYTTHLHKGAFMLPKYVEDILSEEEMKK

SEQ ID NO: 31382 - protein, 319 aa, Nicotiana tabacum
MENFPIINLEKLNGSERADTMEMIKDACENWGFFELVNHGIPHEVMDTVEKMTKGHYKKCMEQRFKELVASKGLEAVQAEVTDLDWESTFFLRHLPVSNICEVPDLDDQYREVMRDFAQRLEKLAEELLDLLCENLGLEKGYLKKIFYGTQGPNFGAKVSNYPPCPQPDLIKGLRAHTDAGGIILLFQDDKVSGLQLLKDGQWIDVPPMRHSIVVNLGDQLEVITNGKYKSVMHRVITQTDGTRMSLASFYNPGSDAVIFPAPTLVEKEAEESKAIYPKFVFDDNMKLYAGLKFQAKEPRFEAMIKAMETVKSDPVATA

SEQ ID NO: 31383 - protein, 213 aa, Streptomyces griseus
MSAATSPSERRVSARIGAISESATLAVDAKAKALKAAGRPVIGFGAGEPDFPTPDYIVDAAVEACRNPKYHRYTPQRAPELKAAIAEKTLRDSGYEVDAGQILVTNGGKQAIYEAFAAILDPGDEVIVPAPYWTTYPESIRLAGGVPVEVVADETTGYRVSVEQLEAARTEKTKVVLFVSPSNPTGAVYSEADAEAIGRWAVEHGLWVMTDEI

SEQ ID NO: 31384 - protein, 320 aa, Escherichia coli
MNIWTLGDAVVDLLPLTDMQFRACAGGAPFNVAIGTAQLKCRTGFIGRVGDDDFGHFLRKTLEDSGVSTQCIQMDKYHRTSTVLVSLKDQGERGFTFLTNPSADQFLTQDALPAFSDDILHFCSLALVAADCRTTLTKAVQEVIDHGGLISFDVNLRDQMWRDKEEMFATVSQFAEKADILKLSEEEWYWLMGTHDYTEALEALKTHPARLKVVTFGARGSLVLWQDMVIHFRGFNVKSIDTTGAGDAFMAGLLASIANKGLPMNFPELQLAITQASATGALATTKKGALTALPDTAALETFINHFPLPGYEILGATATV

SEQ ID NO: 31385 - protein, 462 aa, Streptomyces avermitilis MA-4680
MANDASTVFDLVILGGGSGGYAAALRGAQLGLDVALIEKDKVGGTCLHRGCIPTKALLHAGEIADQARESEQFGVKATFEGIDVPAVHKYKDGVISGLYKGLQGLIASRKVTYIEGEGRLSSPTSVDVNGQRVQGRHVLLATGSVPKSLPGLAIDGNRIISSDHALVLDRVPESAIVLGGGVIGVEFASAWKSFGADVTVIEGLKHLVPVEDENSSKLLERAFRKRGIKFNLGTFFSKAEYTQNGVKVTLADGKEFEAEVLLVAVGRGPVSQGLGYEEQGVAMDRGYVLVDEYMRTNVPTISAVGDLVPTLQLAHVGFAEGILVAERLAGLKTVPIDYDGVPRVTYCHPEVASVGITEAKAKEIYGADKVVALKYNLAGNGKSKILNTAGEIKLVQVKDGAVVGVHMVGDRMGEQVGEAQLIYNWEALPAEVAQLIHAHPTQNEAMGEAHLALAGKPLHSHD

SEQ ID NO: 31386 - protein, 234 aa, Thermus caldophilus
MRAENPVFFLDYDGTLAPIAQRPEEAFPHPEAPRVLRALMERHPVYVVTGRRVRDLEPLLPLPGLPVVGGHGLEEGVLFGEVRPLFPVDLGPLRARLPSCPGVRVEDKGFALALHYRGAEDEEKARACLEALLKAVEGLLEALGLEALPGKKVLELKPKGVDKGQAVLRLLGRHPDHTPVYIGDDTTDEAAFLALRGRGLTFKVGEGPTAAQGRLKDVEEVLAYLQTYLRPTSL

SEQ ID NO: 31387 - protein, 266 aa, Gossypioides kirkii
LSVEEIEVAPPQKNEVRVKIHFTSLCHTDVYFWEAKGQNPLFPRILGHEAGGVVESVGEGVKDVQLGDHVLPIFTGECNECPHCLSEASNMCDLLRINTERGGMLHDGKTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHDKPVQEVIAEMTGGGVDCSIECTGSIQAMISAFECVHD

SEQ ID NO: 31388 - protein, 278 aa, Mastigocladus laminosus
MANQTPIPVIVNGAAGKMGRETIKAVVQAADMTLMGAVDTNPEYQGKDAGEVAGLNEPTEVPITDQLEPILAYVAGERHLQPGVMVDFTHPDAVYDNVRSAIAYGIRPVVGTTGLSSKQIEQLADFAEKASTGCLIIPNFSIGMVLLQQAAIAASQYFDHVEIIELHHNQKADAPSGTAIQTAQMLAEMGKTFNQPAVKETEKLPGARGSLAGEGIRIHSVRLPGLIAHQEVIFGAPGQIYTLRHDTSDRTAYMPGVLLAIRKVLQLKSLVYGLEKIL

SEQ ID NO: 31389 - protein, 166 aa, Escherichia coli
AKGDPHVLLTTSAGNIELELDKQKAPVSVQNFVDYVNSGFYNNTTFHRVIPGFMIQGGGFTEQMQQKKPNPPIKNEADNGLRNTRGTIAMARTADKDSATSQFFINVADNAFLDHGQRDFGYAVFGKVVKGMDVADKISQVPTHDVGPYQNVPSKPVVILSAKVLP

SEQ ID NO: 31390 - protein, 467 aa, Synechococcus elongatus PCC 6301
SAAGYKAGVKDYKLTYYTPDYTPKDTDLLAAFRFSPQPGVPADEAGAAIAAESSTGTWTTVWTDLLTDMDRYKGKCYHIEPVAGEENSYFAFIAYPLDLFEEGSVTNILTSIVGNVFGFKAIRSLRLEDIRFPVALVKTFQGPPHGIQVERDLLNKYGRPMLGCTIKPKLGLSAKNYGRAVYECLRGGLDFTKDDENINSQPFQRWRDRFLFVADAIHKSQAETGEIKGHYLNVTAPTCEEMMKRAEFAKELGMPIIMHDFLTAGFTANTTLAKWCRDNGVLLHIHRAMHAVIDRQRNHGIHFRVLAKCLRLSGGDHLHSGTVVGKLEGDKASTLGFVDLMREDHIEADRSRGVFFTQDWASMPGVLPVASGGIHVWHMPALVEIFGDDSVLQFGGGTLGHPWGNAPGATANRVALEACVQARNEGRDLYREGGDILREAGKWSPELAAALDLWKEIKFEFETMDKL

SEQ ID NO: 31391 - protein, 254 aa, Escherichia coli
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQHDVDGFLVGGASLKPEFVDIINAAEAAKQA

SEQ ID NO: 31392 - protein, 214 aa, Physcomitrella patens
LSDIHCTQCLPIRLSLVLSSALSKFRESVAMASAVVSTVVAPVALGGASSCVGAPSESSSVKAFSGLKSATLFSGKTQKLSSVQNGSRVQCMQVWNPIGQPKFETFSYLPPLTDDQIAKQVDYMIQQNLIPCIEFDTVGSVSRTNFSGAGSSGYYDGRYWTMWKLPMFGCTDSSQVLREIQECKSQFPSCWVRVLGFDSKKQVQICGFLVSRPN

SEQ ID NO: 31393 - protein, 502 aa, Leymus chinensis
SAIPRRGLFIGGGWREPTLGRRIPVINPATEDTIGDIPAATVEDVELAVAAARSAFLLDGGSRWSRASGATRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGADAGAPIASHPHVDKIAFTGSTATSKTIMTAAAQMVKPVSLELGGKSPLVIFDDVADIDKAVEWAMFGCFFNGGQVCSATSRLLLREKIAERFLDRLVEWAKNIKISDPLEEGCRLGSVVSKGQYEKIKKFISTARSEGATILHGGDRPKHLGKGFFIEPTIITDVSTSMQIWREEVFGPVICVKVFKTESEAIELANDTHYGLAGGVISDDLERCERIAKVIHSGIVWINCSQPTLVQAPWGGNKQSGFGRELGEWGLENYLSVKQVTRYCKDELYGWYQRPSKL

SEQ ID NO: 31394 - protein, 502 aa, Leymus chinensis
MASPAIPQRQLFIDGEWRAPALGRRLPVINPTTEASIGEIPSGTSEDVDAAVAAARAALKRNRGRDWSRAPGAVRAKYLRAIAAKMIERKADLARLEALDCGKPLDEAAWDMDDVAGCFEFFAGHAEALDKRQNAAVSLPENFKCHLKKEPIGVVSLITPWNYPLLMATWKVAPALAAGCTAVLKPSELASVTCLELADVCKEVGLPPGVLNVVTGLGPEAGAPLSSHPDVDKVAFTGSYATGQKIMVAAAPTVKAVTLELGGKSPIVVFDDVDIDKAVEWTLFGCFWTNGQICSATSRLLIHKNIAKEFVDRMVAWSKNIKVSDPLEEGCRLGPVVSEGQYEKIKKFISNAKSEGATILTGGVRPKHMEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 31395 - protein, 312 aa, Streptomyces coelicolor A3(2)
MPRRPIDITIPDLRDTRAVVTGASDGMGLGMAIRLASAGAQVVLPVRNPRKGEAALTKIRQHAPDADVSLRSLDLSSLASVAALGKTLLEEGQPIHLLLNNAGVMTPPERQATVDGFELQFGTNHLGHFALAAHLLPLLRAGQARVTSQVSIAANQHAINWDDLNWECSYNGRKAYSQSKIALGLFALELNRRSEAGGWGITSNLSHPGVAPTSLLAARPEVGRDKDTVLVRMIRAMSARGVIVGTVETAQLPALMAATSAAAKPGGFYGPSGPGHLGGPPGEQELYSRLRSADEAQRVWRTSEELTGTHLR

SEQ ID NO: 31396 - protein, 311 aa, Streptomyces coelicolor A3(2)
MTTVNHWTPGDIPDQAGRTALITGGNSGIGLETARALARHGARVILAGRSRTRLDQAAEAVRAATPEARTDTLVLDLSDLSSVRDAATRIAETETVDLLFNNGGVMNLPERRTTHDGLEMTVGTNHLGHFAFNAQVWPAVRRSPAPRVVTVSAIAARWPMGRLEDLMSEKSYRAMGAYAKSKRANIVYTLELARRTASSPVEALVVHPGAAMTNLQQHGTGPLSRMVTPIAARLLMGSAEGAAWPSLYAATSPHVQSGWFIGPAGRDQTSGTPRPAKLPTGADDPAEGRRLWAASEQLTGVPFDIEAEAAV

SEQ ID NO: 31397 - protein, 274 aa, Zymomonas mobilis subsp. pomaceae
MSRIANTFAKTKKENRAALIAFLTAGDPSIEATPALLDSLVENGVDIIELGMPFSDPMADGPAIQKANLRALAAKTGYNDIFRIATEFRKRHPETPLILMGYANPMTFKGSDSFAASAKDAGVDGIICVDIPPEEDATLGVAVREKGMDMIRLATPTSDEARLKIILDGASGFLYYVSVAGVTGLQQATEASIDAALDRIKSVTDLPVAVGFGIRSPEQAAAIAKKADAVVVGSAFVSCIEKAVTNRQDPNAALEKLAKELSTAISDARKEAAL

SEQ ID NO: 31398 - protein, 440 aa, Staphylococcus aureus subsp. aureus COL
MKTYDLIVIGFGKAGKTLAKYAASTGQHVAVIEQSPKMYGGTCINIGCIPSKTLVHDGLEGKSFEASYNRKNDVVNALNNKNYHLLADDNNIDVLDFKAQFKSNTEVNLLDQHDDIVDSITAPHIIINTGATSVIPNIKGLDQAKHVFDSTGLLNISYQPKHLVIVGGGYIALEFASMFANLGSKVTVLERGESFMPREDQDVVAYGITDLENKGIALHTNVETTELSSDNHHTTVHTNVDNFEADAVLLAIGRKPNTDLALENTDIELGDRGEIKVNAHLQTTVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDNIYTHPTMAESFNDLFNF

SEQ ID NO: 31399 - protein, 312 aa, Staphylococcus aureus subsp. aureus COL
MKQFVNLGKSDVEVFPIALGTNAVGGHNLYPNLDEEQGKDVVRQAINHGINLLDTAYIYGPERSEELVGEVVKEYPREQIKIATKGSHEFDENQEVHQNNQPEYLKQQVENSLKRLQTDYIDLYYIHFPDNNTPKDQAVAALQELKEQGKIKAIGVSNFTLDQLKEANKDGYVDVVQLEYNLLHRENEAVLQYCVDHQITFIPYFPLASGILAGKYDENTKFSDHRTTRRDFKPGVFEENVRRVKALESIAAAHQTSIANIVLAFYLTRPAIDVIIPGAKRAEQVVENIKAADIVLSDDEIQYIDELFPIED

SEQ ID NO: 31400 - protein, 505 aa, Staphylococcus aureus subsp. aureus COL
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 31401 - protein, 446 aa, Staphylococcus aureus subsp. aureus COL
MPKRTFTKDDIRKFAEEENVRYLRLQFTDILGTIKNVEVPVSQLEKVLDNEMMFDGSSIEGFVRIEESDMYLHPDLDTWVIFPWTAGQGKVARLICDVYKTDGTPFEGDPRANLKRVLKEMEDLGFTDFNLGPEPEFFLFKLDEKGEPTLELNDDGGYFDLAPTDLGENCRRDIVLELEDMGFDIEASHHEVAPGQHEIDFKYADAVTACDNIQTFKLVVKTIARKHNLHATFMPKPLFGVNGSGMHFNVSLFKGKENAFFDPNTEMGLTETAYQFTAGVLKNARGFTAVCNPLVNSYKRLVPGYEAPCYIAWSGKNRSPLIRVPSSRGLSTRIEVRSVDPAANPYMALAAILEAGLDGIKNKLKVPEPVNQNIYEMNREEREAVGIQDLPSTLYTALKAMRENEVIKKALGNHIYNQFINSKSIEWDYYRTQVSEWERDQYMKQY

SEQ ID NO: 31402 - protein, 484 aa, Staphylococcus aureus subsp. aureus COL
MEDNKMNRSLNSRHISMIAIGGAIGTGLFVATGNIISQAGPGGAILAYLVIGVMLYFLMSSIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHTYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPQFLSKLNKTTKLPLRALLTTYAVVVIVIIYANFNSNAVFNLLEIIGSMIIVVWGSSIWSQIRLRQAIKKQGQDPNKVLPYKAPFYPLGPIIVITTLLFLLFGGSVEYILKDQWLNAFKNFLPLIILALIYFIHKIIHKTKFVKLETINLKPHDYDNQK

SEQ ID NO: 31403 - protein, 242 aa, Staphylococcus aureus subsp. aureus COL
MTKLFIPYIMGNKDLIENATLLSENGADIIEIGVPFSDPVADGPVIMEAGQQAIKQGITIDYIFNQLEKHGDQIKCNYVLMTYYNIICHYGEQAFFEKCRDTGVYGLIIPDLPYELSQRLKQQFSHYGVKIISLVAMTTDDKRIKDIVSHAEGFIYTVTMNATTGQNGAFHPELKRKIESIKAIANVPVVAGFGIRTPQHVADIKEVADGIVIGSEIVKRFKSNTREEIIKYLQSIQQTLNN

SEQ ID NO: 31404 - protein, 440 aa, Staphylococcus aureus subsp. aureus COL
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAS

SEQ ID NO: 31405 - protein, 302 aa, Staphylococcus aureus subsp. aureus COL
MQKNILKSGISLSELGLGCMSLGTDLKKAEQIIDCAVENGITYFDTADMYDKGINESVVGKALLKYQQRDDIFIGTKVGNRLTKDGSTTWDPSKSYIKEAVKGSLKRLGIDHIDLYQLHGGTIDDPLDETISAFDELKQEGIIRAYGISSIRPNVIDYYLKHSQIETIMSQFNLIDNRPESLLDAIHNNDVKVLARGPVSKGLLTSNSVNVLDNKFKDGIFDYSHDELGETIASIKEIESNLSALTFSYLTSHDVLGSIIVGASSVDQLKENIENYHTKVSLDQIKTARARVKDLEYTNHLV

SEQ ID NO: 31406 - protein, 473 aa, Staphylococcus aureus subsp. aureus COL
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDTNEGYSEMVIDQSTEEIVGINMIGPHVTELINEASLLQFMNGSALELGLTTHAHPSISEVLMELGLKAESRAIHV

SEQ ID NO: 31407 - protein, 428 aa, Staphylococcus aureus subsp. aureus COL
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 31408 - protein, 497 aa, Staphylococcus aureus subsp. aureus COL
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 31409 - protein, 453 aa, Staphylococcus aureus subsp. aureus COL
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 31410 - protein, 492 aa, Staphylococcus aureus subsp. aureus COL
MDFWLYKQAQQNGHHIAITDGQESYTYQNLYCEASLLAKRLKAYQQSRVGLYIDNSIQSIILIHACWLANIEIAMINTRLTPNEMTNQMKSIDVQLIFCTLPLELRGFQIVSLDDIEFAGRDITTNSLLDNTMGIQYETSNETVVPKESPSNILNTSFNLDDIASIMFTSGTTGPQKAVPQTFRNHYASAIGCKESLGFDRDTNWLSVLPIYHISGLSVLLRAVIEGFTVRIVDKFNAEQILTMIKNERITHISLVPQTLNWLMQQGLHEPYNLQKILLGGAKLSATMIETALQYNLPIYNSFGMTETCSQFLTATPEMLHARPDTVGMPSANVDVKIKNPNKEGHGELMIKGANVMNVYLYPTDLTGTFENGYFNTGDIAEIDHEGYVMIYDRRKDLIISGGENIYPYQIETVAKQFPGISDAVCVGHPDDTWGQVPKLYFVSESDISKAQLIAYLSQHLAKYKVPKHFEKVDTLPYTSTGKLQRNKLYRG

SEQ ID NO: 31411 - protein, 489 aa, Staphylococcus aureus subsp. aureus COL
MYQLEDDSLMLHNDLYQINMAESYWNDNIHEKMAVFDLYFRKMPFNSGYAVFNGLKRVIDFIEHFGFSESDLEYLKSIGYKDDFLSYLKDLKFTGSIRSMQEGELCFGNEPLLRVEAPLIQAQLIETILLNIVNFHTLITTKASRIRQIASNDKLMEFGTRRAQEIDAALWGARAAYIGGFDSTSNVRAGKLFGIPVSGTHAHAFVQTYGDEYVAFKKYAERHKNCVFLVDTFHTLKSGVPNAIKVAKELGDKINFVGIRLDSGDIAYLSKEARRMLDEAGFTETKIIASNDLDEETITSLKAQGAKVDSWGVGTKLITGYDQPALGAVYKLVAIENEDGSYSDRIKLSNNAEKVTTPGKKNVYRIINKKTGKAEGDYITLENENPYDEQPLKLFHPVHTYKMKFIKSFEAIDLHHNIYENGKLVYQMPTEDESREYLALGLQSIWDENKRFLNPQEYPVDLSKACWDNKHKRIFEVAEHVKEMEEDNE

SEQ ID NO: 31412 - protein, 264 aa, Staphylococcus aureus subsp. aureus COL
MQLYYLGPKGTFSYLACRQYFSENEATFQPKSNFFEVIKAVADDDTSIGVVPIENSIEGTINIVADALAQQDVFAHGEIRLDINFALYGNGTDSISDIKKVYSIAPAISQTTNYIHQHQFDYDYVDSTIQSLTKIENGVAAIAPLGSGEAYGFTPIDTHIEDYPHNVTRFLVIKNQQQFDQNATSLMFLITPMHDKPGLLASVLNTFALFNINLSWIESRPLKTQLGMYRFFVQADSAITTDIKKVIAILETLDFKVEMIGAFN

SEQ ID NO: 31413 - protein, 459 aa, Staphylococcus aureus subsp. aureus COL
MNIIEQKFYDSKAFFNTQQTKDISFRKEQLKKLSKAIKSYESDILEALYTDLGKNKVEAYATEIGITLKSIKIARKELKNWTKTKNVDTPLYLFPTKSYIKKEPYGTVLIIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYIFKSTRLESGVHLPPYKGKFKYIKAFFKN

SEQ ID NO: 31414 - protein, 319 aa, Staphylococcus aureus subsp. aureus COL
MRRLFSIGEALIDFIPNVTNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 31415 - protein, 470 aa, Staphylococcus aureus subsp. aureus COL
MTKTLPEDFIFGGATAAYQAEGATNTDGKGRVAWDTYLEENYWYTAEPASDFYDRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 31416 - protein, 459 aa, Staphylococcus aureus subsp. aureus COL
MENNELQRGLSARQIQMIALGGTIGVGLFMGATSTIKWTGPSVILAYLIAGIFLFLIMRAMGEMIYLNPTTGSFATFASDYIHPAAGYMTAWSNIFQWIVVGMSEVIAVGEYMKFWFPELPTWIPGVIAILLLMAANLFSVKAFGEFEFWFALIKVVTIILMIIAGFGLIFFGFGNGGHAVGISNLWTNGGFMPNGIVGFFFALSIVIGSYQGVELIGITAGETKDPQKNIVKAVNGVIWRILIFYLGAIFVIVSVYPWNQLGDIGSPFVATFAKIGITFAAGLINFVVLTAAMSGCNSGIFSASRMIYTLAHKGEMPKIFTKIMRNGVPLYTVVAVSLGILIGALLNVILPLYIDGAKSIFVYVYSASILPGMIPWFMILFSHLRFRKLHPEELEGHPFKMPGGAVTNYLTILFLILVLVGMVFNVETRISVLIGVIFLTIVTIYYFIRYNKNNVKAK

SEQ ID NO: 31417 - protein, 305 aa, Staphylococcus aureus subsp. aureus COL
MFQKLSIFATKSFLVWMLVAAVIGFIFPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFVSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 31418 - protein, 389 aa, Staphylococcus aureus subsp. aureus COL
MYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVVMIIGAIILGISDHIALFTVGCLTISICAGIGNGLIFKLVPSYFLNEAGSANGIVSMMGGLGGFFPPLVITYVANLTGSSHLAFIFLAVFGCIALFTMRHLYQKEYGSLKNG

SEQ ID NO: 31419 - protein, 243 aa, Staphylococcus aureus subsp. aureus COL
MIQLTNIHKSFNDVEVIKGIDLSVEQGEVVTLIGRSGSGKTTLLRMINALEIPTEGTVYVNGKTYTSKDKKSQIEVRKQSGMVFQSYNLFPHKTALENVMEGLITVKKLKKDEARGKSLELLEKVGLTHVKDQRPHALSGGQQQRVAIARALAMNPKVMLFDEPTSALDPELVNDVLKVIKDLANEGMTMVIVTHEMRFAKEVSNNIVFIHEGMIGEQGAPEEMFNRPKTEELRRFLNVINEE

SEQ ID NO: 31420 - protein, 228 aa, Staphylococcus aureus subsp. aureus COL
MPKLILCRHGQSEWNAKNLFTGWEDVNLSEQGINEATRAGEKVRENNIAIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 31421 - protein, 452 aa, Staphylococcus aureus subsp. aureus COL
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSKKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 31422 - protein, 495 aa, Staphylococcus aureus subsp. aureus COL
MAVNVRDYIAENYGLFINGEFVKGSSDETIEVTNPATGETLSHITRAKDKDVDHAVKVAQEAFESWSLTSKSERAQMLRDIGDKLMAQKDKIAMIETLNNGKPIRETTAIDIPFAARHFHYFASVIETEEGTVNDIDKDTMSIVRHEPIGVVGAVVAWNFPMLLAAWKIAPAIAAGNTIVIQPSSSTPLSLLEVAKIFQEVLPKGVVNILTGKGSESGNAIFNHDGVDKLSFTGSTDVGYQVAEAAAKHLVPATLELGGKSANIILDDANLDLAVEGIQLGILFNQGEVCSAGSRLLVHEKIYDQLVPRLQEAFSNIKVGNPQDEATQMGSQTGKDQLDKIQSYIDAAKESDAQILAGGHRLTENGLDKGFFFEPTLIAVPDNHHKLAQEEIFGPVLTVIKVKDDQEAIDIANDSEYGLAGGVFSQNITRALNIAKAVRTGRIWINTYNQVPEGAPFGGYKKSGIGRETYKGALSNYQQVKNIYIDTSNALKGLY

SEQ ID NO: 31423 - protein, 394 aa, Staphylococcus aureus subsp. aureus COL
MNSIIELTDYYSSNNYAPLKLVISKGKGVKVWDTDGKQYIDCISGFSVANQGHCHPTIVKAMTEQASKLSIISRVLYSDNLGKWEEKICHLAKKDKVLPLNSGTEAVEAAIKIARKWGSEVKGITDGQVEIIAMNNNFHGRTLGSLSLSNHDAYKAGFHPLLQGTTTVDFGDIEQLTQAISPNTAAIILEPIQGEGGVNIPPKGYIQAVRQLCDKHQILLIADEIQVGLGRTGKWFAMEWEQVVPDIYILGKALGGGLYPVSAVLANNDVMRVLTPGTHGSTFGGNPLAIAISTAALDVLKDEQLVERSERLGSFLLKALLQLKHPSIKEIRGRGLFIGIELNTDAAPFVDQLIQRGILCKDTHRTIIRLSPPLVIDKEEIHQIVAAFQDVFKN

SEQ ID NO: 31424 - protein, 304 aa, Staphylococcus aureus subsp. aureus COL
MITYDLIGNTPLVLLEHYSDDKVKIYAKLEQWNPGGSVKDRLGKYLVEKAIQEGRVRAGQTIVEATAGNTGIGLAIAANRHHLKCKIFAPYGFSEEKINIMIALGAEVSRTSQSEGMHGAQLAARSYAEKYGAVYMNQFESEHNPDTYFHTLGPELTSALQQIDYFVAGIGSGGTFTGTARYLKQHHVQCYAVEPEGSVLNGGPAHAHDTEGIGSEKWPIFLERRLVDGIFTIKDQDAFRNVKSLAINEGLLVGSSSGAALQGALNLKAQLSEGTIVVVFPDGSDRYMSKQIFNYEENNNEQEN

SEQ ID NO: 31425 - protein, 341 aa, Staphylococcus aureus subsp. aureus COL
MIEFRQVSKTFNKKKQKIDALKDVSFTVNRNDIFGVIGYSGAGKSTLVRLVNHLEAASNGQVIVDGHDITNYSDKMMRDIKKDIGMIFQHFNLLNSATVFKNVAMPLILSKKSKTEIKQRVTEMLEFVGLSDKKDQFPDELSGGQKQRVAIARALVTNPKILLCDEATSALDPATTASILTLLKNVNQTFGITIMMITHEMRVIKDICNRVAVMEKGKVVETGTVKEVFSHPKTTIAQNFVSTVIQTEPSTSLIRRLNDEQVGDFKDYKIFVEETQVTQPIINDLIQICGREVKILFSSMSEIQGNTVCYMWLRFNMDQQFEDTAINQYFKEKNIQFEEVH

SEQ ID NO: 31426 - protein, 487 aa, Staphylococcus aureus subsp. aureus COL
MGEFKGFMKYDKQYLGELSLVDRLKHHKAYQQRFTKEDASIQGARCMDCGTPFCQTGQQYGRETIGCPIGNYIPEWNDLVYHQDFKTAYERLSETNNFPDFTGRVCPAPCESACVMKINRESIAIKGIERTIIDEAFENGWVAPKVPSRRRDEKVAIVGSGPAGLAAAEELNLLGYQVTIYERARESGGLLMYGIPNMKLDKDVVRRRIKLMEEAGITFINGVEVGVDIDKATLESEYDAIILCTGAQKGRDLPLEGRMGDGIHFAMDYLTEQTQLLNGEIDDITITAKDKNVIIIGAGDTGADCVATALRENCKSIVQFNKYTKLPEAITFTENASWPLAMPVFKMDYAHQEYEAKFGKEPRAYGVQTMRYDVDDKGHIRGLYTQILEQGENGMVMKEGPERFWPADLVLLSIGFEGTEPTVPNAFNIKTDRNRIVADDTNYQTNNEKVFAAGDARRGQSLVVWAIKEGRGVAKAVDQYLASKVCV

SEQ ID NO: 31427 - protein, 454 aa, Staphylococcus aureus subsp. aureus COL
MAKKKVIFECMACGYQSPKWMGKCPNCGAWNQMEEIVEKAANPKHGVKTKELAGKVQKLNSIKHETTPRVLTDSAEFNRVLGGGIVSGSLVLIGGDPGIGKSTLLLQICASLSQKKKVLYITGEESLSQTKLRAERLDEDSSELQVLAETDLEVIYQTVKEEQPDLLVVDSIQTIYHPEISSAPGSVSQVRESTQSLMNIAKQMNIATFIVGHVTKEGQIAGPRLLEHMVDTVLYFEGDEHHAYRILRAVKNRFGSTNEMGIFEMKQSGLKGVNNPSEMFLEERSTNVPGSTIVATMEGTRPLLIEVQALVTPTTFNNPRRMATGIDHNRLSLLMAVLEKKENYLLQQQDAYIKVAGGVKLTEPAVDLSVIVATASSFKDKAVDGLDCYIGEVGLTGEVRRVSRIEQRVQEAAKLGFKRVIIPKNNIGGWTYPEGIQVIGVTTVHEVLSFALHS

SEQ ID NO: 31428 - protein, 458 aa, Staphylococcus aureus subsp. aureus COL
MNVILEQLKTHTQNKPNDIALHIDDETITYSQLNARITSAVESLQKYSLNPVVAINMKSPVQSIICYLALHRLHKVPMMMEGKWQSTIHRQLIEKYGIKDVIGDTGLMQNIDSPMFIDSTQLQHYPNLLHIGFTSGTTGLPKAYYRDEDSWLASFEVNEMLMLKNENAIAAPGPLSHSLTLYALLFALSSGRTFIGQTTFHPEKLLNQCHKISSYKVAMFLVPTMIKSLLLVYNNEHTIQSFFSSGDKLHSSIFKKIKNQANDINLIEFFGTSETSFISYNLNQQAPVESVGVLFPNVELKTTNHDHNGIGTICIKSNMMFSGYVSEQCINNDEWFVTNDNGYVKEQYLYLTGRQQDMLIIGGQNIYPAHVERLLTQSSSIDEAIIIGIPNERFGQIGVLLYSGDVTLTHKNVKQFLKKKVKRYEIPSMIHHVEKMYYTASGKIAREKMMSMYLRGEL

SEQ ID NO: 31429 - protein, 494 aa, Staphylococcus aureus subsp. aureus COL
MEKKNKQIDRGDLKQNLSEKFVWAIAYGSCIGWGAFIIPGDWIKQSGPIAASIGIVIGALLMILIAVSYGALVERFPVSGGAFAFSFLSFGRYVSFFSSWFLTFGYVCVVALNATAFSLLVKFLLPDVLNNGKLYTIAGWDVYITEIIIATVLLLVFMLVTIRGASVSGSLQYYFCVAMVIVVLLMFFGSFFGNNFALENLQPLAEPSKGWLVSIVVIVSVAPWAYVGFDNIPQTAEEFNFAPNKTFKLIVYSLLAASLTYVVMILYTGWLSTSHQSLNGQLWLTGAVTQTAFGYIGLGVLAIAIMMGIFTGLNGFLMSSSRLLFSMGRSGIMPTMFSKLHSKYKTPYVAIIFLVGVSLIAPWLGRTALTWIVDMSSTGVSIAYFITCLSAAKLFSYNKQSNTYAPVYKTFAIIGSFVSFIFLALLLVPGSPAALTAPSYIALLGWLIIGLIFFVIRYPKLKNMDNDELSRLILNRSENEVDDMIEEPEKEKTK

SEQ ID NO: 31430 - protein, 302 aa, Staphylococcus aureus subsp. aureus COL
MEQIMINHYVHFSRLVQGFWRANEWKMTAKELNYFINELVERGITTMDHADIYGDYQCESLFGNALDLSPELRNKIQIVTKCGIILPSKQFDFTNGHRYDLSSKHIVKSVEQSLINLNVDYLDSLLIHRPSPLMDPEQVADALTKLVKQGKLKSFGVSNFNHSQYQLLNQYIMKERLHISINQLELSPYHVDSLQDGTMDSMYQNHVQIMAWSPFAGGKIFDKEDIKAQRIMKVVQSIADKYGVSDTAVMIAWLVKIPHRIMPILGTSQLKRIDQAIEGLQLNLDDQSWFDIYTAIIGQDIP

SEQ ID NO: 31431 - protein, 319 aa, Staphylococcus aureus subsp. aureus COL
MVKIVVSRKIPDKFYQQLSKLGDVVMWQKSLVPMPKDQFVTALRDADACFITLSEQIDAEILAQSPNLKVIANMAVGYDNIDVESATANNVVVTNTPNVLTETTAELGFTLMLAIARRIVEAEKYVEADAWQSWGPYLLSGKDVFNSTIGIYGMGDIGKAFARRLQGFNTNILYHNRSRHKDAEADFNATYVSFETLLAESDFIICTAPLTKETHHKFNAEAFEQMKNDAIFINIGRGQIVDETALIDALDNKEILACGLDVLANEPIDHTHPLMGRDNVLITPHIGSASVTTRDNMIQLCINNIEAVMTNQVPHTPVN

SEQ ID NO: 31432 - protein, 375 aa, Staphylococcus aureus subsp. aureus COL
MKSKYEPLFDKVELPNGVELRNRFVLAPLTHISSNDDGTISDVELPYIEKRSQDVGITINAASNVSDVGKAFPGQPSIAHDSNIEGLKRLATAMKKNGAKALVQIHHGGAQALPELTPDGDVVAPSPISLKSFGQKQEHSAREMTNEEIEQAIKDFGEATRRAIEAGFDGVEIHGANHYLIHQFVSPYYNRRNDVWANQYKFPVAVIEEVLKAKEAYGNKDFIVGYRLSPEEAESPGITMEITEELVNKISHMPIDYIHVSMMDTHATTREGKYAGQERLPLIHKWINGRMPLIGIGSIFTADEALDAVENVGVDLVAIGRELLLDYQFVEKIKDGREDEIINYFDPEREDNHHLTPNLWHQFNEGFYPLPRKDK

SEQ ID NO: 31433 - protein, 396 aa, Staphylococcus aureus subsp. aureus COL
MTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINENTAAVLVEPIQGEAGINIPPEGYLKAIRELCDEHNVLFIADEIQAGLGRSGKLFATDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 31434 - protein, 492 aa, Staphylococcus aureus subsp. aureus COL
MKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYQEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPATVAVKHMNPCGVGIGDTIEQAFQHAYEADSQSIFGGIVALNRAVTPELAEQLHSIFLEVIIAPKFTDEALDILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 31435 - protein, 272 aa, Staphylococcus aureus subsp. aureus COL
MNVYLAEFLGTAILILFGGGVCANVNLKRSAANGADWIVITAGWGLAVTMGVFAVGQFSGAHLNPAVSLALALDGSFDWSLVPGYIVAQMLGAIVGATIVWLMYLPHWKATEEAGAKLGVFSTAPAIKNYFANFLSEIIGTMALTLGILFIGVNKIADGLNPLIVGALIVAIGLSLGGATGYAINPARDLGPRIAHAILPIAGKGGSNWSYAIVPILGPIAGGLLGAVVYAVFYKHTFNIGCAIAIVVVIITLILGYILNKSSKKGDIESIY

SEQ ID NO: 31436 - protein, 379 aa, Staphylococcus aureus subsp. aureus COL
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINEQPSNFKDRAKRFFKGE

SEQ ID NO: 31437 - protein, 389 aa, Staphylococcus aureus subsp. aureus COL
MQQHSSKTAYVYSDKLLQYRFHDQHPFNQMRLKLTTELLLNANLLSPEQIVQPRIATDDELMLIHKYDYVEAIKHASHGIISEDEAKKYGLNDEENGQFKHMHRHSATIVGGALTLADLIMSGKVLNGCHLGGGLHHAQPGRASGFCIYNDIAITAQYLAKEYNQRVLIIDTDAHHGDGTQWSFYADNHVTTYSIHETGKFLFPGSGHYTERGEDIGYGHTVNVPLEPYTEDASFLECFKLTVEPVVKSFKPDIILSVNGVDIHYRDPLTHLNCTLHSLYEIPYFVKYLADSYTNGKVIMFGGGGYNIWRVVPRAWSHVFLSLIDQPIQSGYLPLEWINKWKHYSSELLPKRWEDRLNDYTYVPRTKEISEKNKKLALHIASWYESTRQ

SEQ ID NO: 31438 - protein, 429 aa, Staphylococcus aureus subsp. aureus COL
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIKQTLKAADYAFSQMK

SEQ ID NO: 31439 - protein, 475 aa, Staphylococcus aureus subsp. aureus COL
MRDYTKQYINGEWVESNSNETIEVINPATEEVIGKVAKGNKADVDKAVEAADDVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPNKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 31440 - protein, 302 aa, Staphylococcus aureus subsp. aureus COL
MTKTKAIDIIGAPSTFGQRKLGVDLGPTAIRYAGLISRLKQLDLDVYDKGDIKVPAVNIEKFHSEQKGLRNYDEIIDVNQKLNKEVSASIENNRFPLVLGGDHSIAVGSVSAISKHYNNLGVIWYDAHGDLNIPEESPSGNIHGMPLRILTGEGPKELLELNSNVIKPENIVLIGMRDLDKGERQFIKDHNIKTFTMSDIDKLGIKEVIENTIEYLKSRNVDGVHLSLDVDALDPLETPGTGTRVLGGLSYRESHFALELLHQSHLISSMDLVEVNPLIDSNNHTAEQAVSLVGTFFGETLL

SEQ ID NO: 31441 - protein, 333 aa, Staphylococcus aureus subsp. aureus COL
MKMIGFEKPFKLEEGNLFKVYEQRKPTPENDDILVKVNSISVNPVDTKQRQMEVTQAPRVLGFDAIGTVEAIGPDVTLFSPGDVVFYAGSPNRQGSNATYQLVSEAIVAKAPHNISANEAVSLPLTGITAYETFFDTFKISTNPAENEGKSVLIINGAGGVGSIATQIAKRYGLTVITTASRQETTEWCEKMGADIVLNHKEDLVRQFKEIPLVDYIFCTYNTDLYYNTMIELIKPLGHITTIVAFNEDQDLNALKLKSITFTHEFMFARPIHRTPDMIKQHEYLEDITKNIESGHYQPTTTQVFEGLSPENLYQAHQLLEKQSMIGKLVINI

SEQ ID NO: 31442 - protein, 317 aa, Staphylococcus aureus subsp. aureus COL
MEKVYVAGAIPEVGLKLLQEHFEVEMYEGKGLVDKDTLIKGVKNATALISLLSTNVDKDVIDAGKDLKIIANYGAGFNNIDIEYAREKSIDVTNTPKASTNATADLTIGLVLAVARRIVEGDQLSRTTGFDGWAPLFFRGREVSGKTIGIIGLGEIGSAVARRARAFDMDVLYTGPNRKEEKEREIGAKYVDLDTLLKNADFITINAAYNPKMHHLIDTEQFKMMKSTAYLINASRGPIVHEQALVQALKDNEIEGAALDVYEFEPDITDDLKSLNNVVLTPHIGNATFEARDMMSKIVANAAISAVQGEKPQFVVN

SEQ ID NO: 31443 - protein, 384 aa, Staphylococcus aureus subsp. aureus COL
MISNKLANIPDSYFGKTMGRKIEHGPLPLINMAVGIPDGPTPQGIIDHFQKALTIPENQKYGAFHGKEAFKQAIVDFYQRQYNVTLDKEDEVCILYGTKNGLVAVPTCVINPGDYVLLPDPGYTDYLAGVLLADGKPVPLNLEPPHYLPDWSKVDSQIIDKTKLIYLTYPNNPTGSTATKEVFDEAIAKFKGTDTKIVHDFAYGAFGFDAKNPSILASENGKDVAIEIYSLSKGYNMSGFRVGFAVGNKDMIQALKKYQTHTNAGMFGALQDAAIYALNHYDDFLEEQSNVFKTRRDRFEAMLAKADLPFVHAKGGIYVWLETPPGYDSEQFEQFLVQEKSILVAPGKPFGENGNRYVRISLALDDQKLDEAAIRLTELAYLYE

SEQ ID NO: 31444 - protein, 445 aa, Staphylococcus aureus subsp. aureus COL
MSKAHQLIQEDEHYFAKSGRIKYYPLVIDHGYGATLVDIEGKTYIDLLSSASSQNVGHAPREVTEAIKAQVDKFIHYTPAYMYHEPLVRLAKKLCEIAPGDFEKRVTFGLTGSDANDGIIKFARAYTGRPYIISFTNAYHGSTFGSLSMSAISLNMRKHYGPLLNGFYHIPFPDKYRGMYEQPQANSVEEYLAPLKEMFAKYVPADEVACIVIETIQGDGGLLEPVPGYFEALEKICREHGILIAVDDIQQGFGRTGTWSSVSHFNFTPDLITFGKSLAGGMPMSAIVGRKEIMNCLEAPAHLFTTGANPVSCEAALATIQMIEDQSLLQASAEKGEYVRKRMDQWVSKYNSVGDVRGKGLSIGIDIVSDKKLKTRDASAALKICNYCFEHGVVIIAVAGNVLRFQPPLVITYEQLDTALNTIEDALTALEAGNLDQYDISGQGW

SEQ ID NO: 31445 - protein, 496 aa, Staphylococcus aureus subsp. aureus COL
MELLKHLSQRQYIDGEWVESANKNTRDIINPYNQEVIFTVSEGTKEDAERAILAARRAFESGEWSQETAETRGKKVRAIADKIKEHREALARLETLDTGKTLEESYADMDDIHNVFMYFAGLADKDGGEMIDSPIPDTESKIVKEPVGVVTQITPWNYPLLQASWKIAPALATGCSLVMKPSEITPLTTIRVFELMEEVGFPKGTINLILGAGSEVGDVMSGHKEVDLVSFTGGIETGKHIMKNAANNVTNIALELGGKNPNIIFDDADFELAVDQALNGGYFHAGQVCSAGSRILVQNSIKDKFEQALIDRVKKIKLGNGFDADTEMGPVISTEHRNKIESYMDVAKAEGATIAVGGKRPDRDDLKDGLFFEPTVITNCDTSMRIVQEEVFGPVVTVEGFETEQEAIQLANDSIYGLAGAVFSKDIGKAQRVANKLKLGTVWINDFHPYFAQAPWGGYKQSGIGRELGKEGLEEYLVSKHILTNTNPQLVNWFSK

SEQ ID NO: 31446 - protein, 165 aa, Staphylococcus aureus subsp. aureus COL
MNNRNVYDIEVSDYKGLTYKLEAFRGKVILVVNTATECIYSEQLKKLETLFQKYKDRGFVVLSFPNNNFDNRQPGSNEEILKISREKFGVTFPVLAKISVNGNDEHPLFTHLKNEQPGIFGSPIKWNFTKFIIDRQGNVVNRFLPMEDPLDISTNIEILLQESSS

SEQ ID NO: 31447 - protein, 315 aa, Staphylococcus aureus subsp. aureus COL
MLDSVGQTPMVQLHQLFPKHEVFAKLEYMNPGGSMKDRPAKYIIEHGIKHGLITENTHLIESTSGNLGIALAMIAKIKGLKLTCVVDPKISPTNLKIIKSYGANVEMVEEPDAHGGYLMTRIAKVQELLATIDDAYWINQYANELNWQSHYHGAGTEIVETIKQPIDYFVAPVSTTGSIMGMSRKIKEVHPNAQIVAVDAKGSVIFGDKPINRELPGIGASRVPEILNRSEINQVIHVDDYQSALGCRKLIDYEGIFAGGSTGSIIAAIEQLITSIEEGATIVTILPDRGDRYLDLVYSDTWLEKMKSRQGVKSE

SEQ ID NO: 31448 - protein, 501 aa, Staphylococcus aureus subsp. aureus COL
MNFDWIKTRSDFDDDKPAVIDHAKQTSWTYQQLNARADNMAHYLTSQGVKKGDVIGIFAPNDIAILDLLFACFKTGAVFLPLNWRLNPKEIAAIVEDAQLKLLFYAEKHLSSLTDIDQNLLHMDIDVAQYDEIVNPDYHQPFQATPVEPQDLAALIYTSGTTGSPKGVMFSYESFVHNGANLELTYKFNSNYITIVSTPMFHVLGFNDTVLPVLMSGGTLILQRYFNGEELNDMIAQYHPTFIIMIPTMYYSTLRASNFNPENFRAMDYIIQGGSQPLPSIQAAFKQYGINIINGYGLTEAPLVLVNTPENSKRKPMSIGKAVMFVDARILDDNGEEVPTGEIGELAIKAKNVTPGYWNKPAETAKAFHGRYLLTGDLAKMDNDGDIFIIDRKKELIITGGENVLPSEVENALAEHPLVDRCVVVGYDHPKYGESIAAAIILREDEPHYAEILNQHMRSRLAGYKVPRMYVPVTHMPLNSTQKPDKLAIRQMMNDKVSQTL

SEQ ID NO: 31449 - protein, 478 aa, Staphylococcus aureus subsp. aureus COL
MTKLPQNFMWGGALAANQFEGGYDKGGKGLSVIDVMTSGAHGKARQITESIDPNHYYPNHEGIDFYHRYKEDIALFKEMGLKCLRTSIAWTRIFPNGDEDVPNEEGLAFYDRIFDELIAQGIEPVVTLSHFEMPLHLAKHYGGFRNREVVDYFVHFARVVFERYKDKVTYWMTFNEINNQMDTSNPIFLWTNSGVALTENDNPEEVLYQVAHHELLASALAVRLGKEINPKFKIGTMISHVPIYPYSCHPKDMMEAQIANRLRFFFPDVQVRGYYPSYAKKMLARKGYDVGWQEGDDSILQQGTVDYIGFSYYMSTAVKHDVDTTVENNIVNGGLNHSVENPHIATSDWGWAIDPDGLRYTLNVLYDRYQLPLFIVENGFGAVDEVVDGHIHDDYRIEYLKAHITAAIEAVDQDGVDLIGYTPWGIIDIVSFTTGEMKKRYGLIYVDRDNDGHGTMERLKKDSFYWYQQVIASNGDKL

SEQ ID NO: 31450 - protein, 399 aa, Staphylococcus aureus subsp. aureus COL
MYRYKPLLQSIHLPNGIKISNRFVLSPMTVNTSTKEGYITKEDLAYAARRSNSAGMQVTGAAYIEPYGQLFEYGFNIDHDACIPGLTNMASTMKQHGSLAIIQLAHAGRFSNQAILNFGKVYGPSPMTLHSPIEHDVIAMSHEKINSIIQQYRDATLRAIKAGFDGVEISIAQRLLIQTFFSTFSNKRTDHYGADSLKNRARLCLEVMRAVQEVIDKEAPDNFILGFRATPEETRGSDLGYTIDEFNQLINWVMDVSNIQYLAIASWGRHIYQNTSRTPGDHFGRPVNQIVYEHLAGRIPLIASGGINSPESALDALQHADMVGMSSPFVTEPDFVHKLAEQRPHDINLEFSMADLEDLAIPHAAFKDIVKMMDYGEGLKKHTRDALRQLEQNYHDSSS

SEQ ID NO: 31451 - protein, 341 aa, Staphylococcus aureus subsp. aureus COL
MNNKVLATGGTGFVGMRIISRLLEQGYDVQTTIRDLSKADKVIKTMQDNGISTERLMFVEADLSQDEHWDEAMKDCKYVLSVASPVFFGKTDDAEVMAKPAIEGIQRILRAAEHAGVKRVVMTANFGAVGFSNKDKNSITNESHWTNEDEPGLSVYEKSKLLAEKAAWDFVENENTTVEFATINPVAIFGPSLDAHVSGSFHLLENLLNGSMKRVPQIPLNVVDVRDVAELHILAMTNEQANGKRFIATADGQINLLEIAKLIKEKRPEIAQKVSTKKLPDFILSLGAKFNHQAKEGKLLLDMNRNVSNERAKTLLGWEPIATQEEAILAAVDSMAKYHLI

SEQ ID NO: 31452 - protein, 452 aa, Staphylococcus aureus subsp. aureus COL
MNFLKPAKHIKPLPENQIDDTYKRLRLQVFLGIFIGYAGYYLLRKNFSLAMPALQEQGFTKAELGFALSAVSIAYGFSKFFMGTVSDRSNARIFLVLGLALTAIVNLLMGFVPFFTSGIGIMFVLLFLNGWFQGMGWPPSGRVLVHWFSVSERGSKTALWNVAHNVGGGIMAPIAAWGITTTAFINFGYLKGFEGVFIYPALLALIIAAISYVLIRDTPQSQGLPPIEIYKNDFATSDKKTLETELTTKEILFKYVLNNKWVWAIAFANIFVYFVRYGVLDWAPVYLSEEKHFDLKASGWAYFLYEWAGIPGTLLCGYISDKLFKGRRGPAGFFFMLGVTVFVLIYWLNPPGNAWLDNVSLIAIGFLIYGPVMLIGLQALDYVPKKAAGTAAGLTGLFGYLFGAVMANIVLGAVVDKFGWDVGFILLTAISVFAMLSFILTWNKVGQETVHH

SEQ ID NO: 31453 - protein, 350 aa, Candida albicans
MSEQIPKTQKAVVFDTNGGQLVYKDYPVPTPKPNELLINVKYSGVCHTDLHAWKGDWPLATKLPLVGGHEGAGVVVGMGENVKGWKIGDFAGIKWLNGSCMSCEFCQQGAEPNCGEADLSGYTHDGSFEQYATADAVQAAKIPAGTDLANVAPILCAGVTVYKALKTADLAAGQWVAISGAGGGLGSLAVQYARAMGLRVVAIDGGDEKGELVKSLGAEAYVDFTKDKDIVEAVKKATDGGPHGAINVSVSEKAIDQSVEYVRPLGKVVLVGLPAHAKVTAPVFDAVVKSIEIKGSYVGNRKDTAEAIDFFSRGLIKCPIKIVGLSELPEVFKLMEEGKILGRYVLDTSK

SEQ ID NO: 31454 - protein, 215 aa, Setosphaeria turcica
MGAFGLVWKGPDTLGHYPVTDFGRSSAKDQLTNQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSS

SEQ ID NO: 31455 - protein, 475 aa, Isoetes melanopoda
MSPQTETKASVGFKAGVKDYRLNYYTPDYKTKDTDILAAFRMTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEALNKSQAETGEIKGHYLNATAGTCEEMMKRAVFARELGAPIVMHDYLTGGFTANTSLAHYCRDNGLLLHIHRAMHAVIDRQRNHGIHFRVLAKALRMSGGDHIHSGTVVGKLEGEREVTLGFVDLLRDDYIEKDRSRGIYFTQDWVSMPGVLPVASGGIHVWHMPALTEIFGDDSVLQFGGGTLGHPWGNAPGAVANRVASEACVQARNEGRDLAREGNEIIREACKWSPELAAACEVWKEIKFEFETIDTL

SEQ ID NO: 31456 - protein, 475 aa, Selaginella apoda
MSPQTETKASVGFKAGVKDYRLTYYTPDYETKDTDILAAFRMTPQPGVPAEEAGAAVAAESSTGTWTTVWTDGLTNLDRYKGRCYDIEPVAGEKDQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFVAEALNKAQAETGEIKGHYLNATAGTCEEMMKRAEFARELGVPIVMHDYLTGGFTANTTLASYCRDNGLLLHIHRAMHAVIDRQKNHGIHFRVLAKALRMSGGDHIHAGTVVGKLEGERQVTLGFVDLLRDDYIEKDRSRGIYFTQDWVSMPGVLPVASGGIHVWHMPALTEIFGDDSVLQFGGGTLGHPWGNAPGAVANRVALEACVQARNEGRDLATAGNEVIREACKWSPELAAACEVWKEIKFEFDTIDTL

SEQ ID NO: 31457 - protein, 266 aa, Escherichia coli
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 31458 - protein, 214 aa, Bordetella bronchiseptica
NSLSKYIAGHGHALGGAVTDTGLYDWSGYANIYESYRKGAPTGWGLTQIKKKGLRDMGGTLAAEPAHRIAIGTETLALRMARHCSNALALATFLQGHPGVARVHYPGLSSHAQHQRASELFDGRYGGLLGVELAEGIDCFDFLNRLRIVLMATHLGDTRSLALPAAHTIYYEMGAEKRAQMGIADSLIRVSVGIEDEADLLFDFDQALRGCLQS

SEQ ID NO: 31459 - protein, 465 aa, Elaeagnus angustifolia
  misc_feature (433)..(433): Xaa can be any naturally occurring amino acid
VGFKAGVKDYKLTYYTPDYQTKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAIFARELGAPIVMHDYLTGGFTANTSLAHYCRDNGLLLHIHRAMHAVIDRQKNHGMHFRVLAKGLRMSGGDHIHARTVVGKLEGEREITLGFVDLLRDDYIEKDRSRGIYFTQDWVSLPGVLPVASGGIHVWHMPALTEIFGDDAVLQFGGGTLGHPWGNAPGAVANRVALEACVQARNEGRDLAREGNXIIREACKWSPELAAACEVWKEIKFEFEAMDTI

SEQ ID NO: 31460 - protein, 475 aa, Benincasa hispida
MSPQTETKASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKPQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 31461 - protein, 475 aa, Diplocyclos palmatus
MSPQTETKASVGFKAGVKDYKLTYYTPEYQTKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGAPIVMHDYLTGGFTANTSLAHYCRDNGLLLHIHRAMHAVIDRQKNHGMHFRVLAKALRMSGGDHIHAGTVVGKLEGEREITSGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFEAMDTL

SEQ ID NO: 31462 - protein, 391 aa, Candida albicans
MFLKNIFIALAIALLVDASPAKRSPGFVTLDFDVIKTPVNATGQEGKVKRQAIPVTLNNELVSYAADITIGSNKQKFNVIVDTGSSDLWVPDASVTCDKPRPGQSADFCKGKGIYTPKSSTTSQNLGSPFYIGYGDGSSSQGTLYKDTVGFGGASITKQVFADITKTSIPQGILGIGYKTNEAAGDYDNVPVTLKNQGVIAKNAYSLYLNSPNAATGQIIFGGVDKAKYSGSLIAVPVTSDRELRITLNSLKAVGKNINGNIDVLLDSGTTITYLQQDVAQDIIDAFQAELKSDGQGHTFYVTDCQTSGTVDFNFDNNAKISVPASEFTAPLSYANGQPYPKCQLLLGISDANILGDNFLRSAYLVYDLDDDKISLAQVKYTSASNIAALT

SEQ ID NO: 31463 - protein, 412 aa, Candida parapsilosis
MTTIAIFTKNVLLAIAFALFAQGAAIPDPAKRDDNPGFVALDFEVTRKPLDVNATSELSKRSSPSSPLYFEGPSYGIRVSVGSNKQEQQVVLDTGSSDFWVVDSSASCQKGNCKQYGTFDPHSSTSFKSLGSSFRSIGYGDKSSSIGTWGQDTIYLGGTSITNQRFADVTSTSVNQGILGVGRVETESANPPYDNVPITLKKQGKIKTNAYSLYLNSPGAATGTIIFGGVDNAKYSGKLIEEPLVSDRYLAVNLKSLNYNGDNSNAGFGVVVDSGTTISYLPDSIVNDLANKVGAYLEPVGLGNELYFIDCNANPQGSASFTFDNGAKITVPLSEFVLQSTANACVWGLQSSDRQNVPPILGDNFLRHAYAFQLDKETVLSRSGEVHFCLKCFSNLETSIVWKAFFYNRYIQ

SEQ ID NO: 31464 - protein, 402 aa, Candida parapsilosis
MVAIVTLTRQVLLTIALALFAQGAAIPEEAAKRDDNPGFVALDFDVLRKPLNLTEALLREKRDSISLSLINEGPSYASKVSVGSNKQQQTVIIDTGSSDFWVVDSNAQCGKGVDCKSSGTFTPSSSSSYKNLGAAFTIRYGDGSTSQGTWGKDTVTINGVSITGQQIADVTQTSVDQGILGIGYTSNEAVYDTSGRQTTPNYDNVPVTLKKQGKIRTNAYSLYLNSPSAETGTIIFGGVDNAKYSGKLVAEQVTSSQPLTISLASVNLKGSSFSFGDGALLDSGTTLTYFPSDFAAQLADKAGARLVQVARDQYLYFIDCNTDTSGTTVFNFGNGAKITVPNTEYVYQNGDGTCLWGIQPSDDTILGDNFLRHAYYLLYNLDANTISIAQVKYTTDSSISAV

SEQ ID NO: 31465 - protein, 342 aa, Oryza sativa (japonica cultivar-group)
MAPLLSPPLLADSVAKFHCSSTPTPCSGSVRRWAITRFAGAGRRRDWHRRRRTSGRGVLTVSAVAAESPSSGGGVAEDYYAVLGVMPDATPQQIKKAYYNCMKACHPDLSGNDPDVTNFCMFINEVYTVLTDPIQRAVYDEIHGYAATATNPFFDDSAPRDHVFVDEFSCIGCKNCANVCSKVFEIEEDFGRARVYNQSGNAELIQEAIDTCPVDCIHWTSAAQLSLLEDEMRRVERVNVGLMLAGMGSSVDVFRMASTRWEKRQAKVLEKVRRRVSQEDSGKGSSWSDVWGAPTRYRKNEDEARERAKRAAAAARRWREYSRKGADKPPTFKLPEAVSNKE

SEQ ID NO: 31466 - protein, 294 aa, Oryza sativa (japonica cultivar-group)
MDVSRRKKWVAWVAAVTIFVVLMLVTPAIPQNEEYHDFADQRRLFLGIPNTLNVISNIPFFFVGVVGLVLCHYKNYFRLNSQGELWSWTLFFAGVTAVAFGSSYYHLKPNDATLVWDRLPMTIAFTSVMAIFIIERVDDRAGTKSLAPLVIAGALSIMYWRFFDDLRPYAVIQFVPCIAIPVMAIVIPPMYTHSSYWLWAAGFYLLAKVEEAADKPIYKWTHQIVSGHTLKHLAAAMVPVFLALMLAKRTVEPERVSLFQRWKVKLVAVRETRFNKDRNTVDYNYIAVSTTPEP

SEQ ID NO: 31467 - protein, 202 aa, Oryza sativa (japonica cultivar-group)
MEVEASYSYGFLPSGRHQPYAPPPPHPAEEGELWEYFPCPFCYIEVEVPFICNHLQEEHCFDTRNAVCPLCADNIGRDMGAHFRVQHSHLLKRRKPSRPSSSWPTPSNNSDPYFEGPPQYMMNNRTYQDPAPDPLLSQFICSMAQTDTNSDNTNTEIAVSAVSHDQRLSQRVTLTDDASKLELKERLQRIEFVKEIIMSTIL

SEQ ID NO: 31468 - protein, 405 aa, Oryza sativa (japonica cultivar-group)
MDLQDPAADAVAAEPLTVAETDDQPPPPAPPLEAEGVVVAEEDPLPHPPLEVVEEDVAPVVAEAGAAAVPMEPSEAGAGGVVLTDELCDRIVKQVEYYFSDENLPTDEFLIKFVKKNKQGFVPIGVIASFRRMKKLSQDLSIIEAALRTSSKLVVSPDGKRVRRLHPLPNNELNDVKKRIVVVENLPSDFSMESIHAKFETVGKIAKITIHDQHSVGESATIKNHDIMLSNKVHALVEYETAEAAEKAAITLNDGSNWRTGMKVRLAKRTVGSGKHNQSSKENQAIQGQPSKVEQQMVSEKNGGTDSVESAFDNENVNSNISHEDMHQHQKVNAKGGRKGRYKSQGRGQIQQNTSGQGHVSSPATSGSDHVNKPIPGPRMPDGTRGFTMGRGKSPTFQKGDNAEE

SEQ ID NO: 31469 - protein, 226 aa, Oryza sativa (japonica cultivar-group)
MSADELRLDLEELRRLEGLAKRPRVLSALANEIRAVDAKLAKATEPQAPQAVAAGSPPVVAAAAAPAPAAAAGVSYVTLGSFSWDQDAEKIKIYVFLEGVEQDKVETTFKPMSVDTKFHDVKGKNYRCAIPKLHKEIVPEKCKVLVKPTKIIVTLYKASKGNWLDLHFKEDKFKPSMAKEKDPMSGIMDLMKNMYEEGDEDMKRTIAKAWSDARSGKTADSVRGLP

SEQ ID NO: 31470 - protein, 408 aa, Oryza sativa (japonica cultivar-group)
MGNCCGTKISSDAISRNASGSRRRRSGSRRKGTGLSSRVSSSVAAVTPRSEGEILRCANVRSFAFNELKTATRNFRPDSVLGEGGFGSVFKGWVDENTFLPSRPGTGMVIAVKKLNQDGFQGHREWLAEVNYLGQLSHPNLVKLVGYCLQDEQRLLVYEFMPRGSLENHLFRRGSHFQPLSWNLRMKVALGAAKGLAFLHSDKAKVIYRDFKTSNVLLDSNYNAKLSDFGLAKDGPTGDKSHVSTRVMGTYGYAAPEYLATGHLSAKSDVYSFGVVMVEMLSGRRALDKNRPAGEHNLVEWARPYLSSRRRIFRILDARLAGQYSLAGAHKAAALALQCLSADAKNRPTMHQVVAALEQLQETTTTSHHHRSPQSRMLLGGRGFNASGRSSAGAGARPRRLSASPLPA

SEQ ID NO: 31471 - protein, 245 aa, Oryza sativa (japonica cultivar-group)
MAGRSELVVSFGEMLIDFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 31472 - protein, 195 aa, Oryza sativa (japonica cultivar-group)
MEASMSRTVSMLFSARRCIVASAAKDIEIAQGGRRRRSNDVKQQRGSHGQLAVAAATTAAAMTGQCHAAAAAAAPERQWQEVAEWVCRAVAVVGELDPATAKAAIGVAGPALSAFGFLFIARIVMSWYPRLPVREFPYVVAYAPTEPLLAVTRKVIPPLGGVDVTPVVWFGLVSFASEILVGPQGLLVLLSQQKP

SEQ ID NO: 31473 - protein, 385 aa, Oryza sativa (japonica cultivar-group)
MSSPSSAHWLSLVGSIWLQTINGPNSDFPVYSSQLKELKSISQVQLNFLAFASDAGKLFGWFSGVAALYLPLWVVAFVGAAFGLVGYGIQYMFLDSSGLRYWHLFLLTALAGNGICWINTVSYLLCINNFASNSRVAVSLATSYLGLSAKVYTSLAETFPGLANSKTKTYLLLNAVVPLFVTVMVAPSLRVFDLKSAAASSDAAFLVMFAITLATGACAVVGSIGSTANGLSSKEHMISLGVLLATPILIPVGLKIRETLTKIRETQRENRIHDLGTDESESVESVVVIDVAADANAEVAKEEDAVVKKPQEEVGGLRLLKSPDFWLYFFSYMFSGTLGLVFLNNLGQIAESRGIGQTSTLVSLSSSFGFFGRLLPAFMDYYSAK

SEQ ID NO: 31474 - protein, 365 aa, Oryza sativa (japonica cultivar-group)
MWWRAARARRRIAGARAASTSAAAAGEKSCRAVVVPRFGGPEVLEVRQGVPVPDLKPGDVLVRARAVSINPLDLRMRSGYGRSIFEPVLPLIIGRDISGEVAATGTSVSSFTIGQEVFGALHPTAIRGTYTDYAILSQDELTSKPSTLSHVEASAIPFAALTAWRALHGTARISEGQRVLVIGGGGAVGLAAVQLAVAAGCSVSATCGTKSIEQVLAAGAEKAIDYTAEDTESAVKGKFDAVLDTIGVPETERIGINVLRRGGHYMTLQGEAAALADRYGLAVGLPAATAVLLKKQMQYRYSHGIDYWWTYMRADSEGLHEIQRLSGAGKLQIPVEKTFPISKVREAHEAKEKRLVPGKVVLEFD

SEQ ID NO: 31475 - protein, 302 aa, Oryza sativa (japonica cultivar-group)
MPKFSVRGIWQRWRESYPNNGSKNDEAITVFTGVPTMYTRLLQGYDGMDPEQQSASSFAAKQLRLMMCGSSALPSPLMKRWEEVTGHRLLERYGMTEFVMALSNPLHGARKEGTVGKPLPCVEAKIIMEDGAETTSEVGELCIRSPSLFKEYWRKPEVTAESFIDGGFFKTGDTVTVDDEGYFIILGRTNADIMKVGGYKLSALEIESVLLQHEIVLECAVLGLPDEAYGEIICAIIVPKEDSKKRAELDSKPALTLEALTSWSKDKLAPYKIPTRLYLWDSLPRNAMGKVNKKELKKLLGA

SEQ ID NO: 31476 - protein, 439 aa, Oryza sativa (japonica cultivar-group)
MDDAGRASAPAVVTVTASAAAPTPPLPPPPPPPPPSQLPATAAATDEPSHDPAALYGEGMWQQMTMSGSGAMQPGPYPERSGEPDCTYYLRTGLCRFGMSCRFNHPQDRNLAIASARMKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 31477 - protein, 322 aa, Oryza sativa (japonica cultivar-group)
MKGEYPERMGQPECQYYLKTGTCKFGPTCKFHHPREKAGIAGRVQLNTLGYPLRPSEKECAYYLKTGQCKYGNTCKFHHPELFNAMASSRGSPIYPSVHSSATAGPPYTGTMASWAFPRGSFIPSPRWQNPSNYAPMIVPQGLVQVPSWNSYTGQMMPVSSSESRLQSPGAQQTYGTSQQVDASAGNQGMLSPYRSSSYPVPQYALQRENVFPERPDQPECQYYMKTGDCKFGAVCKFHHPRVRSMPTPDCVLSPVGLPLRPGEELCKFYSRYGICKFGANCKFDHPTMAPPMGVYAYGSASTNVPMVRRLLQSPSASAYTS

SEQ ID NO: 31478 - protein, 467 aa, Oryza sativa (japonica cultivar-group)
MLPFVVAHLGRLLDAAAAALPELGCTFMFRGPWLVGADFLVTCDPAVFRHCLVANFAGYDKGRDFAEMFDVVGDGLLVADAASWAAKRHLAASVFTSAAFRGFVLSTVERQTRRLLVPFLDHAGGVVELEDVFMRYSLDVSYTVAFAADLDSLSVASAAEPFPPFGEATRVTGEAVLLRHIAPAGWWKLMRWLNVGVERRLADAKAVLDEFVYREIANRRSRPAPAVAGGDDLLCMYMASPIDPAMSDQTLRDAAVGFMFAAKDLIAAALTWLFYMICTHPHVEAKILDELRSLHTTTTAGAVVFDADELRAATYLHAAVLETLRLYPSAPFEEKEAVGDDVLPGGTAVRKGTRVVFCLYAMGRVEGIWGSDCREFRPERWLSTGDGDGGAGKVRQEPSYKFAAFNAGPRSCLGKDLGLSNIKIAAAAIVYNFTVELVAGHVVEPKDSVVLHTKNGLMVRVKRRETA

SEQ ID NO: 31479 - protein, 171 aa, Aspergillus ochraceus
MGVSGAGKTTLLDVLAQRKTEGTIQGSILVDGHPLPVSFQRSAAYTEQLDVHEPYATVREALEFSALLRQSRDTPEADKLRYVDVIIDLLELHDIADSLIGKVGTGHGLSVEQRKRLTIGVELVSKPKILIFLDEPTSGLDGQSAFNTVRFLRKLADAGQAVLVTIHQPSI

SEQ ID NO: 31480 - protein, 145 aa, Pinus taeda
MSKQKLLIFAAMAGLLFASAAVESRIARSDLGLDLGGGLGLGVGVGAGLGLGGGSASGSGSGSGSGSGSGSGSGAGSAAGSGSGSGAGSGAGSYAGSGAGNGGGQRRGSGSGYGSGSGSGSGYGAGNGNGNGYGAGSGSGSGSGY

SEQ ID NO: 31481 - protein, 141 aa, Pinus taeda
MSKQKLLIFAAMAGLLFACAAVESRIARSDLGLDLGGGLGLGVGVGAGLGLGGGSASGSGSGSGSGSGSGSGAGSAAGSGSGSGAGSGAGSYAGSGAGNGGGQSRGSGSGYGSGSGSGYGAGNGNGNGYGAGSGSGSGSGY

SEQ ID NO: 31482 - protein, 143 aa, Pinus taeda
MSKQKLLIFAAMAGLLFACAAVESRIARSDLGLDLGGGLGLGVGVGAGLGLGGGSASGSGSGSGSGSGSGSGAGSAAGSGSGSGAGSGAGSYAGSGAGNGGGQSRGSGSGYGSGSGSGSGYGAGNGNGNGYGAGSGSGSGSGY

SEQ ID NO: 31483 - protein, 145 aa, Pinus taeda
MSKQKLLIFAAMAGLLFACAAVESRIARSDLGLDLGGGLGLGVGVGAGLGLGGGSASGSGSGSGSGSGSGSGSGAGSAAGSGSGSGAGSGAGSYAGSGAGNGGGQSRGSGSGYGSGSGSGSGYGAGNGNGNGYGAGSGSGSGSGY

SEQ ID NO: 31484 - protein, 141 aa, Pinus taeda
MSKQKLLIFAAMAGLLFACAAVESRIARSDLGLDLGGGLGLGVGVGAGLGLGGGSASGSGSGSGSGSGSGSGAGSAAGSGSGSGAGSGAGSYAGSGAGNGGGHSRGSGSGYGSGSGSGYGAGNGNGNGYGAGSGSGSGSGY

SEQ ID NO: 31485 - protein, 145 aa, Pinus taeda
MSKQKLLIFAAMAGLLFASAAVESRIARSDLGLDLGGGLGFGVGVGAGLGLGGGSASGSGSGSGSGSGSGSGSGAGSAAGSGSGSGAGSGAGSYAGSGAGNGGGQRRGSGSGYGSGSGSGSGYGAGNGNGNGYGAGSGSGSGSGY

SEQ ID NO: 31486 - protein, 141 aa, Pinus taeda
MSKQKLLIFAAMAGLLFACAAVESRIARSDLGLDLGGGLGLGVGVGAGLGLGGGSASGSGSGSGSGSGSGSGAGSGAGSGSGSGAGSGAGSYAGSGAGNGGGQSRGSGSGYGSGSGSGYGAGNGNGNGYGAGSGSGSGSGY

SEQ ID NO: 31487 - protein, 456 aa, Xanthomonas campestris pv. phaseoli
MSARYDYDVVILGGGSGGLAAGFRAARHGARVAIMEPSELGGTCVNLGCVPKKAMWLAADLAGKIELASALGFDLPRPTLAWQELVTHRQGYIANIHASYRRRLNEDGVVLIPQRGVLQDRHTVMGSDGVPVTAEHIVIATGAHPLRPDVQGAEHGEVSDDFFNLCHAPEQVAIIGGGYIAVEIAGLLQALGSRVHLFVQGERLLERFDAELTLQLADNLRHLGVRLHFGFTTTALERDLHGALRVHGHSVHPREQGNDVFDKVFFAVGRRANTAGLGLDTVGVALGDKGEVVVDDGQTTNVPNIHAIGDVGGKVGLTPVAIAAGRKLMDRLFGHQPDARMDYENVPSVVFSHPPLGHVGLTEEQARARYNGAVRVYRSNFRPMLHALADAPQRSLFKLVCVGEEERVVGVHLLGESADEMLQGFAVAVKMGATKRDFEETVAIHPTSSEEIVLMH

SEQ ID NO: 31488 - protein, 206 aa, Escherichia coli
KHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQE

SEQ ID NO: 31489 - protein, 177 aa, Betula pubescens
RLKILYTALCHTDVFFWEAKGQNPLFPRILGHEAGGIVESVGEGVTDLEAGDHVLPVFTGECKECRHCKSEESNLCELLRINTDRGVMLSDGKSRFSIKGKPIFHFVGTSTFSEYTVVHMGCVVKINPLAPLDKVCILSCGISTGLGATLNVAKPKKGSSVAVFGLGAVGLAGCRGG

SEQ ID NO: 31490 - protein, 177 aa, Betula papyrifera
RLKILYTALCHTDVFFWEAKGQNPLFPRILGHEAGGIVESVGEGVTDLKAGDHVLPVFTGECKECRHCKSEESNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGA

SEQ ID NO: 31491 - protein, 177 aa, Betula alleghaniensis
RVKILYTALCHTDVFFWEAKGQNPLFPRILGHEAGGIVESVGEGVTDLKAGDHVLPVFTGECKECRHCKSEESNLCELLRINTDRGVMLSDGKSRFSIKGKPIFHFVGTSTFSEYTVIHRGCVVKINPLAPLDKVCILSCGISTGLGATLNVAKPKKGSSVAVFGLGAVGLAAAEGA

SEQ ID NO: 31492 - protein, 177 aa, Betula maximowicziana
RLKILYTALCHTDVFFWEAKGQNPLFPRILGHEAGGIVESVGEGVTDLKAGDHVLPVFTGECKECRHCKSEESNLCELLRINTDRGVMLSDGKSRFSIKGKPIFHFVGTSTFSEYTVVHRGCVVKINPLAPLDKVCILSCGISTGLGATLNVAKPKKGSSVAVFGLGAVGLAAAEGA

SEQ ID NO: 31493 - protein, 177 aa, Corylus avellana
RIRILYTALCHTDVFFWEAKGQNPLFPRIFGHEAGGIVESVGEGVKDLKPGDHVLPVFTGECKECAHCKSEESNLCELLRINTDRGVMLSDGKSRFSINGKPIYHFLGTSSFSEYTVVHVGCVVKINPLAPLDKVCILSCGISTGLGATLNVAKPKKGSTVAVFGLGAVGLAAAEGA

SEQ ID NO: 31494 - protein, 318 aa, Betula pendula
EVAPPQVGEVRLKILYTALCHTDVFFWEAKGQNPLFPRILGHEAGGIVESVGEGVTDLKAGDHVLPVFTGECKECRHCKSEGSNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGARIAGASRIIGVDLHPDRIKEGRKFGVTELVNPKDHKKPIQEVIADMTDGGVDRSVECTGNVDCMISAFECVHDGWGVAVIVGVPQKDAVFKTNPMNFLNGRTLKGTFFGNYKPRSDLPGVVEQYMNKELEV

SEQ ID NO: 31495 - protein, 185 aa, Oryza sativa (japonica cultivar-group)
MASSGVGGVPGSPCGACKFLRRKCAAECVFAPYFCAEDGAAQFAAIHKVFGASNAAKLLQQVAPGDRSEVAATVTYEAQARLRDPVYGCVAHIFALQQQLATLQVQVAQAKTQVAQTLAAAGMLTAGNPLLQHQQQQQQAWQIEHESTMTSTQSSGCYSAPRSDGSTSLQDMYCFGEQEEGSYSR

SEQ ID NO: 31496 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 31497 - protein, 311 aa, uncultured archaeon
MPLDPQIKPILERIRALSIAASPQELRRQVEEQSRLLTAAVQEPIAETRDVHIPVSGGSIRARVYFPKKAAGLPAVLYYHGGGFVFGSIETHDHICRRLSRLSDSVVVSVDYRLAPEYKFPTAVEDAYAALKWVADRADELGVDPDRIAVAGDSAGGNLAAVVSILDRNSGEKLVKKQVLIYPVVNMTGVPTASLVEFGVAETTSLPIELMVWFGRQYLKRPEEAYDFKASPLLADLGGLPPALVVTAEYDPLRDEGELYAYKMKASGSRAVAVRFAGMVHGFVSFYPFVDAGREALDLAAASIRSGLQPS

SEQ ID NO: 31498 - protein, 111 aa, Ipomoea batatas
YFLYQILRGLKYIHSANVIHRDLKPSNLLLNANCDLKICDFGLARPNIENEFMTEYVVTRWYRAPELLLNSSDYTGAIDVWSVGCIYMELMNRKPLFPGKDHVHQMRLLTE

SEQ ID NO: 31499 - protein, 508 aa, Gossypium arboreum
MASQVSQMPSSSPLSSNKDEIRPKADFQPSIWGDFFLNCPDKNIDAGTEKRHQQLKEEVRKMIVAPMANSTQKLAFIDSLQRLGVSYHFTKEIEDELENIYHNNNDAENDLYTTSLRFRLLREHGYNVSCDVFNKFKDEQGNFKSSVTLDVRGLLELYQASYLRVHGEDILDEAISFTTNHLSLAVASLDHPLSEEVSHALKQSIRRGLSRVEARHYLSVYQDIESHNKALLEFAKIDFNMLQFLHRKELSEICRWWKDLDFQRKLPYARDRVVEGYFWISGVYFEPQYSLGRKMLTKVIAMASIVDDTYDSYATYEELIPYTNAIEKMIRLAQSYLVEARWTLQNYKPSFEEFKANALPTCGYAMLAITSFVGMGDIVTPETFKWAANDPKIIQASTIICRFMDDVAEHKFKHRREDDCSAIECYMEEYGVSAQEAYDVFNKHVESAWKDVNQEFLKPTEMPTEVLNRSLNLARVMDVLYREGDGYTYVGKAAKGGITSLLIEPIAL

SEQ ID NO: 31500 - protein, 349 aa, Yarrowia lipolytica
MTTIPKTQKAVIFETSGGPLMYKDVPVPVPADDEILVNVKFSGVCHTDLHAWKGDWPLDTKLPLIGGHEGAGVVVAKGKNVTTFEIGDYAGIKWINKACYTCEFCQVSAEPNCPKATMSGYTHDGSFQQYATANAVQAAHIPKNCDLAQIAPILCAGITVYKALKTAGLKAGEWAAVTGAGGGLGSLAVQYAKAMGYRVLAIDTGADKEKMCKELGAEVFIDFAKSKDLVKDVQDATKGGPHAVINVSVSEFAVGQSVEYVRTLGTVVLVGLPAGAVCKSPIFQQVARSIQIKGSYVGNRADSQEAIEFFARGLVKSPIIIVGLSQLESVYKLMEEGKIAGRYVLDTYK

SEQ ID NO: 31501 - protein, 351 aa, Yarrowia lipolytica
MTTIPKTQKAVIFETSGGPLMYKDVPVPVPADDEILVNVKYSGVCHTDLHAWKGDWPLDTKLPLIGGHEGAGVVVAKGKNVTTFEIGDYAGIKWINKACYTCEFCQVAAEPNCPKATMSGYTHDGSFQQYATANAVQAAHIPKNCDLAQVAPILCAGITVYKALKTAGLKAGEWAAVTGAGGGLGSLAVQYAKAMGYRVLAIDTGADKEKMCKELELGAEVFIDFAKSKDLVKDVQEATKGGPHAVINVSVSEFAVNQSVEYVRTLGTVVLVGLPAGAVCKSPIFQQVARSIQIKGSYVGNRADSQEAIEFFARGLVKSPIIIVGLSELESVYKLMEEGKIAGRYVLDCSK

SEQ ID NO: 31502 - protein, 494 aa, Klebsiella aerogenes
MSEITLLAEVTAFLRQPHGQFIAGQREAGRGAPFAVINPATGRAIAEVTAADSDQADRAMESARQALSQWREMPTLARGALLLKLADTLAEHREALAQLESLCSGKTITLVRMLELDQSVALLRYFAGWAGKVTGETLDVSLPSMAGEKYTAFTRRQPLGVVVGIVPWNFSIMIAIWKLAAALVCGCTIVLKPSEYTPLTLLRVAELAKAVGIPDGVINVVNGAGGEIAQRLITHPACAKVSFTGSVATGEKVQQSASASGKRVTLELGGKYAALFLDDLTPEAMVNGIIEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYRSEEEALARINASPYGLAASVWSDNIRQALRYSEAIEAGIVWVNMHTFLDPAVPFGGMKGSGIGREFGSAFIDDYTELKSVMVRY

SEQ ID NO: 31503 - protein, 452 aa, Klebsiella pneumoniae
MTQRLELQKLLNAAPVGARQWRVIICCFLVVMLDGFDTAAIGFIAPDIRSHWQLTAGDLAPLFGAGLLGLTAGALLCGPLSDRFGRKRVIEFCVALFGLFSLLSAFAPDLQMLVFLRFLTGLGLGGAMPNTITMTSEYLPARRRGALVTLMFCGFTLGSAFGGVVSAQLVPLIGWHGILVLGGVLPLILAVALVPLLPESPRWQIRRQLPQATIARTVGAITGERYNDTHFWLDEPAAGAKGSISQLFAGRQLAITLMLWVVFFMSLLIIYLLSSWMPTLLNHRGIDLQHASWVTAAFQIGGTFGALLLGVLMDRFNPYRVLALSYGLGAVCIVMIGLSENGLWLMALAIFGTGIGISGSQVGLNALTATLYPTQSRATGVSWSNAVGRCGAIVGSLSGGVMMAMNFSFDTLFFVIAVPAVVSAVMLILLTLAVRNPTSVPAALPSAGIVNK

SEQ ID NO: 31504 - protein, 163 aa, Chlamydomonas sp. W80
MASPFYALAATDIAGKEFPFAQLQGKVVLVVNVASQCGFTPQYKGLQELYDKYKDEGLVIIGFPCDQFGHQEPGQESEIASFCQKNFGVTFPMMAKIEVNGDNTHPVYQFLKSEKKQLFMERIKWNFEKFLINKQGEVVERFSSAGDPMRNIAPAVAKLLAEA

SEQ ID NO: 31505 - protein, 427 aa, Anabaena sp.
MSLQTLIEQATNPPESGSAASSPFSTDSFDASVMSTYGRFPLALERGAGCRVWDTQGKEYLDFVAGIATCTLGHAHPAMVEAVTRQIQKLHHVSNLYYIPEQGELAQWIIQHSCADRVFFCNSGAEANEAAIKLARKYAHTVLDIEKPIILTANASFHGRTLATITATGQAKYQKYFDPLVPGFHYVNYNDISAVEAAISELDEGDYRVAAILIEPLQGEGGVRPGDVEYFQKLRQICDDTGILLMFDEVQVGMGRSGKLWGYEYLGVEPDIFTSAKGLGGGIPIGAMMSKKFCDVFQPGEHASTFGGNPFACGVALAVCQTLERENILQNVQDRGEQLRSGLRAIAAKYPHHLTEVRGWGLINGLELAADIPLTAADVVKAAINEGLLLVPAGPKVVRFVPPLIVTEAEINTALKLLEKALATVTA

SEQ ID NO: 31506 - protein, 466 aa, Jensenia connivens
GVGFKAGVKDYRLTYYTPDYETKETDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFVAEAIFKSQAETGEIKGHYLNATAGTSEEMMKRAACARELGVPIVMHDYLTGGFTANTSLAHYCRDNGLLLHIHRAMHAVIDRQKNHGMHFRVLAKALRLSGGDHIHAGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPDLAAACEVWKEIKFEYETIDTL

SEQ ID NO: 31507 - protein, 464 aa, Noteroclada confluens
GFKAGVKDYRLTYYTPDYETKETDILAAFRMTPQPGVPPEEAGAAVAAESSTGTWTTVWTDGLTSLDRYKGRCYDIEPVAGEDNQYIAYVAYPLDLFEEGSVTNPFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFVAEAIFKSQAETGEIKGHYLNATAGTSEEMMKRAACARELGVPIVMHDYLTGGFTANTSLAHYCRDNGLLLHIHRAMHAVIDRQKNHGMHFRVLAKALRLSGGDHIHAGTVVGKLEGEREVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREAAKWSPDLAAACEVWKEIKFEYETIDTL

SEQ ID NO: 31508 - protein, 240 aa, Escherichia coli
MIEFKNVSKHFGPTQVLHNIDLNIAQGEVVVIIGPSGSGKSTLLRCINKLEEITSGDLIVDGLKVNDPKVDERLIRQEAGMVFQQFYLFPHLTALENVMFGPLRVRGANKEEAEKLARELLAKVGLAERAHHYPSELSGGQQQRVAIARALAVKPKMMLFDEPTSALDPELRHEVLKVMQDLAEEGMTMVIVTHEIGFAEKVASRLIFIDKGRIAEDGNPQVLIKNPPSQRLQEFLQHVS

SEQ ID NO: 31509 - protein, 347 aa, Mycobacterium leprae
MAAIGGDGRMPMGVAIEVKGLTKSFGSSRIWEDVTLDIPAGEVSVLLGPSGTGKSVFLKSLIGLLRPERGSILIDGTDIIECSAKELYEIRTLFGVLFQDGALFGSMNLYDNTAFPLREHTKKKESEIRDIVMEKLQLVGLGGDEKKFPGEISGGMRNVPGLARALVLDPQIILCDEPDSGLDPVRTAYLSQLIMDINAQIDATILIVTHNVNIARTVPDNMGMLFRKHLVMFGPREVLLTSDEPVVRQFLNGRRIGPIGMSEEKDESTMAEEAALLEAGHYAGGAEEVEGVPPQITVTPGMPKRKAVARRQARVRAMLPTLPKGAQAAILDDLEGAHNYQAHEFGD

SEQ ID NO: 31510 - protein, 388 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDP

SEQ ID NO: 31511 - protein, 466 aa, Dysosma versipellis
SVGFKAGVKDYKLNYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMLTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALFKSQPETGEIKGHYLNATAGTCEEMMKRAVFARELGAPIVMHDYLTGGFTANTSLAHYCRDNGLLLHIHRAMHAVIDRQKNHGIHFRVLAKALRMSGEDHIHAGTVVGKLEGEREITLGFVDLLRDDFIEKDRSRGIYLTQDWVSLPGVLPVASGGIHVWHMPALTEIFGDDSVLQFGGGTLGHPWGNAPGAVANRVALEACVKARNEGRDLARQGNEIIREACKWSPELAAACEIWKEIKFEFEAMDTL

SEQ ID NO: 31512 - protein, 475 aa, Sinopodophyllum hexandrum
MSPQTETKASAGFKAGVKDYKLTYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRALRLEDLRILVAYVKTFQGPPHGIQVERDKLNKYGRPLLGCTIKPKLGLSAKNYGRAVYECLRGGLDFTKDDENVNSQPFMRWRDRFLFCAEAIFKSQPETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREACKWSPELAAACEVWKEIKFEFEAMDTL

SEQ ID NO: 31513 - protein, 101 aa, Pseudomonas putida
TRAAINMTGGEATLNLDAMPAVVFTDPQVPTVGYSEAEAQRAGLETDSRTLSLDNVPRALANFDTRGFIKLVAEAGSGRLLGVQAVAPEPGELIQTAVLAI

SEQ ID NO: 31514 - protein, 118 aa, Pseudomonas putida
VAAAAGTRAAINMTGGDAALNLAAMPAVVFTDPQVATVGYSEAEAQHDGIETDSRTLTLDNVPRALANFDTRGFIKLVIEEGSGRFIGVQAVAPEAGELIQTGVLAIRNRMTVQELGE

SEQ ID NO: 31515 - protein, 113 aa, Pseudomonas putida
VAAAAGTCAINMTGGDAALNLTAMPAVVFTDPQVATVGYSEAEAHHDGIETDSRTLTLDNVPRALANFDTRGFIKLVIEEGSGRLIGVQAVAPEAGELIQTAVLAIRNRMTVQ

SEQ ID NO: 31516 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENPGGWPERPTAERFAEYAAIAADALGDRVKTWTTLNEPWCSAFLGYGSGVHAPGRTDPVAALRAAHHLNLGHGLAVQALRDRLPADAQCSVTLNIHHVRPLTDSEADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 31517 - protein, 262 aa, Zea mays
MSRPVSDTMAALMAKGKTAFIPYITAGDPDLATTAEALRLLDGCGADVIELGVPCSDPYIDGPIIQASVARALASGTTMDAVLEMLREVTPELSCPVVLLSYYKPIMFRSLAKMKEAGVHGLIVPDLPYVAAHSLWSEAKNNNLELVLLTTPAIPEDRMKEITKASEGFVYLVSVNGVTGPRANVNPRVESLIQEVKKVTNKPVAVGFGISKPEHVKQIAQWGADGVIIGSAMVRQLGEAASPKQGLRRLEEYARGMKNALG

SEQ ID NO: 31518 - protein, 433 aa, Synechococcus elongatus PCC 6301
MVTSSPFKTIKSDEIFAAAQKLMPGGVSSPVRAFKSVGGQPIVFDRVKDAIAWDVDGNRYIDYVGTWGPAICGHAHPEVIEALKVAMEKGTSFGAPCALENVLAEMVNDAVPSIEMVRFVNSGTEACMAVLRVVRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 31519 - protein, 305 aa, Streptococcus suis
PCYPGSELGIVSDDVFAWEEYPLSVAVIGAGYIAVEMAGLIHGLGVQTDLFVRGNRPLRSFDTYIVDALMEEMQRTNLPLHTGKTPVSLEKTDDGQIQINFADGSNHIAQKVLWAIGRKPNIDKLNLKATSVQLTSSGHISVNEYQETAVPGIYALGDVTGEKELTPVAIKAGRLLAERLFNNKPTAKMDYTTIPTVVFSHPAIGTVGLTEDEAITQYGQDNVKVYTSAFTSMYTALENNRQMAKFKLVTVGENEKVVGLHGIGYGVDEMIQGFSVAIKMGATKEEFDAVVAIHPTGSEEFVTMR

SEQ ID NO: 31520 - protein, 178 aa, Streptococcus suis
ALAILTNKKKNLRILELAFDTQDASEVEKEFTGVVGGLLVQDQDVVVESPVDWQVVTEHQPSEQEWAAMEFAWKSSKYVKSNGIIITNDKMTLGVGPGQTNRVASVRIAIEQAKDRLEGAVLASDAFFPFADNVEEIAAAGIKAIIQPGGSIRDQDSIDMANKYGLTMVFTGVRHFRH

SEQ ID NO: 31521 - protein, 178 aa, Streptococcus suis
ALAILTNKKKNLRILELAFDAQDASEVEKEFTGVVGGLLVQDQDVVVESPADWQVVTERQPSEQEWAAMEFAWKSSKYVKSNGIIITNDKMTLDVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31522 - protein, 178 aa, Streptococcus suis
ALAILTNKKKNLRILELAFDAQDVSEVEKEFTGVVGGLLVQDQDVVVESPADWQVVTERQPSDQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31523 - protein, 178 aa, Streptococcus suis
ALAILTNKKKNLRILELAFDAQNASEVEKEFTGVVGGLLVQDQDVVVESPADWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31524 - protein, 178 aa, Streptococcus suis
ALAILTNKKKNLRILELAFDAQDASEVEREFTGVVGGLLVQDQDVVVESPADWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31525 - protein, 178 aa, Streptococcus suis
AVAILTNKKKNLRILELAFDAQDASEVEKEFTGVVGGLLVQDQDVVVESPADWEVVTERQPSEQEWAAMEFAWKSSKYVKSNGIIVTNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31526 - protein, 178 aa, Streptococcus suis
ALAILTNKKKNLRILELAFDAQDVSEVEKEFTGVVGGLLVQDQDVVVESPADWQVVTERQPSDQEWAAMEFAWKSSKYVKSNGIIITNDKMTLGVGPGQTNRVASVRIAIEQAKDCLEGAVLASDAFFPFADNVEEIAAAGIKAIIQPGGSVRDQDSIDMANKYGLTMVFTGVRHFRH

SEQ ID NO: 31527 - protein, 178 aa, Streptococcus suis
ALAILTNKKKNLRILELAFDAQDASEVEKEFTGVVGGLLVQNQDVVVENPADWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31528 - protein, 178 aa, Streptococcus suis
ALAILTNKKKNLRILELAFDAQDASEVEKEFTGVVGGLLMQNQDVVVENPADWQVVTERQPSEQEWAAMEFAWKSSKYVKSNGIIITNDKMTLGVGPGQTNRVASVRIAIDQAKDRLDGAVLASDAFFPFADNVEEIAAAGIKAIIQPGGSVRDQDSIDMANKYGLTMVFTGVRHFRH

SEQ ID NO: 31529 - protein, 178 aa, Streptococcus suis
ALAILTNKKKNLRILELAFDAQDASEVEKEFTGVVGGLLVQDQDVVVESPADWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31530 - protein, 178 aa, Streptococcus suis
ALAILTNKKKNLRILELAFDAQDASEVEKEFTGVVGGILVQDQDVVVESPADWQVVTERQPSEQEWAAMEFAWKSSKYVKSNGIIITNDKMTLGVGPGQTNRVASVRIAIEQAKDHLEGAVLASDAFFPFADNVEEIAAAGIKAIIQPGGSVRDQDSIDMANKYGLTMVFTGVRHFRH

SEQ ID NO: 31531 - protein, 178 aa, Streptococcus suis
ALAILTNKKKNLRILELAFDAQDASEVEKEFIGVVGGLLVQDQDVVVESPADWQVVTERQPSEQEWAAMEFAWKSSKYVKSNGIIITNDKMTLGVGPGQTNRVASVRIAIEQAKDRLEGAVLASDAFFPFADNVEEIAAAGIKAIIQPGGSVRDQDSIDMANKYGLTMVFTGVRHFRH

SEQ ID NO: 31532 - protein, 479 aa, Escherichia coli K12
LISGRHDRKPYYAGEAAIMAINSPLNIAAQPGKTRLRKSLKLWQVVMMGLAYLTPMTVFDTFGIVSGISDGHVPASYLLALAGVLFTAISYGKLVRQFPEAGSAYTYAQKSINPHVGFMVGWSSLLDYLFLPMINVLLAKIYLSALFPEVPPWVWVVTFVAILTAANLKSVNLVANFNTLFVLVQISIMVVFIFLVVQGLHKGEGVGTVWSLQPFISENAHLIPIITGATIVCFSFLGFDAVTTLSEETPDAARVIPKAIFLTAVYGGVIFIAASFFMQLFFPDISRFKDPDAALPEIALYVGGKLFQSIFLCTTFVNTLASGLASHASVSRLLYVMGRDNVFPERVFGYVHPKWRTPALNVIMVGIVALSALFFDLVTATALINFGALVAFTFVNLSVFNHFWRRKGMNKSWKDHFHYLLMPLVGALTVGVLWVNLESTSLTLGLVWASLGGAYLWYLIRRYRKVPLYDGDRTPVSET

SEQ ID NO: 31533 - protein, 472 aa, Escherichia coli K12
METNIVEVENFVQQSEERRGSAFTQEVKRYLERYPNTQYVDVLLTDLNGCFRGKRIPVSSLKKLEKGCYFPASVFAMDILGNVVEEAGLGQEMGEPDRTCVPVLGSLTPSAADPEFIGQMLLTMVDEDGAPFDVEPRNVLNRLWQQLRQRGLFPVVAVELEFYLLDRQRDAEGYLQPPCAPGTDDRNTQSQVYSVDNLNHFADVLNDIDELAQLQLIPADGAVAEASPGQFEINLYHTDNVLEACDDALALKRLVRLMAEKHKMHATFMAKPYEEHAGSGMHIHISMQNNRGENVLSDAEGEDSPLLKKMLAGMIDLMPSSMALLAPNVNSYRRFQPGMYVPTQASWGHNNRTVALRIPCGDRHNHRVEYRVAGADANPYLVMAAIFAGILHGLDNELPLQEEVEGNGLEQEGLPFPIRQSDALGEFIENDHLRRYLGERFCHVYHACKNDELLQFERLITETEIEWMLKNA

SEQ ID NO: 31534 - protein, 421 aa, Escherichia coli K12
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAVEFNDPQTGEPSAAIAQKIQQRALAQGLLLLTCGAYGNVIRFLYPLTIPDAQFDAAMKILQDALSD

SEQ ID NO: 31535 - protein, 475 aa, Platanus orientalis
MSPQTETKASVGLKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 31536 - protein, 236 aa, Saccharomyces cerevisiae
  misc_feature (236)..(236): Xaa can be any naturally occurring amino acid
MSGENRAVVPIESNPEVFTNFAHKLGLKNEWAYFDIYSLTEPELLAFLPRPVKAIVLLFPINEDRKSSTSQQITSSYDVIWFKQSVKNACGLYAILHSLSNNQSLLEPGSDLDNFLKSQSDTSSSKNRFDDVTTDQFVLNVIKENVQTFSTGQSEAPEATADTNLHYITYVEENGGIFELDGRNLSGPLYLGKSDPTATDLIEQELVRVRVASYMENANEEDVLNFAMLGLGPNWX

SEQ ID NO: 31537 - protein, 368 aa, Escherichia coli
DAGDKGIYRHYMQKEIYEQPNAIKNTLTGRISHGQVDLSELGPNADELLSKVEHIQILACGTSYNSGMVSRYWFESLAGIPCDVEIASEFRYRKSAVRRNSLMITLSQSGETADTLAGLRLSKELGYLGSLAICNVPGSSLVRESDLALMTNAGTEIGVASTKAFTTQLTVLLMLVAKLSRLKGLDASIEHDIVHGLQALPSRIEQMLSQDKRIEALAEDFSDKHHALFLGRGDQYPIALEGALKLKEISYIHAEAYAAGELKHGPLALIDADMPVIVVAPNNELLEKLKSNIEEVRARGGQLYVFADQDAGFVSSDNMHIIEMPHVEEVIAPIFYTVPLQLLAYHVALIKGTDVDQPRNLAKSVTVE

SEQ ID NO: 31538 - protein, 478 aa, Hordeum vulgare
VRIALKKRPIDRNSRVATGLSGGEEQPLLSGANPLRSEEEGDIVALKNYMNAQYFGEIGVGTPPQKFTVIFDTGSSNLWVPSAKCYFSIACYLHSRYKAGASSTYKKNGKPAAIQYGTGSIAGYFSEDSVTVGDLVVKDQEFIEATKEPGITFLVAKFDGILGLGFKEISVGKAVPVWYKMIEQGLVSDPVFSFWLNRHVDEGEGGEIIFGGMDPKHYVGEHTYVPVTQKGYWQFDMGDVLVGGKSTGFCAGGCAAIADSGTSLLAGPTAIITEINEKIGAAGVVSQECKTIVSQYGQQILDLLLAETQPKKICSQVGLCTFDGTRGVSAGIRSVVDDEPVKSNGLRADPMCSACEMAVVWMQNQLAQNKTQDLILDYVNQLCNRLPSPMGESAVDCGSLGSMPDIEFTIGGKKFALKPEEYILKVGEGAAAQCISGFTAMDIPPPRGPLWILGDVFMGPYHTVFDYGKLRIGFAKAA

SEQ ID NO: 31539 - protein, 432 aa, Synechococcus sp.
VTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVNDAVPSIEMVRFVNSGTEACMAVLRLMRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 31540 - protein, 201 aa, Bacillus halodurans
MGKPTGFMEYKRETPPKKDPFERSKNWQEFTLLMPESALRQQGARCMDCGVPFCQTGTSMDGSGEIGCPVYNLIPEWNDLVYRGHWKEALERLHKTNNFPEFTGRVCPAPCEGSCTVAISDDAVAIKSMEFHIVERGFQEGWIVPNPPRSRTGKKVAVVGSGPAGLAAAAQLNKAGHWVTVFEREDRIGGLLTYGIPDVKL

SEQ ID NO: 31541 - protein, 408 aa, Sinorhizobium meliloti
MSRIVIVGAGECGARAAFALREKGFDGGITLIGAEPDLPYERPPLSKEGLAAAAPPKYLADAMRYQEARITVLTNAPVARIDRDEKAVELADGRSVAYDRLLLATGAPPRVFPGAPENSERIRMLRTHADALAIRAALAPGRKLAVIGGGFIGLELAATARKLGAEVGVIEGLPRILSRGVPKEIAAIVDERHRREGVKILCGARIATIGHQGDGANILLADGGSIAADLLVVGIGATPNTELAEAAGLAVEDGIPVDETLRTSDPDIFAAGDCCSFPLSHYHGRRVRLEAWRNAQEQGTLVAANLMGAAKLVASVPWFWSDQYELTLQIAGLADDAAVTVRRDLSDDASFLFHLDGEGRLIAASAIGPGNAVARDIRLAEMLIATGSRPDPAALASPETKLKKLLGV

SEQ ID NO: 31542 - protein, 164 aa, Capsicum annuum
MADLMEKAKNYVVEKVGNMEKPEAEITDVDMKKVSMDSISYHANVAVKNPYSVPVPIMQISYALKCSGRIIVSGTIPDPGNIKANDTTMLDVPVKVPHSVLVSLAKDIGKDWDIDYTLELGLTIDLPVIGNFTIPLSHSGEIKLPSISDLWKGDNEEEETEKET

SEQ ID NO: 31543 - protein, 258 aa, Trichodesmium sp. IMS101
FGPEAEFFVFEDARFDQTENKAYYYVDSIEGRWNSGREEDGGNKAYKPDYKGGYFPVPPTDTMQDLRTEMLLTMAKCGVPIEKHHHEVATGGQNELGFRFGKLVEAADNLMIYKYVIKNVGRKYGKTITFMPKPIFNDNGSGMHVHQSIWKDGEPLFWGDGYANLSKMALHYIGGILKHAPAILGFSNPSTNSYKRLVPGFEAPVNLAYSQGNRSASVRIPLTGTNPKAERLEFRCPDATCNPYLAFAAMLCAGIDGI

SEQ ID NO: 31544 - protein, 329 aa, Synechococcus elongatus PCC 7942
MPKILNRLTEWIGNTPLVRLQETAQQYGAIAEVLLKLEYLNPLGSVKDRTALSLIQSARSQGLITAGTTLIEPTTGNTGIGLAFAAAAEQLRLILVMPDRVSAERIRLAKLLGAKVVLTPAAEAMLGCIAKAQALQQQIPDSVILQQFQNPANPSIHQATTGPEIWRDTDGEVDIVVAGVGTGGTLMGISRYLKPLRPRLQSIAVQPARSPVLSGGAAGSHQLTGMGPNFVSPLVDRSLIDEILSAYEEDAIAVIRTCAAREGIPLGVSSGAIVWAALQVAKRPENAGKRIVAVCPSGSERYLSSTLLADISLESDDVSDWVAIPQGQA

SEQ ID NO: 31545 - protein, 387 aa, Methanosarcina thermophila
MATTRDYYEILGLSRDATPEDIKKSYRKLALKYHPDRNKEPGAEEKFKEISEAYAVLSDPEKRAQYDRFGHAGINGQYTAEDIFRGADFSGFGDIFEMFFGGSRRGPRGPRRGSDLQYDLYITFEEAAFGVRKDIDVPRTERCSNCSGTGARPGTSPKRCPTCGGTGQIRTTRTGLGMQFVSTTTCSTCRGKGQVIESPCPVCSGTGRVRNTRKITVNVPAGADSGMSLRLSGEGDAGDPGAPPGDLYVVLHVMEHKIFKRVDYDVISEVPISFAQAALGTDIMVDTLYGKVKMNIPAGTPTHSVFKIKEKGIQHLHGNRRGDQLVRVVIKTPTNLSHEQKRNFFASLKALSSGKNPGGEKGRYDKFTEKSKKSKGFFEKVKDAFES

SEQ ID NO: 31546 - protein, 307 aa, Solanum virginianum
MGSKHSKETTSTSHRVPFVDLQEATNNFDDNFLIGEGGFGKVYRGVWRDGTKVALKRYNPKSGQGIAQFRTEIKMLSQLRHPYLVSLIGYCDENNEMTLIYEYMENGNLRKHLYGSDLPTLSWEQRLEICIGAAKGLHYLHTTAVIHCDVKCTNILLAENFVAKVADFGLSKKGTVLDETHTTTMMKGTFGYLDPEYYRTLRLTEKSDVYSFGVVLLDVLCARPAVASSSSKGIINLAEWAMKWKKKGQLERIIDPNLVGKIIPDSLRKFGETAEKCLAESGVDRTSMNTVLWNLEYALHLQEPVIQ

SEQ ID NO: 31547 - protein, 395 aa, Magnaporthe grisea
MKGAMMTAAVLLGTAEAGVHKLKMKKIPLEDQLKTFDLNAQMRGLGQKYLGIRPESHQQAVFSNDAVQASGNHPVPISNFMNAQYFSEITIGTPPQNFKVILDTGSSNLWVPSSSCGSIACYLHNKYESSSSSTYKKNGTEFKIQYGSGSMEGFVSNDVMTIGDLKIKNLDFAEATKEPGLAFAFGRFDGILGMGFDRLSVNKIVPPFYAMVDQKLIDEPVFAFYLADEKSESEVVFGGVNKDHIDGKITEIPLRRKAYWEVDLDAIALGDEVAELDNTGVILDTGTSLIALPSQLAELLNSQIGAKKGYNGQYSIDCDKRKDLPDITFRLSGYDFPISAYDYILEVSGSCISTFMAMDIPEPVGPLAILGDAFLRRYYSIYDLGKGTVGLAKAK

SEQ ID NO: 31548 - protein, 346 aa, Magnaporthe grisea
MSSTTEERQVWQPLHPQVRPRLDPQYVEVHDKLLQYAPPTHTQPWSAAMRQPSQASVKTGLDVVPVLTEEVQLERFTILVLTPVTNADDEPRPESGWPVFVWFHGGGFVLGDHSSELDLLTRICATARCVVCSVGYRLAPEHPYPAAIEDGTDGVRWILSDAQDGGATRFSIDRNRWAIGGVSAGALLSTVTLISLGEAGDLDSGEMARPLRQVLVVPVVDNTAMPGSGFWSINPHAISPSAERMLWYRRLWLGDADPRVWSVSVNHASDKQLAYMPPTFTAIGGEDLLAPEGLAFVDQLRGAGVDVETMMLPGCPHAILAFAGCVDKAKDLFDMCVDRISKSFGN

SEQ ID NO: 31549 - protein, 136 aa, Magnaporthe grisea
MTGGGKSGGKASGSKNAQSRSSKAGLAFPVGRVHRLLRKGNYAQRVGAGAPVYLAAVLEYLAAEILELAGNAARDNKKTRIIPRHLQLAIRNDEELNKLLGHVTIAQGGVLPNIHQNLLPKKTGKTAGGKNASQEM

SEQ ID NO: 31550 - protein, 475 aa, Nothofagus nitida
MSPQTETKASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYGKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYITGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 31551 - protein, 506 aa, Antirrhinum majus
MSTLVYSTLFILSTLLLTLLTRTRRKTRPPGPLALPLIGHLHLLGPKLHHTFHQFSQRYGPLIQLYLGSVPCVVASTPELAREFLKTHELDFSSRKHSTAIDIVTYDSSFAFAPYGPYWKFIKKLCTYELLGARNLSHFQPIRALEVNSFLRILYEKTEQKQSVNVTEELVKLTSNVISNMMLGIRCSGTEGEAEVARTVIREVTQIFGEFDVSEIVWFCKNLDLQGIRKRSEDIRRRYDALLEKIISDRERLRLRGGGGGGGGEVKDFLDMLLDVMESEKSEVEFTREHLKALILDFFTAGTDTTAITTEWAIAELISNPNVLKKAQEEMDKVIGSQRLLQESDAPNLPYLNAIIKETFRLHPPIPMLTRKSISDVVVNGYTIPAKTLLFVNLWSMGRNPNYWENPMEFRPERFLEKGTGSIDVKGQHFELLPFGTGRRGCPGMLLGMQELFSIIGAMVQCFDWKLPDGVKSVDMTERPGLTAPRANDLVCQLVPRIDPVVVSGP

SEQ ID NO: 31552 - protein, 512 aa, Torenia hybrida
MDTVLITLYTALFVITTTFLLLLRRRGPPSPPGPLSLPIIGHLHLLGPRLHHTFHEFSLKYGPLIQLKLGSIPCVVASTPELAREFLKTNELAFSSRKHSTAIDIVTYDSSFAFSPYGPYWKYIKKLCTYELLGARNLGHFQPIRNLEVRSFLQLLMHKSFKGESVNVTDELVRLTSNVISHMMLSIRCSEDEGDAEAARTVIREVTQIFGEFDVTDIIWFCKKFDLQGIKKRSEDIQRRYDALLEKIISDRERSRRQNRDKHGGGNNEEAKDFLDMLLDVMESGDTEVKFTREHLKALILDFFTAGTDTTAIATEWAIAELINNPNVLKKAQEEISRIIGTKRIVQESDAPDLPYLQAIIKETFRLHPPIPMLSRKSTSDCTVNGYKIQAKSLLFVNIWSIGRNPNYWESPMEFRPERFLEKGRESIDVKGQHFELLPFGTGRRGCPGMLLAIQEVVSIIGTMVQCFDWKLADGSGNNVDMTERSGLTAPRAFDLVCRLYPRVDPATISGA

SEQ ID NO: 31553 - protein, 487 aa, Salmonella enterica subsp. enterica serovar Dublin
MKKINHWINGQNVAGDDYFQTTNPATGDVLAEVASGGEAKLNQAVAAAKEAFPKWANLPMKKRARLMRRLGDLIDQNVPEIAAMETADTGLPIHQTKNVLIPRASHKFEFFAEVCQQMNGKTYPVDDKMLNYTLVQPVGVCALVSPWNVPFMTATWKVAPCLALGNTAVLKMSELSPLTADRLGELALEAGIPAGVLNVVQGYGATAGDALVRHHDVRGVSFTGGTATGRNIMKNAGLKKYSMELGGNSPVLIFEDAEIERALEAALFTIFLINGERCTAGLSIFIQQSIYPEFVKRFAERANRLRVGDPTDPNTQVGALISQQHWEKVSGYIRLGIEEGATLLAGGAEKPTDLPAHLKGGNFLRPTVLADVDNRMRVQEEIFGPVACLLPFKDEAEGLRLANDVEYGLASYIWTQDVSKVLRLARAIEAGMVFVNTQNVRDLRQPFGGVKASGTGREGGEYSFEVFAEMKNVCISMGDHPIPKWGV

SEQ ID NO: 31554 - protein, 262 aa, Rhodobacter sphaeroides
MTAAAQPSGLPGLATAPGRPWPLGASFDGEGVNFALFSAHAEKVELCLFAPDGRREALRLPLTERDGDIWHLKVNGLLPGQLYGYRVHGPYQPEQGHRFNPNKLLIDPYARKLDGRLRWSDAVMGYRVGSARADLSFDGRDSAFAVPKSVVVGHNFNWGPDAPPERALTETLIYEAHVKGLTALHPGVEDGLRGTFLGLASDPILEHLTRLGVTAVELLPVQAFLDDRFLVNRGLSNYWGYQTVGFFAPDPRYLAKGALWEF

SEQ ID NO: 31555 - protein, 251 aa, Yarrowia lipolytica
GSGGSSGGGNGGGNGGNGGNGGNGGNGGSGGGTDGGSSGGVSGGSSGGSSSGSSGGSSGSSGSSVSSGSSGSSGSSGSSGSSGSSGSSGSSGSSGSGSSGSSGSSGSSGSSGSSGSGSSGSSGSSGSSGSSGSSDSGTGFSGSSGGFTSGDNNNSPNNSPDANSPNSQNPDSPDRPTSTTPHNNDGSPASPVQPPMGSQGTIPNLQGNRTNSTRGNKSEGSTTYGGLGGNGSMFGSAATAISMSVVVLLLF

SEQ ID NO: 31556 - protein, 355 aa, Verticillium dahliae
MSRSNAPNPSGSRKISFNVSEQYDIQDVVGEGAYGPPSSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 31557 - protein, 113 aa, Atropa belladonna
IKNPRVQQKAQEELDQVIGYERVMNETDFPNLPYLQCVAKEALRLHPPTPLMLPHRANANVKIGGYDIPKGSNVHVNVWAVARDPKVWKNPLEFRPERFLEEDVDMKGHDFRL

SEQ ID NO: 31558 - protein, 113 aa, Datura metel
VKNPRVQQKAQEELDRVIGSDRVITESDMSKLSYLQSVVKESLRLHPPTPLMLPHMASASVKIGGYNIPKDSIVHVNVWALGRDPKVWKEPLQFRPERFIEEDVDMKGHDFRL

SEQ ID NO: 31559 - protein, 125 aa, Teucrium canadense
TSTTMEWAMTELIKNPRVQQKAQEEMDRVIGYERVMTEMDFSNLPYLQCVAKEALRLHPPTPLMLPHRSNANVKIGGYDIPKGSNVHVNVWALARDPAVWKNPLEFRPERFLEEDVDMKGHDFRL

SEQ ID NO: 31560 - protein, 275 aa, Achromobacter xylosoxidans
MAQEISGVVGIIGIGQLGSAIASNLLDMGYRVVGYRRNRNEAQAFVDAGGELVDTPSLVVQQADFIFLCLPNESASNAVLEGVGGILPLLKDGKTVVEVGTYRKSFKLMQAEKIQATGANILEAELSGSPSLVLHAKRAFYVGGTDSVYEKCEPLLQAITDNRFFLGAFGTAVSMKLIANYLVTVNTLAAAEAMNLGTRAGFSPDLLARVLSVGAGASAMMSVRAPIMASRKFEPAPGSFITLEKYLDLGQELVSELGCSAPLYAAAVPVFQACY

SEQ ID NO: 31561 - protein, 365 aa, Aspergillus oryzae
MAEFVRAQIFGTTFEITSRYTELQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAACIFAEMLEGKPLFPGKDHVNQFSIITELLGTPPDDVIETICSENTLRFVKSLPKRERQPLATKFKNADPDAVDLLERMLVFDPKKRIRAGEALAHEYLAPYHDPTDEPVAEEKFDWSFNDADLPVDTWKIMMYSEILDFHNIDQGTEASQVLVEGAGDAQQNFV

SEQ ID NO: 31562 - protein, 436 aa, Streptomyces sp. 139
MRLPRSRAVNERLHALVPGGAHTYAKGDDQYPQDLAPVISHGRGAHVWDVDGNRYIEYGSGLRSVSLGHAHPRVLEAARRELDRGSNFVRPSVVEAEAAERFLATVPTAEMVKFAKNGSDATTAAVRLARAVTGRARVALCADHPFFSTDDWFIGTTPMSAGIPAETTELTVTFPYGDLAATEELLDRHRGEIACLILEPAAQTEPPPGYLAGLRELADRHGCVLVFDEMITGFRWSEAGAQGLYGVVPDLSTFGKALGNGFAVSALAGRRALMERGGLRHDDDRVFLLSTTHGAETHALAAAMAVQATYTEEGVTARLHALGERLAAGVRDAAAAMGVGDHLVVRGRASNLVFATLDGPGRPSQEYRTLFLRRLLTGGVLAPSFVVSAALDEADVDRTVDVVGQACAVYRKALDAGDPTPWLGGRPVRPVFRRRA

SEQ ID NO: 31563 - protein, 362 aa, Acacia mangium x Acacia auriculiformis
MGSIEGERTTVGWAARDPTGILSPYTFNLRNTGPDDVYIKVHYCGICHSDLHQIKNDLGMSNYPMVPGHEVVGEVIEVGSNVTKFKVGEVVGAGLIVGSCRNCRACKSDIEQYCGKKIWNYNDVYTDGKPPQGGFAETMIVDQNFVVKIPEGMSPEQVAPLLCAGVTVYSPLSHFGLRDSGLRGGILGLGGVGHMGVKDRGRADWKHPVCQVIGSSEKRKKEARETLEQTIMWLSSDETQMQKIADSLDYIIDTVPVGHPLEPNLSLLKIDGKLILMGVINTPLQFVSPMVMLGRKTITGSFIGSIKETEEMLEFWKEKGLSSMIEMVKMDYINKALERLEKNDVRYRFVVDVAGSKLDDHQ

SEQ ID NO: 31564 - protein, 479 aa, Dasyphyllum argenteum
MSPQTETKASVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIREASKWSPELAAACEVWKEIKFEFAAMDTLDPTK

SEQ ID NO: 31565 - protein, 477 aa, Doniophyton anomalum
MSPQTETKASVGFKAGVKDYKLTYYTPDYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREASKWSPELAAACEVWKEIKFEFEAMDTLDN

SEQ ID NO: 31566 - protein, 475 aa, Ainsliaea acerifolia
MSPQTETKASVGFKAGVKDYKLTYYTPDYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAIEGNEIIREASKWSPELAAACEVWKEIKFEFQAMDTI

SEQ ID NO: 31567 - protein, 475 aa, Nassauvia gaudichaudii
MSPQTETKASVGFKAGVKDYKLTYYTPDYQTKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTI

SEQ ID NO: 31568 - protein, 475 aa, Onoseris hyssopifolia
MSPQTETKASVGFKAGVKDYKLTYYTPDYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAVEGNEVIREASKWSPELAAACEVWKEIKFEFQAMDTL

SEQ ID NO: 31569 - protein, 475 aa, Cirsium texanum
MSPQTETKTSVGFKAGVKDYKLTYYTPDYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAKEGNDIIREATKWSPELAAACEVWKEIKFEFEAMDTI

SEQ ID NO: 31570 - protein, 477 aa, Lactuca sativa
MSPQTETKASVGFKAGVKDYKLTYYTPEYETKDTDILAAFRVTPQPGVPPEEAGAAVAAESSTGTWTTVWTDGLTSLDRYKGRCYGIEPVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDQ

SEQ ID NO: 31571 - protein, 476 aa, Pluchea sericea
MSPQTETKASVGFKAGVKDYKLTYYTPEYETKDTDILAAFRVTPQPGVPPEEAGAAVAAESSTGTWTTVWTDGLTSLDRYKGRCYGIEPVPGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHGGTVVGKLEGEREITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLAREGNEIIREAAKWSPELAAACEVWKAIKFEFEPVDTVD

SEQ ID NO: 31572 - protein, 485 aa, Psilostrophe gnaphalodes
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQFIAYVAYPLDLFEEGSVTNMFTSIVGNVFGFKALRALRLEDLRIPVAYVKTFDGPPHGIQVERDKLNKYGRPLLGCTIKPKLGLSAKNYGRACYECLRGGLDFTKDDENVNSQPFMRWRDRFLFCAEAIYKSQAETGEIKGHYLNATAGTCEDMMKRAVFARELGVPIVMHDYLTGGFTANTSLSHYCRDNGLLLHIHRAMHAVIDRQKNHGMHFRVLAKALRMSGGDHIHSGTVVGKLEGEREITLGFVDLLRDDYIETDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 31573 - protein, 325 aa, Vigna radiata
MSTAAGKLVCVTGASGYIASWLVKFLLERGYTVKATVRDTNDPKKVDHLLSLDGAKERLHLVKANLLEEGSFDSAVEGVHAVFHTASPFFNDAKDPQTELLDPAVKGTLNVLKSCVNSPTLKRVVLTSSIAAVAFSDRPKNPDVVVDETWYSDPEYCKRTGLWYNLSKTLAEDAAWKFAKENNIDLVTMNPALVVGPLLQPVLNTSAAIVLGLVNGAKTFKNASLGWVDVKDVALAHILAYENASANGRYLLVERVAHFGDAAKILRDLYPTLQIPDKCEDDKPLEPIFQVSKEKAKSLGIDYIPLEVSLKDTVESLKEKKFLKV

SEQ ID NO: 31574 - protein, 347 aa, Glycine max
MGSASESVCVTGASGFIGSWLVMRLIERGYTVRATVRDPVNMKKVKHLVELPGAKSKLSLWKADLAEEGSFDEAIKGCTGVFHVATPMDFESKDPENEVIKPTINGVLDIMKACLKAKTVRRLIFTSSAGTLNVIERQKPVFDDTCWSDVEFCRRVKMTGWMYFVSKTLAEKEAWKFAKEQGLDFITIIPPLVVGPFLMPTMPPSLITALSPITGNEDHYSIIKQGQFVHLDDLCLAHIFLFEEPEVEGRYICSACDATIHDIAKLINQKYPEYKVPTKFKNIPDQLELVRFSSKKITDLGFKFKYSLEDMYTGAIDTCRDKGLLPKPAEKGLFTKPGETPVNAMHK

SEQ ID NO: 31575 - protein, 2500 aa, Sinorhizobium fredii
MTVEIIGRACLAPGAQSPQALFKILRQGMCTVSSVPGDRWDLARFWHPVMGTPGKTYSFAAGVLDTIYDFDPAVFGMSQREAMYMDPQQRVLLQLAWRALEDANISVASLHGENVGVYIGASSLDHANLTVEDPAAAGPYFMTGNTLSIVSNRISHVFGLSGPSMTVDTACSSSLVALDQAMRALNAGEIDTAIVGGVNILAHPLPFVGFAQARMLSPEGLCRAYDNDGAGYVRAEGGVVFVLRRSDRARRERDRSYARIVASGTNSAGRTNGISLPSREAQANLLKAIYEGNGIDANQVAFVEGHGTGTKVGDPAEVWSIGTVIGARRRAPVPIGSIKSNIGHTEPASGLFGMMKAVLALEHNYLPASLHFDTPNEHIDFEGLNVRVTANPIELLKGKRARLAGINSFGFGGANAHVVISDPDPVQQEKASAASSGHVFLASAHTQSSLENLLKDYKGSFANASKEETRAIIAASGANRTHMRHRFAARSDHPEDIVRAIASHLDNPGSDIGEVGEAPVKNAQVAFVFSGNGSQWAGMGADAFRENLHFRQSFTSVSALFKFHSDIDLKDLLTDPELDKKLADTKIAQPLLFAIQAALSDSLVAMGVKPAAVFGHSVGEIAAAYAAGALTLVDAVSIVAKRSLHQDLLAGQGTMAAVMLGEEAAAAFAEARGLDEVCVAAVNAHNSVTISGPAHEVTAFRDAARKAKIPVQILDINYPFHHPIIDQAKEAFLADIPDIAPRRTELTYLSTVTGSALDGTELDPDYWWKNVREPVRFQAATDAALALGCRLFIEISPRPILASYVKETIKQAAAPATVVATLLRDAAEKGQDPISASMARAVAHGAAVDRPRAYGKRDAFIELPSLPFEPVELRPQATTDATDLFGRSSKPYRLTGWRGDPNSGSWKNHVDAHLFPDLAEHVVDGKAILPGSGFIEIAVSAAQQYYGSDEVEITNLEIVRPLELSDSRIMELSTILSPETGDIEIRSRERLSEDDWTVHAVARSRKPIAGANARHPSISGLAKTGIVTPAKAYDTAKQFGLDYGPHFQLLAKAVAYGDRLIEVELKAPTGSGHPLVTYALHPISVDATFHGLVALFDRFTGEKGGAPYIPVRFGSVRVVNAGRPIARATIEIERVSANSIKARFHFYDAAGEPIAHFDDCRFRRTYLRKHKTLDGLSFHYETVLSDVILPGAKLAGTVPAKLSEPADAGTGVDNATLLFNAAIYRACHEIALKLARGKSTIQGNGLPGDFAFQCFLTNCLYALEDAGLCEHQNGNWKVAPEFTLPTVAEILGELYGERPDRAVEAVLINNAHAEALSRLATLLAGTADGEAAAFNAGFISEATLDHQAVHSVSSRSRMDQVLGMVERALAAQVRGARLRIVELGSVSAGFTRRLADLAARHGTTLSVVEPRDNAQRNLEIAFEEEAHVRILKKSEFAAIGPFDLAVSASDNLYQLVEEEAGIRTALRSTLRENGALVAAVSAPSIFSDFALGLSEGWFERSQTAEFPIGKRAAVSHWQKCLADLELSDVSVSDCECPHGNAILIEARGTAGAARPPASHAGGIPYLLIETDVRRSSAPAGAIPVAASGDLAADIAVLGTAIDGLGEKPVRAVFVSATADHIGDDDSALLQTHVLALSAFAEALKQRAGNAELVGEARPRLVLVAPGGGPVSESASSGVNSGLWTFVRVLQNEYEFLDVHSLDLADRTASYEEMLASALPLLAIEGSNREWLLDRATGLVSEIRAVSGPAAKSEGKISAFSAATIRQRVSSQVSSITWEETDVPRAGPGEIVVSVAATGLNFRDVMWAMGLLPEEALEDGFAGATIGMELSGHVVEVGEGVDDLAVGDAVMAIASAAFSTHAVVSRAGVAKLPQTISPVAAATLPVAFLTAYYAMVELGRIRSGETILIHGAAGGVGLAALQVAKLKGAKVIATAGTREKRRFLTMLGADHVFDSRSLGFVNDVRAVTGGEGVDLVLNSLFAEAMEQSLALVKPFGRFLELGKRDYYADSKIGLRPFRRNVSYFGIDADQLLVNQPELTKRIFMEIGELFDQGRLTPLPYRAFDFDEIGNAFRLMQNAGHIGKIVVLPPVAGQHEIAAKPRRGMKVDPDGMHLVVGGIGGFGLVAANWLVEKGARNIALCSRRGQPDAATSAMVDRWKKAGVAASLHACDVTDAAAVEALLASLRAQAPLRSIVHAAMVLDDALISNLTHERNRPVIDVKAKGAAILDRLTRQDALDNFILFSSATTLVGNPGQANYVAANGYLEGLARARRAAGLAGLAVGFGAIADAGYLTQNADVNDLLAKRIGKTALKAHVALDMVESHIAADPGGVDAAVVMISEIDWGAARNLPVARNALFEVILRSADQHASGTEGTKMDLVAMIEGKSPQEAEDILFDLVAGEIAAILRVAKDTVTRSKILKEIGLDSLMAVELGISFQQNTGFDMPLSGVADNTTVGDVARKLYEKVSKRDQSDDGEAGDDKLVTELTQRHVGAAKEKALSQ

SEQ ID NO: 31576 - protein, 309 aa, Escherichia coli
MSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 31577 - protein, 373 aa, Gibberella fujikuroi
MVRNIVSRLCSQLFALPSSSLQERDPCSVTEYSGLATAVSSCKNIVLNGFQVPTGKQLDLSSLQNDSTVTFKGTTTFATTADNDFNPIVISGSNITITGASGHVIDGNGQAYWDGKGSNSNSNQKPDHFIVVQKTTGNSKITNLNIQNWPVHCFDITGSSQLTISGLILDNRAGDKPNAKSGSLPAAHNTDGFDISSSDHVTLDNNHVYNQDDCVAVTSGTNIVVSNMYCSGGHGLSIGSVGGKSDNVVDGVQFLSSQVVNSQNGCRIKSNSGATGTINNVTYQNIALTNISTYGVDVQQDYLNGGPTGKPTNGVKISNIKFIKVTGTVASSAQDWFILCGDGSCSGFTFSGNAITGGGKTSSCNYPTNTCPS

SEQ ID NO: 31578 - protein, 182 aa, Mesembryanthemum crystallinum
MASSLMSNAATTMAAATTTAQANMVAPFNGLKSISAFPVTRKNNDITSVASNGGRVQCMVWPPLGMKKFETLSYLPPLSEESLLKEVQYLLNNGWVPCLEFEPTHGFVYREHGNTPGYYDGRYWTMWKLPMFGCTDPSQVVAELEEAKKAYPEAFIRIIGFDNVRQVQCVSFIAYKPASYGA

SEQ ID NO: 31579 - protein, 125 aa, Pinus taeda
ISGGAKDLVKRMLEHDPKKRLKAADVLSHPWMREDGEAPDKPLDSTVLVRMKQFRAMNKLKKVALKVIAESLSEEEIRGLKEMFKSIDTDNSGTVTFEELKNGLARFGSKISETEVRQLMDAVST

SEQ ID NO: 31580 - protein, 125 aa, Pinus taeda
ISGGAKDLVKRMLEHDPKKRLKAADVLSHPWMREDGEAPDKPLDSTVLVRMKQFRAMNKLKKVALKVIAESLSEEEIRGLKEMFKSIDADNSGTVTFEELKNGLARFGSKISETEVRQLMDAVST

SEQ ID NO: 31581 - protein, 211 aa, Isochrysis galbana
LKSFNTTDLLAELKRRMEGKPKKNIILVGPPGSGKGTQAPLIKEKYELCHLATGDLLRAAVEAGTDMGKKAKSVMESGGLVSDEIVIGIIKDNIAAPECNNGFILDGFPRTVTQAEKLDGMLIEQGAGKIDAVIEFKVPDETLVERICGRLVHPASGRSYHEKFAPPKVAGKDDSDWGASHQAERRQRRDAQEEARCLPQADQAGRRLLCQ

SEQ ID NO: 31582 - protein, 186 aa, Isochrysis galbana
PMAGTPAYAELKPAAAAAKGSKTVMILFGPPGAGKGSHAPKIVEAFKIPQLSTGDMLRAAVAAGTEVGKQAKTVMESGGLVSDELVVSIIRERIKEEDCTSGFILDGFPRTVEQAKMLDEVLAGIGEKVNHVVALEVPDAVLTERICGRWVHKESGRSYHIKYAKPKSLPDGAEPTEDNMKDDETG

SEQ ID NO: 31583 - protein, 285 aa, Heterocapsa triquetra
  misc_feature (254)..(254): Xaa can be any naturally occurring amino acid
MPARRSKSAAVAVAVALGVAGECFVAPKAAASDLVASGRVAGVAATAPTDEASSFASAGVLPAVSLGVVALAAIGASKATASRRTREQHKVALAARGGADGRLVVIAGPPAAGKGTQCEKIKEKYGYVHISTGDILRENVKAGTELGKKAKGFMDSGALVPSELIVDLVKDRLDQPDVKEKGCLLDGFPRAPDQAQAMVDAGLKVQRMLLIEVPDETLVERGCGRRLDPETGDIYHLKFKPPPEDIVDRLVHRXDDQEEAIPNRLKGYHSQIDGIVPSSRTPWSH

SEQ ID NO: 31584 - protein, 452 aa, Heterocapsa triquetra
EIKKRAEGDMKGFLGYCDEDLVSTDFETCTISSTFDSKACIMLDPTFVKLVAWYDNEWGYSCRVVDLIKHMAKVDAGESGAAPKGVKKSVADLSDADLDGKTVLIRCDLNVPLNGDLEITDETRITASIPTIEYLCKKGAKVLACSHLGRPKNGPEDKFSLKPVAKRMSELMGKEIKCAPDCKATDEVKKMVGAMGKGDVMILENTRFYKGETKNDPELAESMASLADLFVNDAFGTAHRAHSSTEGVTKFLKPNVSGFLLKKELDYLAGAVDSPVRPMCAIVGGAKVSTKIPVIESMLDKVDKLVIGGGMVFTFLKARGLSVGGSLVEEDMLDLAKKLEEQAKAKGVELILPSDIACGDAFPADGKEVGFKVVPAIEIPDGWLGLDNGPDATEEIKKALADCKTVIWNGPMGVFESPQFSKGTYEIAECLARSRRRTAPSPSSAVATPCQP

SEQ ID NO: 31585 - protein, 415 aa, Heterocapsa triquetra
  misc_feature (219)..(219): Xaa can be any naturally occurring amino acid
PAKLSIDDVDVAGKRVFMRVDFNVPQDKKDPTIITNTQRIDGALPTIQAVLAKGAKCVVLASHLGRPDGSVMEKYSLAPVAKIVEEKLGKPVTFCKDCCGPEVEATCADPAMGSVILLENLRFHVEEEGKGVDASGEKIKADKEKVKEFRASIRKLADIYCNDAFGTAHRAHSSMVGEGFDVKCSGGLMAKELSAFAKVLDEPARPLLAILGGAKVSDXIQLIMNMLDKVNKIIIGGGMAYTFLKVKDNMSIGTSLYDEEGANIVPDILKKAEEKGVELILPVDFVISSKFGEDGEIKTATKEEGIPDGFMGLDCGEKTLELNRAGVAASKTIIWNGPMGVFEMAKFETGTKTLMDDIVKRLRMASFTVIGGGDTATACKKYGTEDKVSHCSSGGGASLELLEGKDLPGVSALND

SEQ ID NO: 31586 - protein, 436 aa, Isochrysis galbana
MVARTATLALALFGGAEALRIGAAPMRSTSRTCTIEMAKKSVGDLTKADLEGKRVLVRCDLNVPLDGKTITDDTRIRASIPTIKYLIDNGAKVLLSSHLGRPKGGPEDKFSLGPVAPRLSELLGKEVTMAPDCIGDAVADCVTKMANGDVLLLENTRFYKEEEKNDPEFAEKLAANADMFVNDAFGTAHRAHGSTEGVTKFLSPSVAGFLLQKELDYLDGAVSDPKRPFAAIVGGSKVSSKIGVIESLMEKVDKIVIGGGMVFTFLKARGLETGSSLVEEDQLELAKKLEVIAKEKGIDFILPTDVIVADKFAADAATQIVSVDAIPEGWMGLDNGPESTKMIQQKLSECKTIIWNGPMGVFEFEAFAKGTFDVADTLAELTGKGCTTIIGGGDSVAAVEKAGLAEKMSHISTGGGASLELLEGKVLPGVAALQEA

SEQ ID NO: 31587 - protein, 448 aa, Isochrysis galbana
VPQDKKDPSVITNTARIDGAMPTIKYCLDGGAKAVILMSHLGRPDGLPKPEYSMAPVAKCLEAIVGKPVTFLKDCVGPEVEAACADPEPGSVILLENLRYHVEEEGKGLDEAGAKVKASPESVTAFRASLAKLGDVYVSDAFGTAHRAHSSMVGDGYEVKTSGFLVAKELEAFGKVLDAPVKPVLAILGGAKVSDKIQLIKNMLDKVDKMIIGGGMAYTFLKVLHNMPIGSSLYDEEGAKIVSEIMADAKAKGVEITLPVDFVISSKFGEDGDISTATLDAGIPDGFMGLDCVAKVHRDEQGGDHGLQDDHLERPDGRLRDVLLRDGHQEHDGHHRGGHHRRSHHRHRRGGHGHLLQEVRHRGQGDARLDRWRRIARAPRGKGSAWSRGPDGQVKQLMAAPESGRLGRHMARETCARLRKSAKVELRGLWAWMLGCGCAPAVEGWLRE

SEQ ID NO: 31588 - protein, 419 aa, Pavlova lutheri
MSLSSKLQLSSVDVKGKRVLIRVDFNVPQDKKDPSKITNTARIEGALPTIKHCLDSGAKSVVLMSHLGRPDGSRVDKFSLKPVAGELEKLLGKPITFLSDCVGEEVEAACAAPADGSVILLENLRFHIEEEGKATTESGEKLKADPAKVAAFRASLAKLGDVYVSDAFGTAHRAHSSMLGEGFTTKAAGFLVAKELVAFAKVLDAPARPVLAILGGAKVSDKIQLIKNMLDKVDKMIIGGGMAYTFLKTTNSMPIGSSLYDEEGAKIVPEIMALAKEKNVEIHLPVDFVTSSKFGEDGTIGAATLAAGVPDGMMGLDCGPKSSEAFAKVIMESKTIIWNGPMGVFEMASFETGTKAMMDVMCKATEAGIVTVIGGGDTATCCKKYDTEDKMTHVSTGGGASLELLEGKEMPGIAALSSA

SEQ ID NO: 31589 - protein, 418 aa, Guillardia theta
MSSLNKKQLKDVDVSGKRVFIRVDFNVPQDKADPSKITNNARIVGALPSIKHCLEKGAKSVVLASHLGRPDGARIEKYSLAPVAKELSKLLDKEVKFLNDCVGAEVEAACADPAPGSVILLENVRFHVEEEGKGEVNGEKIKADPAKVKDFRASLRKLADVYVSDAFGTAHRAHSSMVGEGYDVKCAGFLVAKELENFSKVLDNPTKPVLAILGGAKVSDKIQLIKNMIPKVDKMIIGGGMAYTFLKVLDKMEIGTSLYDEEGAKIVPEIMSLAKEKNVEIVLPVILSSPRSLERDGETGTATKAEGIKAGFMGLDCGPESIKKNREAIMSSKTIIWNGPMGVFEMSKFEGGTKAMMDGMVEATSKGVLTVIGGGDTATWCVKYNTEDKVSFVSTGGGASLELLEGKVLPGVSALSDA

SEQ ID NO: 31590 - protein, 442 aa, Kryptoperidinium foliaceum
GRATESSILHCTIMVQTRKRNVGDILESLPSDGGAKNILVRVDFNVPLNGSFEITDDSRIRGAMPTIESILKAKHNAILMSHMGRPKAVQKGEDTDGSQRKALTLQHVQKRLSELSGVDVQFVDDCIGDKVKDAVSKLPKEGGAILLLENLRFYKEEEKNAPEFAKSLASIADAYVNDAFGTSHRAHASVSGVPGLMPKEKCAVGSLVAKEVAFLDFSSLGEDEVVAAVIGGSKVSTKLPVIKGLLNQVHILVLGGGLAYTFAKAKGITIGTSLCEEEMVETAKDLIREAEVKGKKLILPIDAVCSKEFPKGEMKMEDTQTFDLVPGNGITDGWMGLDVGPKTAALFDQALTTATKIVFNGPMGVFEIRPFDEGTKAMVDTLEAVTKKGAITVVGGGDSVAALEQFHKTDVVTYVSTGGGATLELLAGDTLPGVAAIADLEE

SEQ ID NO: 31591 - protein, 309 aa, Heterocapsa triquetra
YDSPFGCCGAPLRRGRAQGFVAPLAGSASASRVPRVVRGASATSLMASRATPSKSPPEACTASSCSRSRSSCLSENQAVAQGFVEEKVEVAQEEPSILKWVGAGVLAGLLAAVSAAPPVHATADFRVTFSPEKFTIKAAKHLEPCKDNKKYHKKIKDQIYKITNRQKKYPKDSIIYNRFEKKIAGVQRREEAYGDRFCGKKDGLPRVIASGEIVRGGVVVPALMFLYTAGWIGWAGRSYLIRTGDEMKELNIDVPLALTCMASGFSWPVAAWQDIVNGRMVVDDRTCTAASGETGGCPVLRGSVGFGCF

SEQ ID NO: 31592 - protein, 1060 aa, Pichia pastoris
MPSISQRGSRNNSFSSETTVPSLAEASAVSPFGLPTDPESLYGTTLTSAHTVITTVPYYLSDRLFSYAAPGADGALDAAAHLWRTYLRPNAQGNVPHLTRFDIRSGASNAILGYLSGLEPSAVVPVLVPGAALTYMRPVLAERRDSPVPVAFNVSALDYDFETSTLVSNYVEPLNAARYLGYSVFTPLSKNEAQSIAILTHALANIEPTLNLYDGPSYLKQSGKIEGILTGEKLFQLYQKLLAEIPSWSKIESYKRPAAALASLSKLTGSRLKSFEYAGHNSPSTVFVIHGSVESELLLHTVERFAEKDVQIGAIAARVPLPFNIDEFASSFPSSTRRIVVIGQVQSSSSSSLKKDVTASLFWKLGASAPAVAEFVYEPSFNWSSDSLESIIASYEVLPKSTSATKGDYIFWTADNGRFAEVASKIAYSFSLRDDNKLSYRAKFDNINGAGVLQAQLRTNSLVATDIDAADIVFVEGFKLLQAFDVVSTAKEGATLIIASSDSIEDLDKVVESFPTTFKRDAATKNLKILLIDLASVGEQEGLGARTGPIACQAIFYRVAQPELADQLTRYLWEGAASETELLASVVAEVISKVEEVGIKELSVDKEWASLPTGEEEEVILPPRPLETSFEPNLRESAIVPPPAISSKLELSKKLVFKESYGLTNSLRPDLPVRNFIVKVKENRRLTPDDYSRNIFHIEFDVSGTGLTYDIGEALGIHGRNDPALVEEFIQWYGLNGEDLIDVPSRDDPNTLETRTIFQSLVENIDLFGKPPKRFYEALAPFALDSSEKAKLEKLASPEGAPLLKAYQEDEFYSFADILELFPSAKPTASDLVQIVSPLKRREYSIASSQKMHPNEVHLLIVVVDWIDKRGRQRFGQCSHYLSELSVGSELVVSVKPSVMKLPPLSTQPIVMAGLGTGLAPFKAFVEEKIWQKQQGMEIGEVYLYLGARHRKEEYLYGELWEAYMDAGIVTHVGAAFSRDQPHKIYIQDRIRENLKELTSAIADKNGSFYLCGPTWPVPDITACLQDIIESDAARRGVKVDADHEIEEMKESGRYILEVY

SEQ ID NO: 31593 - protein, 266 aa, uncultured bacterium
MNRIEARFQELRRQGRKAFIPYIAAGDPTLERTAEIVLALEQAGADVVELGIPFSDPLADGAVNQEAALRALRHGASLRDVLGMVKTLRQRSHVPIVLFTYFNPVHSYGLDRFGPDCRDAGVDGVLCVDLPPEEAGEYKASLDALDIATIFLLAPTSTDKRIETVSRHCTGFVYYVSRTGVTGEQARVGEDVRAMVAKIKQHTDKPVAVGFGISKPEHAAEIARYADGVIVGSAIVRMIGELGDSPETAPKVGEFAKSLADAAKHA

SEQ ID NO: 31594 - protein, 261 aa, uncultured bacterium
MDRIEKAFRNNQPYIGYLTGGDGGIEASVNYALALIEGGVDLLEIGFPFSDPVADGPVIQKAHERALAGGTTSATLLEIARRVRKVSDVPLVLFSYFNPVLQKGAQFLNELKSAGFDAVLIVDLAVCTDTSDSEPFFNALADAGLIPILLATPSTNLERLEMISKMAKGFLYYVSQKGTTGIRSQLADDFSTQMMRMKQLFQIPVVAGFGIADRANAQAVLEHADGFVVGSAFVKLIEQKKAPKELTKFAQSIDPRKEAIA

SEQ ID NO: 31595 - protein, 265 aa, Wolbachia endosymbiont of Drosophila simulans
MKIKRALISVYDKTNIIDLASFLTQQQIEILSTGNTYKTLSSAGIKTQEVSDYTQFPEILGGRVKTLHPKIHGGILCNREKHKTEIQNLGIKPIDLLITNLYPFWETVNSGSNEEQIIEQIDIGGVALIRAAAKNFRFTSVISSIQDYEALKAEMIKNNNKTTLEYRKHLATKAFALTAHYDSNIHSWFLSQSKNNELPEFFALYGHKVQELRYGENPHQKAAFYSNQFTKYPLEKIHGKELSYNNIVDIESALNITSEFKNMQQ

SEQ ID NO: 31596 - protein, 494 aa, Wolbachia endosymbiont of Drosophila simulans
MEACYSFDDILLLPAYSNILPCGADTKTYLTNNIELNIPLISSAMDTVTESGFAIAIAQHGGIGCIHKNLSIDEQVLEVRRVKKYESWIVYNPITISPDKTVAEAISLMREHNYSGIPVVDQRKLVGILTNRDVRFIEDQNMNVKVSEVMTKDKLVTVREQGVNSASAMKLLHENRIEKLLVVDENSCCIGLITVKDIEKYNRYPNSCKDSKGRLRVAAAIGTGKKDGIDRCEALIGEEVDVVVVDTAHGHSENVINTIREIKKMYPNTQLIGGNIATKEAAEALIDAGVDAVKVGIGPGSICTTRIVTGVGVPQFSAIKNVAEACRARNVRLIADGGVKYSGDVAKAIAAGADSVMIGSIFAGTDESPGEIIMYKGRAYKGYRGMGSISAMKRGSASRYFQDKDSKLKLVPQGVEGRVPFKGPASGVIHQLIGGLQAAMGYTGNRNIEEMKKNCKFVTITASGLRESHAHDIVITQEAPNYAYQTSNLSTDSE

SEQ ID NO: 31597 - protein, 232 aa, Wolbachia endosymbiont of Drosophila simulans
MNGMRSSFVDFIGKLNNKSNEITSKLVICPPFTSFPSSIELNNNINIGAQNCHHKKFGSYTGEISAEMLKELGCTYVILGHSERANEKDSEIKLKSEIAIESGLHPIICVGENSEDYKNEKTKEVIEYQCKNRLPTHGEYTVAYEPIWAIGTGHVPNNDAIAKVIEVIKLCTSKKHIIYGGSVSSENIENLLNISNLSGVLIGSASLDFDHFYKIIQQVEKKFSLINSKISN

SEQ ID NO: 31598 - protein, 429 aa, Wolbachia endosymbiont of Drosophila simulans
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFKAKRYIDEIKKSAPNLYNLCFKYFTPQERFLYLKQRDFAGIEGISIDYLVMEKAKNVAMIEANFDWLDVGTWNSVLELSEKFSKEPVSFQHVIREKEPVSTTKSNKNLLGGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 31599 - protein, 507 aa, Wolbachia endosymbiont of Drosophila simulans
QDFKILENLKTKALEAEKGGGSDRITKQHEKGKLTARERLSILLDESSFAEYDKFVKHHANDFGMQNANFLGDGVVIGHGTIYGRKVFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHTSKTGVADFAFNNDVEMLLKMREFFTFLPANNQESPKSAPICNDVDDIDESLNTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASHGYIDDIIVPSKTRYHFCKALELLKNKKVERIWKKHDNLPL

SEQ ID NO: 31600 - protein, 390 aa, Wolbachia endosymbiont of Drosophila simulans
MFLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 31601 - protein, 391 aa, Wolbachia endosymbiont of Drosophila simulans
INKIDKSEPGDVEKIINSLPQYDLIPEGLGGDVMIVPVSAKKKTNLDKLEETILLIAELMKLEAIEDCRALGWVIESKIDKAKGISATLIVEEGTLKVGDILVVGTTYSKVRSMVNHLGQREKAALPSAPIEITGLNGVPNAGDKFVVINSEKQAREIVEYRLELIKKKKEDLGDNNLDIFSRNNSETEELSVVLKCDVTGSIEAISSSIDKLGKDQVKLNILHKAVGGITDSDVLLAEASSAVILAFNVKVDSKIRDLAKQKGIEIHTYNIIYELIDDMRMYLTKMLKPVTREVRVGFASVRQIFNVSKAGNIIGCYVSDGVIRKDSLIKVMRGGKLVHEGKLKALRRFKDDVKEVGVNFECGVSLEGNIDIKVGDILEAYQLVQEERVL

SEQ ID NO: 31602 - protein, 191 aa, Wolbachia endosymbiont of Drosophila simulans
MTDYDLIVIGGGPGGYKCAIAAAKLGLKVACIDKNSIFGGTCLRVGCIPSKALLHSSYQYAHTKNDLSKLGIKIKDASFDLKEMLGYKDARVQELGKGIEYLFNLHKITKINGLASFDQGNLEVSVEGKVLKTKNIVIATGSDVISLPGINIDEKNIISSTGALSLTEVPKKLVVIGAGAIGLEMSSVGAG

SEQ ID NO: 31603 - protein, 359 aa, Wolbachia endosymbiont of Drosophila simulans
DVARDYSYSNVGTPTVHYFSNALAEIEGSGQALIFPSGLFALTFAILTFTKAGSHVLIQDNSYYRLKRFAENELPNRGIEVTFYDPTQDITDLIQSNTSLIMIETPGSVTFEISNIEHIVKVAKERGIVTVCDNSWATPLLFKPLDYGIDVALYAVTKYLAGHSDLLMGTMIAEGEIFKLLYESYKNYGVTIQSHDCYLAHRGLRTLHTRMKKYQNTAMEVAKWLEAQQKVRKVLYPALPSHPQHELWKSYFKGASGVFSIVLGREYSCEELSCMVDHMKIFGIGASWGGCDSLILPIDRRSMSRSVMNSDYGGSFIRIFCGLEDPEDLIFDLNDALKRLPCLDFQNDEVGHETERITA

SEQ ID NO: 31604 - protein, 225 aa, Wolbachia endosymbiont of Drosophila simulans
MNLSLSFDDRTVLKDLNFDILKGESLVILGGSGSGKSVLTKTIIGLLAPDSGSVKINSKSKNKFGVLFQNSALFDYVTVWENISFNYKKRFNISKKEAKQLAIEKLNDVGLEESIADMFPIELSGGMKKRVALARAIAHNPEIIILDEPTSGLDPIMSDIVNEIIIKLSRDLNPTIITITHDIHSAFKIADKIAVLYEGEIISHGTVQEIQNTNNQYIKKFIRYI

SEQ ID NO: 31605 - protein, 439 aa, Wolbachia endosymbiont of Drosophila simulans
MNIGSGRVVIQSLQRINQEIGTIENNVNLQSFISNLKSKNGVCHIMGLVSDGGVHSHQKHISTLANKISQHGIKVVIHAFLDGRDTLPNSGKKCIQEFIKSIKGNDIRIATVSGRYYAMDRDNRWERTIEAYEAIAFAKAPRHDNAVSLIDENYQNNITDEFIRPAVIGDYQGIKPEDGVLLANFRADRMIQLASILLGKTDYAKVAKFSSILSMMKYKKDLQIPYIFPPTSFADTLGQTIEDNKLQQLRIAETEKYAHVTFFFNCGKEEPFSGEERILIPSPKVQTYDLQPEMSAFELTEKLVEKIHSQEFALIVVNYANPDMVGHTGNIKAAEKAVLAVDDCLAKVLSAVKKSSNTALIVTADHGNVECMFDEENNTPHTAHTLNKVPFIVSCDNLKLRDGRLSDIAPTILQLLGIKKPDEMTGSSLISCITLCHSS

SEQ ID NO: 31606 - protein, 157 aa, Wolbachia endosymbiont of Drosophila simulans
MALMKTVYVCQSCGHSTGRWVGKCIACDNWDTVVEEIAVKTGKRSISAPILIKTLSGSEIITPSRFLTGIEELDRVFGGGIVQGASILIGGEPGIGKSTLLLRIAANVVQLSSFECLYVSGEESLEQVSLRAKRLKINEPKIKLLSTVSLTDVVANN

SEQ ID NO: 31607 - protein, 223 aa, Wolbachia endosymbiont of Drosophila simulans
MVDTVLYFEGENSNQYRILRTIKNRFGPANEIGVFEMSEAGLVPVDNPSSLFLMAHDREVVGSAVFAGIEGSRPILMEVQALIAGTNMATPRRAVVGWDINRLAMIIAVLNACCKMFLHDKEVYLNIAGGLKIQEPSADLAVAASLISSVVNLPLPTSSIICGEVALSGEIRNVSHADLRLKEAQKLGFKKAIMPKNGNYSSHDIEIIKLGHVRELREIFNYN

SEQ ID NO: 31608 - protein, 322 aa, Wolbachia endosymbiont of Drosophila simulans
MNKIINNVFAREILDSRGYPTIEVEIELCDGAIGRASVPSGASTGKLEALELRDQDEKRYCGKGVLKAVQAVNGIIADEIIGMNAADQNAIDKALIELDGTKNKSKLGANATLGVSLAVAKAAANSFKMPLYRYLGGKQTSVMPVPLINIINGGVHADNKLDFQEFMILPVGAETFSEAIRISAEVFHNLRSILKKKGYSTNVGDEGGFAPNIESTEEALDLIIYAIESAGYSAQSDFALGLDVASSTFYEDGIYEFESKGLTSEELTEYYCNLVERYPIISIEDAMSEDDYEGWKLLTAKLGNKIQLVGDDLFVTNCELIC

SEQ ID NO: 31609 - protein, 115 aa, Arabidopsis thaliana
MPCLNLSTNVNLDGVDTSSILSEASSTVAKIIGKPENYVMIVLKGSVPMSFGGTEDPAAYGELVSIGGLNADVNKKLSAAVSAILDTKLSVPKSRFFLKFYETKGSFFGWNGATL

SEQ ID NO: 31610 - protein, 34 aa, Clarkia amoena
KFLQGAHSIDQHFSSAPFEKNIPVLLGLLSVWNV

SEQ ID NO: 31611 - protein, 203 aa, Clarkia lassenensis
KFLLGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVVKSQQPVYLKGEVVNNHDELMSNFFAQPDALAYGKTPEQLTKENVSEHLIPHKTFTGNRPSISILLPTLDGYRIGQLLAIYEHRVAVQG

SEQ ID NO: 31612 - protein, 256 aa, Clarkia gracilis
KFLQGAHSIDQHFSSAPFEKNIPVLLGLLSVWNVSFLGYPARAILPYSQALEKLAPHIQQVSMESNGKGVSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPTLDAYRIGQLLAIYEHRVAVQGFVWGINSFDQWGVELGKSLATQVRKQLHASRVKGETVEGFNFSTKTLLTRYLE

SEQ ID NO: 31613 - protein, 283 aa, Astragalus membranaceus
MGKDVEVAEHGEFSAKDYTDPPPAPLIDMAELASWSFYRAIIAEFIATLLFLYITVLTVIGYKSQSATDQCGGVGILGIAWAFGGMIFVLVYCTAGISGGHINPAVTFGLFLARKVSLIRAVMYMVAQCLGAICGVGFVKAFQKSYYVKFGGGANELADGYNKGTGLAAEIIGTFVLVYTVFSATDPKRSARDSHVPVLAPLPIGFAVFMVHLATIPITGTGINPARSFGAAVIYNKDKAWDDQWIFWVGPFVGAAIAAFYHQFVLRAAAIKALGSFRSNAHN

SEQ ID NO: 31614 - protein, 385 aa, Gossypium hirsutum
MVHCLPKVSVIQDKPMLPPTAAVAKNKHRPLAFDASILGSEISSQFIWPDDDKPCLDAPELVIPTIDLGAFLLGDSLAVSKAAEAVNEACKKHGFFLVVNHGVDSGLIDKAHQYMDRFFSLQLSEKQKAKRKVGESYGYASSFVGRFSSKLPWKETLSFRYCPHTQNIVQHYMVNWMGEDFRDFGRLYQEYCEAMNKVSQEIMGLLGISLGLDQAYFKDFFDENDSILRLNHYPPCQKPELTLGTGPHTDPTSLTILHQDQVGGLQVFADEKWHSVAPIPRAFVVNIGDTFMALTNGIYKSCLHRAVVNTETVRKSLVFFLCPKLERPVTPAAGLVNAANSRKYPDFTWAALLEFTQNHYRADMKTLVAFSKWVQEQESNNKLIP

SEQ ID NO: 31615 - protein, 342 aa, Pseudonocardia autotrophica
SHPTPGPATALANVASLFHLREGATTLVPAPLYHSAPNAHAVFSLAMGMDVHVMPRFDAEGFLRLVEQHRVTTVQMVPTMFVRLLQLPEPVRRSYDLSSLTAIVHAAAPCPPQVKAAMIDWLGPIVHEYYGGAEIGAFTACDSTEALTRPGTVGRPVLDADVRILDEHGTELPTGEDGIVYGRPFSGWPDFTYIDDDAKRRGMEQEGYLTLGDIGHLDVDGYLYLADRQNDMVISGGVNIYPAEIEACLHDLDGVADVAVFGIPDSDMGEAIAAHVQPLPGATLAAEDIRDHVSSRLARYKVPREVVLVEELPREDTGKIFKRLLKEKYLSPDRPLTDRSST

SEQ ID NO: 31616 - protein, 403 aa, Mycobacterium tokaiense
MTTPRHVAVVGGSLAGLRSAEQLRALGHTGPITVFSAERHLPYNRPPLSKEALGEFESATAEELAGRLAFRRRASIADVDIRLATPVATADLGAHRLTLDSGDEQAYDALVIATGLRPRRLVAPGPARGRHVLRTVEDCVGLRAALRPRSRAVVIGGGFIGCEVAGTLRTLGHHVTVVEPAGPPMQRVLGSDLAAAVQGHLTARGIEFVIGTGVDSFTGDDAVTGVELATGETLSADIVVEAIGSTCNVEWLYGQGLDLSDGVLTDNRLAVAGVADTVAVGDLARFPNPLFDDVPRRVEHWSIPGDTANRAAATLVGPHDNDAPFAPVPAFWSNQLDLRLQSYGSPALADAVHLEEGSVDDLTGGVILTYHRDHRHVGTVAANLSPARLRELRSAFTAVQLPA

SEQ ID NO: 31617 - protein, 172 aa, Brassica oleracea
VADFGLSRLFPMDKTHVSTAPQGTPGYVDPDYHLCYQLSKKSDVYSFAVVLMELISSLPAVDITRTRQEINLSNMAVVKIQSHKLHEMVDPSLGFDTDTRVKETVIAVAELAFQCLQSDKDLRPCMSHVMETLTKIENNGFGSNMDGDSNGDKSGPLVVQSPNSVMVKWDSK

SEQ ID NO: 31618 - protein, 319 aa, Nicotiana tabacum
MENFPIINLEKLNGSERADTMEMIKDACENWGFFELVNHGIPHEVMDTVEKMTKGHYKKCMEQRFKELVASKGLEAVQAEVTDLDWESTFFLRHLPVSNICEVPDLDDQYREVMRDFAKRLEKLAEELLDLLCENLGLEKGYLKKIFYGTKGPNFGSKVSNYPPCPKPDLIKGLRAHTDAGGIILLFQDDKVTGLQLLKDGQWIDVPPMRLSIVVNLGDQLEVITNGKYKSVMHRVITQTDGTRMSLASFYNPGSDAVIFPAPTLVEKEAEESKAIYPKFVFDDYMKLYAGLKFQAKEPRFEAMIKAMETVKSDPVATA

SEQ ID NO: 31619 - protein, 168 aa, Solanum tuberosum
MLVYQDLLTGDELLSDSFPYTEIQNGMLWEVHGKWVVHGAVDVNIGANPSAEGGGEDEGVDDQAVKVVDIVDTFRLQEQPAFDKKQFVTYIKRYIKSLTPKLEGEAQEAFKENIESATKFLLSKLKDFQFFVGEGMHDDSALVFAYYKDGSADPTFLYLAPGLKEIKC

SEQ ID NO: 31620 - protein, 396 aa, Thiomonas cuprina
MAKSKFERTKPHVNVGTIGHVDHGKTTLTAAITTVLSSKFGGEAKAYDQIDAAPEEKARGITINTAHVEYETANRHYAHVDCPGHADYVKNMITGAAQMDGAILVVSAADGPMPQTREHILLARQVGVPYIIVFLNKCDMVDDAELLELVEMEVRELLSKYDFPGDDTPIIKGSAKLALEGDKGELGEGAILKLAEALDTYIPTPERAVDGAFLMPVEDVFSISGRGTVVTGRVERGIIKVGEEIEIVGLKPTLKTTCTGVEMFRKLLDQGQAGDNVGILLRGTKREEVERGQVLCKPGSIKPHTHFTAEVYVLSKDEGGRHTPFFNNYRPQFYFRTTDVTGAIELPKDKEMVMPGDNVSITVKLIAPIAMEEGLRFAIREGGRTVGAGVVAKIIE

SEQ ID NO: 31621 - protein, 400 aa, Wolinella succinogenes
MAKKKFVKYKPHVNIGTIGHVDHGKTTLSAAISAVLATKGLCELKDYDAIDNAPEERERGITIATSHIEYETENRHYAHVDCPGHADYVKNMITGAAQMDGAILVVSAADGPMPQTREHILLSRQVGVPYIVVFLNKEDMVDDAELLELVEMEVRELLSNYDFPGDDTPIVAGSALKALEEANDQENVGEWGEKVLKLMAEVDRYIPTPERDVDKPFLMPVEDVFSIAGRGTVVTGRIERGVVKVGDEVEIVGIRNTQKTTVTGVEMFRKELDKGEAGDNVGVLLRGTKKEDVERGMVLCKIGSITPHTNFEGEVYVLSKEEGGRHTPFFNGYRPQFYVRTTDVTGSISLPEGVEMVMPGDNVKINVELIAPVALEEGTRFAIREGGRTVGAGVVTKITK

SEQ ID NO: 31622 - protein, 2738 aa, Debaryomyces hansenii
MASYLPQEEFETNVYKYDETPENKSWASTLPTAKGLYNPEYEKDACGVGFTCHIKGEASHKIVSDCRNLLCNMTHRGGELNPKDGDGAGLLSSLPHKFFLREFKYYCNIDLPKLGQYGTGNIFFKKDDIVFEKSRKTFESIANTLGLKVLGWRKVPHDSSILGPASLSREPLILQPAIVLSELFDGQHKEISEEEFEKNYQMDFEKKLFILRKQSTHTIGLHNWFYICSLSSKTIVYKGQLAPNQVYAYYHDLANAEYEAHFALVHSRFSTNTFPSWDRAQPLRWAAHNGEINTLRGNKNWMRAKEGVMESELFGDELDKLYPIIEEGGSDSAAFDNVLELLVINGVLSLPEAVMMLIPEAWQNDIHIDSKKKAFYEWAACLMEPWDGPALFTFADGRYCGANLDRNGLRPCRYYVTDDDRMICASEVGVIEIEPEKILQKGRLQPGRMLLVDTKEGRIVDDRELKNKVASRFDFKSWVLANMISMDDLFSKLESRNVNLIENPESQDITVQTDPRLVAFGYSHEQISMVLAPMAEAKEALGSMGNDNALACISEQPKLLYDYFRQLFAQVTNPPIDPIREEIVMSLECYVGPQGNLLEMKPDQCNRLLLKSPVLSSLELNAIKNIEKVYPKWSVTNIDITFDKAEGIQGYINKIDNICQASSKAIADDHQIIILSDKLTSFNRIPISALIATGAVHHHLVRQKQRSKVAIIIETAEAREVHHACCLVGYGADGINPYLALETLVRMNIENLLKASLTDDQIIKNYKIAVDSGILKVMSKMGISTLASYKGAQIFEALGVDNSVIDRCFAGTASRIKGITFEYIAQDAFSLHDVGYPSRETIKPVALPETGEYHWRDGGDSHINEPAAIASMQDAVKNKNEIAYEAYSKKEYEAIKKCTLRGLLDFDYENSQSIPIDQVEPWTEIVRRFFTGAMSYGSISMEAHSTLAVAMNRLGGKSNTGEGGEDSARSLVHSNGDTMRSSIKQIASGRFGVTSHHLSDADELQIKMAQGAKPGEGGELPGHKVSEQIGKTRHSTPGVGLISPPPHHDIYSIEDLKQLLYDLKCSNPRARTSVKLVSEVGVGIVAAGVAKAGSENILISGGDGGTGAAKLTSIKYAGLPWELGLAESHQTLVLNDIRGRVILQTDGQLRTGRDIAVAALLGAEEWGFATTPLIALGCIMMRRCLASDTLVRTSEGDKPVAEVAIGDYLLDAEDKPVLCMGANPSQTGRMKEIAYQDFDSKKRVSFKCTPDHHLELTLTDSTPSLSGKSVTWFSRCTGAHLSEEVSEVYLDNMVSIFYNDLVDSTDSAVDKDSIHEAVDLALEDHYHRGNSDQYSIHLNEYISRIADKELQNEPEFIRECIHDAANRFVITSSGNRNIKSESFDDKLLLSRSRSSTADSDSDYVITDASVHSHSNNSSVYLASPDSMIPDGAANRFENIASKLKEPVCNCGGIRKIFRSFGTTEDAELAYSLLLSEHYYRLDPRFVTDGYTFQASVEQYENMCSQEVQNMHLKLYRSPLKFVEREHNSAELPVDPYFLGLWLGDGDSSGTTIMTTDREIVVWLNSYVERLNQNKPEGCFPLKLTEQLIYGAGHTSKSGHTTKVDVRNYKISSGDAFVRSGTYWNPIFDGLKKLGLLNNKSAGIPQEYMNSDEQNRLSVIAGLMDSDGCYVKSHNTYRFTQLTEDHKKIVYDLKELALSCGINTTGVELSVKPLGFNKHKHSTEYVVYLGNGSQKFQELLLLPRKKMEISKKHVSLDARPFTVSDVEDGEFRAIEVSGGVFQLANRLVVANCHLNTCPVGIATQDPELRKKFTGTPEHVINFFYYLANELRGIMANLGFRTVNEMIGRTEKLKVREDLRNTKNANMDLSPILTPAHTIRPGVATHCVKKQDHRLHVRIDNKLIDESEITLAKGLPVTIDCDVVNTDRSLGTTLSYRVSKTFGEQGLPHDTIHVNVNGSAGQSFGAFLAPGITLELEGDANDYVGKGLSGGRIIVYPPKESKFNAEDQIIAGNTAFFGATSGAAFIRGIAAERFAVRNSGANIVVEGTGDHGCEYMSGGRVVVLGSTGRNFAAGMCGGIAYVLDMAQDFGDKVNSQNVELSQITEASEIAFVRGLIEDHRHYTSSAVAENILNNFDRILPRFVKVLPYDYEKVLENEKKKQEEAKKNELNTFIKSIKEDPESDATNGEAAKIRKGHIHRPSLATVSAKDCSHEPNVLDLEDTIFDTEVEKKSVAKLDKLKGFMKYKRRNEKYRDAKKRTNDWNEMTSRLTKDELKYETARCMDCGVPFCTSDTGCPISNVIPKWNELVFQDRWYDALQRLLMTNNFPEFTGRICPAPCNGACVLGINSDPVNIKSVECAIIDHGFEQGWIKPEPPQHRTGKSIAVIGSGPAGLATADQLNKAGHSVKVYERSDRPGGLLMYGIPNMKLDKRIVKRRTDLMTAEGVEFICSTTIGEDISIEEIRSSNDAVVFAVGSTIPRDLRIKGRELNNINFAMQLLHKNTKALLDNDLEEIKKTLEGKHVIVIGGGDTGNDCLGTSTRHGAKSVTNFELLPNPPTSRPKDNPWPQWPRVFRVDYGHTEVTEHYGKDPREYSILSKEFVDDGEGNVKGIKTIRVEWKRSDSGAWQMAEVPGSEEFFSADVVLLSMGFVGPDADNLEVTKTKRGTISTVEPNGYKVSNEDNLFTAGDCRRGQSLVVWGIQEGRQCAREVDNYLMGSSRLPGNGSIEQRNFKLLEELAEKV

SEQ ID NO: 31623 - protein, 140 aa, Lycopersicon esculentum
AHNYHPIPIVFSKAKGSSVWDPEGKKYLDFLSAYSAINQGHCHPKIMKVLAEQAQMLTLSSRAFYNDKFPVFAERITSMFGYDMVLPMNTGAEGVETALKLARKWGYMKKSIPKNEALIVSCCGCFHGRTLAAISMSCDN

SEQ ID NO: 31624 - protein, 171 aa, Nephroselmis olivacea
MPRSQRNDNFIDKTFTVVADILLKVLPTTRREKEAFTYYRDGMSAQAEGEYAEALQNYYEAMRLEVDAYDRSYILYNIGLIHTSNGEHAKALEYYYQALERNPYLPQALNNIAVIYHYRGEQAIESGNSRISNLLFDKAADYWKEAIRLAPTNYIEAQNWLKITNRLEEAI

SEQ ID NO: 31625 - protein, 410 aa, Nephroselmis olivacea
MAREKFERTKPHVNIGTIGHVDHGKTTLTAAITMVMACNTAGSKGKKYEDIDSAPEEKARGITINTAHVEYETATRHYAHVDCPGHADYVKNMITGAAQMDGAILVVSGADGPMPQTKEHILLAKQVGVPNIVVFLNKQDQVDDEELLELVELEVRETLSNYEFPGDEVPVVPGSALLALEAMTENPSLKRGENEWVDKIFALMDAVDQYIPTPKRDTDKSFLMAVEDVFSITGRGTVATGRVERGSVKLGDTIEIVGLKPTRETTVTGLEMFQKTLDQSVAGDNVGILLRGIQKEDIQRGMVLAAPRTITPHTKFESQVYVLTKEEGGRHTPFFPGYRPQFYVRTTDVTGKIDSFRADDGGEATMVMPGDRVKMVVELIQPIAIEKGMRFAIREGGRTVGAGVVSNIIA

SEQ ID NO: 31626 - protein, 343 aa, Nephroselmis olivacea
MSILIENISKTFGTFRALDHVNLEVKAGSLVALVGPSGSGKSTLLRMIAGLERADEGKIWLAGRDATYAPIQKRHIGFVFQNYALFKHLNVAKNISFGLEVRQANPNQIRSRVRDLLQLIQLEHMADRYPAQLSGGQRQRVALARALAVEPKVLLLDEPFGALDARVRRELRSWLRDLHQEMPVTTVFVTHDQQEAMEVAHEIVVFNQGRLEQVGSPQEIYDHPATPFVMGFMGHINHGVDDVQQSSYFVRPNDVIIQLVPSTNSLSGKVVGMTYGDTSMKLDVDIPQQVPSSDWAPRGSLWRIHLSRRDFNQFNSMLVGGIQIGSVLYVQPRRTEMVRGYSI

SEQ ID NO: 31627 - protein, 475 aa, Nephroselmis olivacea
MAPQTETQAKAGFKAGVKDYRLTYYTPDYQVKDTDILAAFRMTPQPGVPPEECGAAVAAESSTGTWTTVWTDGLTSLDRYKGRCYDLEPVAGEDNQYIAYVAYPLDLFEEGSVTNLFTSIVGNVFGFKALRALRLEDLRISVAYCKTFQGAPHGIQVERDKLNKYGRGLLGCTIKPKLGLSAKNYGRAVYECLRGGLDFTKDDENVNSQPFMRWRDRFLFCAEAIYKAQAETGEIKGHYLNATAGTSEEMLKRAVFAKELGVPIIMHDYLTGGFTANTSLAYYCRDNGLLLHIHRAMHAVIDRQRNHGIHFRVLAKALRLSGGDHLHSGTVVGKLEGEREVTLGFVDLMRDAYVEKDRSRGIYFTQDWASLPGVMPVASGGIHVWHMPALVEIFGDDACLQFGGGTLGHPWGNAPGAAANRVALEACTQARNEGRDLAREGGDVIRAACKWSPELAAACEVWKEIKFEFDTVDTL

SEQ ID NO: 31628 - protein, 217 aa, Clostridium beijerinckii
MNKLVKLTDLKRIFKDGMTIMVGGFLDCGTPENIIDMLVDLNIKNLTIISNDTAFPNKGIGKLIVNGQVSKVIASHIGTNPETGKKMSSGELKVELSPQGTLIERIRAAGSGLGGVLTPTGLGTIVEEGKKKVTIGGKEYLLELPLSADVSLIKGSIVDEFGNTFYRAATKNFNPYMAMAAKTVIVEAENLVKCEDLKRDAIMTPGVLVDYIVKEAA

SEQ ID NO: 31629 - protein, 270 aa, Beta vulgaris
  misc_feature (249)..(249): Xaa can be any naturally occurring amino acid
  misc_feature (258)..(258): Xaa can be any naturally occurring amino acid
  misc_feature (270)..(270): Xaa can be any naturally occurring amino acid
AMGGLIFGYDIGISGGVTSMPDFLKKFFPSVYRKEALDKSVNQYCKFDSVTLTLFTSSLYVAALVASLVASVVTRKLGRKLSMLFGGLLFCVGAIINALAKDVAMLIVGRILLGFGVGFANQSVPLYLSEMAPYKYRGSLNIGFQLSITIGILIANVLNYFFAKIHDWGWRLSLGGAMVPAIIISIGSLLLPDTPNSMIERGKRDEALLKLKRVRGVDDVEDEFNDLVVASENSKKVEHPWRNLLQRKXRPHLTMGFXIPFFHNLLGLMX

SEQ ID NO: 31630 - protein, 126 aa, Arabidopsis thaliana
MSAQSEGNYAEALQNYYEAMRLEIDPYDRSYILYNIGLIHTSNGEHTKALEYYFRALERNPFLPQAFNNMAVICHYRGEQAIQQGDSEMAEAWFAQAAEYWKQAITLTPGNYIEAQNWLTITRRFE

SEQ ID NO: 31631 - protein, 338 aa, Streptomyces coelicolor A3(2)
MGESVLLTSTPPEHKESVIVSSAPQSRPWDVHRLPSAEGRNFLVTGGNAGIGYFTAEQLAATGALVVIGSRNPAKADAALASIRSRVPGARVRHLHLDLADLSTLKSAVDGLALDLGRLDAVVHNAGGALDDPPRRETEDGHELMFGTNHLGHYALTRWLAPLLSAAPAGRVVTVGSFAARSERLDLDDLQSTRDYRPKRTYGRSKLAQMCFGFELDRRLRAAGSTVLSAVAHPGGALDSLTPPRPPVGAPTPGERLRGLPAALMVQGKDAGAWPVVRAVLDSDVQGGQLWGPRVFGLRGQPRREPVPAHMADPAVAARLWAASAELTGTTDPHLGFR

SEQ ID NO: 31632 - protein, 253 aa, Fusarium solani
ILMNQSSDTLKKLSLELGGNAPFIVFDDADLDLAVAGAIASKFKCSGQTCVCSNRIFVQKGIYNEFVQKLKAVVSKFQVGHGFDSKTTHGPLVTAAAAERVDGLVKEAVKAGAKVEVGGKRRTDLGPNFFEPTILTNVTTDMRLVRDEIFGPLAPIFSFDNEDEVVDIANKCDVGLASYIFTQDVNRVARVTELLHFGMVAVNTGIMSDAAAPFGGVKHSGMGREGSKYGIEDYLHVKTIVTGNVNVVHRALL

SEQ ID NO: 31633 - protein, 281 aa, Spinacia oleracea
MSKEVSEEAQAHQHGKDYVDPPPAPFFDLGELKLWSFWRAAIAEFIATLLFLYITVATVIGHSKETVVCGSVGLLGIAWAFGGMIFVLVYCTAGISGGHINPAVTFGLFLARKVSLLRALVYMIAQCLGAICGVGLVKAFMKGPYNQFGGGANSVALGYNKGTALGAEIIGTFVLVYTVFSATDPKRSARDSHVPILAPLPIGFAVFMVHLATIPITGTGINPARSFGAAVIFNSNKVWDDQWIFWVGPFIGAAVAAAYHQYVLRAAAIKALGSFRSNPTN

SEQ ID NO: 31634 - protein, 469 aa, Enterococcus faecalis
MAEQTDLLILGGGTGGYVAAIRAAQKGLNVTIVEKYKLGGTCLHKGCIPTKALLRSAEVFDTLKQAASFGIETEAASIDFSKIQQRKEGIIEQLHKGVEGLCKKNKIKILAGEGAILGPSIFSPVSGAVAVTFNDPTREEEIIVPKNVIIATGSSPKTLPNLPLDEEFILSSDGMLELEELPESIAIIGGGVIGVEWASLLNSLGVNVTIIEFLDRLLINESATISKELKKRLEQRGINILLGSKVQEAKVTGQKVQVEVAGQESLTVDKVMVAIGRQPNINKLGLQNTSVKYTDKGIEVNEFYQTTEGHIYAIGDCIDTLQLAHVAMKEGELAVQHLLDETVEPLNYTNVPRGVYTNPEIASVGYTRETLPADKEVVIGTFNFNGNGKSLVYGETDGFIEVIRDKKTDDLLGVSMIGPHVTDLIAEASTAMYLDAAPIEIGEAIHAHPTMTEVLQEAALDTYGLAIHK

SEQ ID NO: 31635 - protein, 512 aa, Glomerella cingulata
MKRKNVKGLALTPAAPKPPPTAETSRHGYDPRDKDGGEQSAQLEIGIEYKLDLRPEDLEILKELGSGNGGTVSKVKHVLTGTVMARKVIHVEAKKEMRKRIVRELQIMHGCSSEYIVNFYGAFLNPHNDVIMCMEYMDVGSLDRVSKVFGPVRVDVLGKIAVATLGGLTYLYSKHHIMHRDIKPSNILVNSRGSIKLCDFGVSGELINSVADTFVGTSTYMAPERIQGEKYTVKSDVWSFGLSIMELAIGKFPFNASEQLSDGECAPAAFGSVTADCTEPGPKLPKSDAFPSILEDMIQKCLFKNPDERPTPQELFDRDPFVQAAKRTPVDLREWAVGLMERDNRKSHLAPQLSPATRDLLNSSDSPTYQGGSTNDRSLDTPTSGEIPIAGAGIISPREPATHSNRSPTRNGINAISSRQQAAGHPGMGQRIVTTNSIPKVGEYPNSAGPVSANAASFSLPVRPAPGGPLPPAPPRKGTPDETRRENRRQATFGMPPAPRSYASDVYNGTSN

SEQ ID NO: 31636 - protein, 462 aa, Volvox carteri f. nagariensis
MALSMKMRANARVVSGRRVAAVAPRVVPFSSVARPVLRSTFAPEVSIDIRRAGRSRIVVEAVKKSVGDLGKADLEGKRVFVRADLNVPLDKKTLAITDDTRIRAAVPTLKYLLDNGAKVLLTSHLGRPKGGPEDKYRLTPVVARLSELLGKEVKKVDDCIGPSVEQAVASLKSGELLLLENVRFYKEEEKNDPEFAKKLASNADLYVNDAFGTAHRAHASTEGVTKFLKPSVAGFLLQKELDYLDGAVSAPKRPFVAIVGGSKVSSKITVIEKLMEKCDKIIIGGGMIFTFYKARGLKVGSSLVEEDKLELAKNLEAIAKAKGVQLLLPSDVVVADKFDANANTQTVSVEAIPDGWMGLDIGPDSIKTFQDALADAKTVVWNGPMGVFEFPKFAVGTVAIANTLSELTPKGAITIIGGGDSVAAVEQAGVAEKMSHISTGGGASLELLEGKVLPGVAALDEK

SEQ ID NO: 31637 - protein, 470 aa, Synechococcus elongatus PCC 7942
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLRWRRVIAIAAERGIPVPAFSASLDYFDSYRASPAQNLTQAQRDYFGAHTYERTDRSGSFHAQWF

SEQ ID NO: 31638 - protein, 468 aa, Bacillus firmus
MTLYRSLWKKGCMLLLSLVLSLTAFIGSPSNTASAAVADDIQASVMGPLAKINDWGSFKKQLQTLKNNGVYAITTDVWWGYVESAGDNQFDWSYYKTYADAVKEAGLKWVPIISTHKCGGNVGDDCNIPLPSWLSSKGSADEMQFKDESGYANNEALSPLWSGTGKQYDELYASFAQNFAGYKSIIPKIYLSGGPSGELRYPSYYPAAGWSYPGRGKFQAYTETAKNAFRTAMNDKYGSLDKINTAWGTKLTSLSQINPPTDGDGFYTNGGYNSAYGKDFLSWYQSVLEKHLGVIGAAAHKNFDSVFGVRIGAKISGLHWQMNNPAMPHSTEQAGGYYDYNRLIQKFKDADLDLTFTCLEMSDSGTAPNYSLPSTLVDTVSSIANAKGVRLNGENALQTGGSGFQKIEEKITKFGYHGFTLLRINNLVNNDGSPTGELSGFKQYIISKAKPDNNGGTGNKVTIYYKKG

SEQ ID NO: 31639 - protein, 482 aa, uncultured bacterium
MQYGKLVRLSALTTALAFSALAQANNLAITGPGAGADGSSKASGSSYGDVKDADLQSYWQPPANNGQRVSVKWSSAISVNQVILREQGSNVTSWRLVNNDNGAVLATGTSIGSNRTVNFSTVSTKKLNLEILTASGAPRIAEFEVYLNTNGGNPPNPTDPEPGPVTSCAASPQGYASLNGGTTGGSGSNAVTVTVSTGAQMVSALQNRDLNRPLTIRVNGTITPGNSGGVSKFDIKDMDNVSIIGVGNNALFDGIGIKIWRANNVIIRNLTMRYVNTGDKDAITIEGPARNIWIDHNEIYNSLNVGKDFYDELISGKKDVDNVTISYNYLHDSWKTSLWGSSDSDNYNRRITFHHNHWHKVNSRLPLFRFGQGHIYNNYYNDIQDTGINSRMGAVIRIENNVFENAKNPIVSFYSSGYGYWDTRGNSFSNITWQEYPSDGIIAGPNVQPTAVLNLPYSFNLLPTNQVKAHVLANAGVNKCSF

SEQ ID NO: 31640 - protein, 348 aa, Bacillus halodurans
MMRSSIVKLVAFSVVVMLWLGVSFQTAEANTPNFNLQGFATLNGGTTGGAGGDVVTVRTGNELINALKSKNPNRPLTIYVNGTITPSNTSDSKIDIKDVSNVSILGVGTNGRLNGIGIKVWRANNIIIRNLTIHEVHTGDKDAISIEGPSRNIWIDHNELYASLNVHKDHYDGLFDVKRDAYNITFSWNYVHDGWKAMLMGNSDSDNYDRNITFHHNYFKNLNSRVPAYRFGKAHLFSNYFENILETGINSRMGAEMLVEHNVFENATNPLGFWHSSRTGYWNVANNRYINSTGSMPTTSTTNYRPPYPYTVTPVGDVKSVVTRYAGVGVIQPYARKPSERLLWWLFA

SEQ ID NO: 31641 - protein, 247 aa, Spinacia oleracea
MAIAFGRFDDSFSWASIKAYIAEFISTLLFVFAGVGSCIAFAKLTEDAALSPSGLVAVAVCHAFALFVAVSVGANISGGHVNPAVTFGLALGGQITILTGILYWIAQCAGSVAACLLLKASTGGLATPIHSVAAGVGSIEAVVMEIIITFALVYTVYATAVDPKKGSIGTIAPIAIGFIVGANILAAGPFSGGSMNPARSFGPAVASLDFSDHWVYWVGPLVGGGLAGLIYGNVFMQDDHAPLSNEY

SEQ ID NO: 31642 - protein, 328 aa, Escherichia coli
MPLHNLTRFPRLEFIGAPTPLEYLPRFSDYLGREIFIKRDDVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 31643 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 31644 - protein, 501 aa, Solanum chacoense
MQLISIFLFICFLFLLRKWKKYSKNSQTKKLPPGPWKLPFIGSMHHLAGGRPHRVLRDLAKKYGPLMHLQLGEVSAVVVTSPDMAKEVLKTHDIAFASRPKLLAMDIICYDRCDIAFSPYGEYWKQMRKICVTEVLSAKSVRSFSSIRCDEVVRLIDSIQSSSSSGELVNFKERVIWFTSSMTCRSAFGQLPKEQDMFIKLIREVIRLAEGFDVADIFPSYKFLHVFGRAKRKLLNVHRKVDAIVEDVINEHKKNFATRKNDDHALGGENLIDVLLKLMNDKSLQFPINNDNIKAIIIDMFAAGTETSSTTTVWAMVEMLKNPRVLAKAQAEVREAFRNKVTFDENDVEDLKYLKLVIKETMRLHAPIPLLVPRECRKETEINGYTIPVKTKVMVNVWALGRDPKYWDDVECFKPERFEQCSIDFIGNNFEYLPFGGGRRICPGTSFGLANDYLPLAQLLCHFDWKLPTGMEPKDLDLTELAGMSAASKDDLYLIATPYQP

SEQ ID NO: 31645 - protein, 500 aa, Solanum chacoense
MQLVSIFLFISFLFLLRKWKKYLNNSQTKKLPPGPWKLPFIGGMHHLAGGLPHRVLRDLAEKYGPLMHLQLGEVSAVVVTSPEMAKQVLKTHDIAFASRPKLLAMDIICYNRRDIAFSPYGDYWRQMRKICIMEVLSAKSVRSFSSIRHDEVVRLIDSIQPCFTSGELVNFTERIIWFTSSMTCRSAFGQVLKEQEVFIKLIREVISLAEGFDVADIFPSYKFLHGFGGAKQKLLNAHRKVDSIVEDVIKEHKKNLATRKSDDAIGGEDLVDALVRLMNDKSLQFPINNDNIKAVIIDLFAAGTETSSTTTVWAMAEMLKNPSVFAKAQAKVREAFRDKVTFDENDVEELKYLKLVIKETMRLHAPVPLLVPRECREETEINGYTIPVKTKVMVNVWALGRDPKYWDDAESFKPERFEQCSIDFIGNNFEYLPFGGGRRICPGISFGLANVYLPLAQLLYHFDWKLPTGMEPKDLDLTESAGITAARKGDLYLIATPHQP

SEQ ID NO: 31646 - protein, 490 aa, Lotus corniculatus var. japonicus
VALMILRKNLKKPDSIPNIPPGPWKLPIIGSIPHLVGSPPHRKLRDLAKKYGPLMHLQLGEVIFIIVSSAEYAKEVMKTHDVTFASRPRSLFTDIVFYGSTDIGFSPYGDYWRQVRKICNVELLSMKRVQSLWPIREEEVKNLIQRIASEEGSVVNLSQAIDSLIFTITSRSAFGKRYMEQEEFISCVREVMKLAGGFNIADLFPSAKWLENLTRMRSKFEYLHQKMDRILETIIDDHKANSRTKEGQVEGGEEDLIDVLLKYENSSTDQDFHLTIRNIKAILFDIFIAGSETSATTINWTMAEMMKDPILLKKAQDEVREIFQRRGKVDETCIYELKYLKAFINEVLRLHPPGPLVFRECRQACEINGYHIPAKSTVLVNTFAIGTDSKYWAEPERFCPERFIDSSIDYKGTNFEHLPFGAGRRICPGINYGMANVELVLALLLYHFDWTLPKGIKNEDLDLTEEFGVTVSKKEDLCLIPSISHPLPST

SEQ ID NO: 31647 - protein, 499 aa, Glycyrrhiza echinata
MEILSLLSYSVFYLALFFIFNIVIRARKFKNLPPGPPSLPIIGNLHHLKRPLHRTFKGLSEKYGHVFSLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEMELSSRLYDMTFNNIMRMISGKRYYGEDCDTSDLQEASQFRDMVSELLQLSGANNKTDFMPLLRFLDFENLEKRLKDISGKTDAFLRGLIEEHRTKKERANTMIDHLLNLQDSQPEYYTDQIIKGLALAMLLAGTDSSAVTLEWSMSNLLNHPEVLKKVKDELDTHVGQDRLVDESDLPKLTYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLINGDKIDLAERDGFTLTKLVPLKAMCKSRPVINKVFKQ

SEQ ID NO: 31648 - protein, 487 aa, Eschscholzia californica
GTSTVALIAVIISSILYLLFGGSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGDPNSGSSEFKEYLWRMLELGNSTNPADYFPMLGKFDLFGQRKEVAECLKGIYAIWGAMLQERKLAKKVDGYKSKNDFVDVCLDSGLNDYQINALLMELFGAGTETSASTIEWAMTELTKNPKITAKIRSEIQTVVGERSVKESDFPNLPYLEATVKETLRLHPPTPLLLPRRALETCTILNYTIPKDCQIMVNAWGIGRDPKTWTDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 31649 - protein, 488 aa, Eschscholzia californica
  misc_feature (192)..(192): Xaa can be any naturally occurring amino acid
MEVVTVALIAVIISSILYLLFGSSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGXPNSGSSEFKEYLWRMLELGNSTNPADYFPMLGKFDLFGQRKEVAECLKGIYAIWGAMLQERKLAKKVDGYQSKNDFVDVCLDSGLNDYQINALLMELFGAGTETSASTIEWAMTELTKNPKITAKLRSELQTVVGERSVKESDFPNLPYLEATVKETLRLHPPTPLLLPRRALETCTILNYTIPKDCQIMVNAWGIGRDPKTWIDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 31650 - protein, 512 aa, Sorghum bicolor
MDASLLLSVALAVVLIPLSLALLNRLRLGRLPPGPRPWPVLGNLRQIKPIRCRCFQEWAERYGPVISVWFGSGLTVVVSTSELAKEVLKENDQQLADRPRNRSTQRFSRNGQDLIWADYGPHYIKVRKLCNLELFTPKRLEALRPIREDEVTAMVESVYRAATAPGNEGKPMVVRNHLSMVAFNNITRLAFGKRFMNANGDIDEQGREFKTIVNNGIKIGASLSVAEFIWYLRWLCPLNEELYKTHNERRDRLTMKIIEEHAKSLKESGAKQHFVDALFTLKQQYDLSEDTVIGLLWDMITAGMDTTVISVEWAMAELVRNPRVQKKLQEELDRVVGRDRVMLETDFQNLPYLQAVVKESLRLHPPTPLMLPHKASTNVKIGGYDIPKGANVMVNVWAVARDPKVWSNPLEYRPERFLEENIDIKGSDFRVLPFGAGRRVCPGAQLGINLVASMIGHLLHHFEWSLPEGTRPEDVNMMESPGLVTFMGTPLQAVAKPRLEKEELYNRVPVEM

SEQ ID NO: 31651 - protein, 395 aa, Syncephalastrum racemosum
MKFSLALLATVALATISQAAPVEKQVAGKPFQLVKNPHYQANATRAIFRAEKKYARHTAIPEQGKTIVKSAASGTGSVPMTDVDYDVEYYATVSVGTPAQSIKLDFDTGSSDLWFSSTLCTSCGSKSFDPTKSSTYKKVGKSWQISYGDGSSASGITATDNVELGGLKITGQTIELATRESSSFSSGAIDGILGLGFDTISTVAGTKTPVDNLISQNLISKPIFGVWLGKQSEGGGGEYVFGGYNTDHIDGSLTTVKVDNSQGWYGVTVSGLKVGSKSVASSFDGILDTGTTLLIFDQATGSKVAAAYGAKDNGDGTYTISCDQSKLQPLALTMGGKDFFVPADSLIYVKQGSQCIAGFGYSSMDFAIIGDTFLKNNYVVFNQGVPEVQIAPSKA

SEQ ID NO: 31652 - protein, 473 aa, Xanthomonas citri
MQHPRAFACLGDRVTDLLVRTSVEEGDAHVCFLRAHKRCRAVRAGQSIECGGVEQEHEIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDSLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALEALDKDREFLKAGGVMSDDFIDGYIALKMQEVTKFRAATHPLEYQLYYGN

SEQ ID NO: 31653 - protein, 265 aa, Hordeum vulgare
FLNITFGSPMEEILIEKLIVKVVLPEGSKDFDVSAPFPANQWQEVKYSHLDIAGRPVLILEKADVIPEHNLHFQVYYKFNNISLLIEPMMLITGFFLLFVACIAYMHTDMSISKNSPSYLAKLQWDEMQATVQQIQGIFEQCLAVHDKLEISLHDLSRTGDTKSCKATRKAADAQFKELAKELKPLLLSVQSSPQSYLIWPKLEDLVAKEREMQEKLMARHATVVDSFEKKQRGQDIENRIASQQQKIAALRQEVESLLEYLSEI

SEQ ID NO: 31654 - protein, 495 aa, Catharanthus roseus
LLFCFILSKTTKKFGQNSQYSNHDELPPGPPQIPILGNAHQLSGGHTHHILRDLAKKYGPLMHLKIGEVSTIVASSPQIAEEIFRTHDILFADRPSNLESFKIVSYDFSDMVVSPYGNYWRQLRKISMMELLSQKSVQSFRSIREEEVLNFIKSIGSKEGTRINLSKEISLLIYGITTRAAFGEKNKNTEEFIRLLDQLTKAVAEPNIADMFPSLKFLQLISTSKYKIEKIHKQFDVIVETILKGHKEKINKPLSQENGEKKEDLVDVLLNIQRRNDFEAPLGDKNIKAIIFNIFSAGTETSSTTVDWAMCEMIKNPTVMKKAQEEVRKVFNEEGNVDETKLHQLKYLQAVIKETLRLHPPVPLLLPRECREQCKIKGYTIPSKSRVIVNAWAIGRDPNYWIEPEKFNPDRFLESKVDFKGNSFEYLPFGGGRRICPGITFALANIELPLAQLLFHFDWQSNTEKLNMKESRGVTVRREDDLYLTPVNFSSSSPA

SEQ ID NO: 31655 - protein, 294 aa, Antirrhinum majus
MEQYEKVEKIGEGTYGVVYKARDRVTNETIALKKIRLEQEDEGVPSTAIREISLLKEMQHGNIVRLQDVVHSEKRLYLVFEYLDLDLKKHMDSCPEFSQDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVMGTPNEETWPGVTSLPDFKSAFPKWPAKELAAVVPNLDASGLDLLDKMLRLDPSKRITARNALQHEYFKDIGFVP

SEQ ID NO: 31656 - protein, 1490 aa, Candida albicans
MADADTSSNSSKTNEDRSQEGFGTYQGYTDRVASEVQELARIISHASIQQLKLKRQHSRQESQKSNEQESELSGKLGVIPVDENGNFVDQRLNPNSPEFNAAYWIQNAHKLVSSDIDYFKPVTIGVAYKNLRAYGSASDADYQSTLVNLIPKYLSLFFREYILRHTGPTFDILKPMDGLIKPGELTVVLGRPGAGCSTFLKTIASQTYGYHIDKDSVIRYNSLTPHEIKKHYRGEVVYCAETENHFPQLTVGDTLEFAAKMRTPQNRPLGVSRDAYARHLAAVVMAVYGLSHTRNTKVGNDFIRGVSGGERKRVSIAEITLNNAMVQCWDNSTRGLDSATALEFIRALKASADIVHTTPLVAIYQCSQDAYDLFDKVVLMYQGYQIYFGSAKKAKQYFIDMGYECPQRQTTADFLTSLTNPAERIVRQGFEGKVPQTPQEFYEYWKKSPEGQQIVADVDQYLTEHSSAAEKEAIKEAHQARQSDHLKPASPYTVSFFMQVRYIAHRNILRIKGNPSIHLFQIFGNIGMSFILSSIFYNLPTATSSFYHRTAALFFAVLFNAFSCLLEIFSLYEARSIVEKHKKYALYHPAADAFASIVTELPTKFIIAIGFNLVYYFMVNFRRTPGNFFFYLLINFSATLAMSHIFRTIGAATKTLQEAMTPAAILLLALTIFTGFVIPTPNMHGWCRWINYLDPLAYAFESLIANEFHNRDFECSQYVPSGGSYPTAGPNRICTPVGSVPGQDFVDGTRYMEMSFDYRNSHKWRNFGIVIGFIVFFFCTYILLCEINKGAMQKGEILLFQQRALKKRKKANNDIESGEIEKVTPEFDNEYENNQDKMLQSGGDTFFWRDLTYQVKIKSEDRVILDHVSGWVKPGQVTALMGASGAGKTTLLNALSDRLTTGVVTEGIRLVNGRPLDSSFQRSIGYVQQQDLHLETSTVREALEFAAYLRQPKSVSRKEKNEYVDYIIRLLEMEQYADAVVGVSGEGLNVEQRKRLSIGVELVAKPKLLVFLDEPTSGLDSQTAWSICKLIRKLADNGQAILCTIHQPSAILLAEFDRLLFLQRGGQTVYFGDLGKNFTTLINYFEKYGAPKCPPEANPAEWMLEVIGAAPGSKANQDYYDVWLKSSEFQEMNSELDLMSEELVKKPLDDDPDRLKPYAAPYWEQYLFVTKRVFEQNWRTPSYLYSKFLLVVTSSLFNGFSFYKADRSLQGLQNQMFSVFMFLVILHTLIQQYLPTFVSQRDLYEVRERPSKTFSWITFIAAQVTAEIPWNIICGTLGYFCWYYPVGLYQNATYTNTVHQRGAFMWFAIVLFFIYTSTLAQLCISFLEIDDNAANLSVLLFTMCLAFCGVLVTKEQLPGFWVFMYRCSPFTYLVSVMLSVGLVDAPVTCAAKEYLRFSPPQGYTCMQYMEPYMKVAGGYLLNENSTTECEFCTMKVTNVFLKMIGSDYSKRGRDIGIYIAFIGINIIGTFILYWFARVPKNFDIKLRRKR

SEQ ID NO: 31657 - protein, 491 aa, Schizosaccharomyces pombe
MTVVRADKKHRRRGSIYMVTPYMDHDLSGLLENPSVKFTEPQIKCYMKQLFAGTKYLHDQLILHRDLKAANLLIDNHGILKIADFGLARVITEESYANKNPGLPPPNRREYTGCVVTRWYRSPELLLGERRYTTAIDMWSVGCIMAEMYKGRPILQGSSDLDQLDKIFRLCGSPTQATMPNWEKLPGCEGVRSFPSHPRTLETAFFTFGKEMTSLCGAILTLNPDERLSASMALEHEYFTTPPYPANPSELQSYSASHEYDKRRKREQRDANSHAFEQTANGKRQFRFMTRGPSDPWYGIRRPNYNSQPQYQRGSYNREGGNMDRSRNVNYQPKRQQNFKPLTSDLPQKNSEFSETNAMNQTSNHSHADGQRYYRPEQDRSQRLRNPSDYGRQGRQSSQSQQPAWNVSSRYQNNSKVQTTSRASENADTNKTQHNIKYIDSYVPEYSIARQSANQKTNEQHPSSTSLHQQSTSDLKSPSFHENSNVDDTPK

SEQ ID NO: 31658 - protein, 380 aa, Daucus carota
MVKELHTVCVTGASGFIGSWLVLRLLQRGYTVRATVRDPGNPQKVKHLLQLPKAETNLILCRADLNEEGSFDDAVKGCHAVFHMATPMDIESQDPENEVIKPTVQGVLDIITACAKAKTVKKLIYTSSAGTVNVREHQLPVYDESNWSDMDFIYSTKMTAWMYFVSKSLAEKAAWQAAEENNIQFISIIPTLVVGPFISPTFPPSLITALSPLTGNEAHYSIIKQCQYVHLDDLCESQIFLYEHPTAQGRYICSSHDATIHDVVKLIREKWPEYNVPTEFKGIEKDLPVISFSSKKLTDMGFTFKYNLEDMFKGAIETCREKGLLPNSTTLQENDQEKKYLFSATDDHHNGHEKDLFHHSIDKDAIGKEKRGETESLVAA

SEQ ID NO: 31659 - protein, 332 aa, Daucus carota
ENKTVCVTGASGYIGSWLVKTLLERGYHVRATVRDPGNERKVKNLLELPNASTHLSLWKADLAEESSYDDAVQGCHGVFHVATPMELLYQDEPAENEEIESTTLNGILSIMRSCSKAKTVKRFIYTSTTATILMQRQPPVDEYTEEHWSDLDLCYEIKMYGWMYVVAKTTAERAAWKYAEENGIDMVTVHPSIVLGHFNTPHTSFSTEAATALYTKNEANMALLKKLHGSPAVHLDDVCNAHIYLFEHPLAKGRYICSSHTYNVFEIGHSLSLKYPERNIPTEFEGLDKSQRINPVSSKKLMSLGFEFAHKNKSVGDLCAETIESCREKGLL

SEQ ID NO: 31660 - protein, 402 aa, Daucus carota
MVATTLESPRVETLAGSGIQLIPKEYVRPKDELISITNIFEEEKSDEGPQVPTVDIADILSEDKAVREKCYERIKDAAVEWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNTVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPEEQQKTEESNPQKIEILKPGEEASSSP

SEQ ID NO: 31661 - protein, 389 aa, Daucus carota
MVATTLESPRVETLAGSGIQLIPKEYVRPKDELISITNIFEEEKSDEGPQVPTVDIADILSDDKAVREKCYERIKDAAVDWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNMVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPTEQQKTEESNPQKI

SEQ ID NO: 31662 - protein, 299 aa, Geobacillus thermoleovorans
MARTVNSITELIGDTPAVKLNRIVDEDSADVYLKLEFMNPGSSVKDRIALAMIEAAEKAGKLKPGDTIVEPTSGNTGIGLAMVAAAKGYKAVLVMPDTMSLERRNLLRAYGAELVLTPGAQGMRGAIRKAEELVREHAYFIPQHLKRANPEIHRLTTGKEIVEQMGDQLDAFVAGVGTGGTITGAGKVLREAYPNIKIYAVEPADSPVLSGGKPGPHKIQGIGAGFVPDILDTSIYDGVITVTTEEAFRGPRAAREEGILGGISSGAAIHAALKVAKELGKGKKVLAIIPSNGERYLST

SEQ ID NO: 31663 - protein, 147 aa, Haemophilus influenzae
MAKAPKTAYVCNDCGAEFSRWQGQCSACKAWNTITEVRLISTAKSKNDRFSGYAGETQAKIQTLSEISLQETPRFSSGFNELDRVLGGGIVPGSAILIGGHPGAGKSTLLLQVMCGLAKNMTALYVTGEESLQQVAMRASRLGLPND

SEQ ID NO: 31664 - protein, 490 aa, Zymomonas mobilis
MAQNKMLSFVHLKQAYPEKRSAQERDKDFNEIYRSFSDEQASCQASRCSQCGVPYCSAYCPLHNNIPDWLKMTAEGRLQDAYALSSATSTMPEICGRICPQDRLCEGNCVIENSGHGAVTIGSVEKYITDTAWKEGWVEPLQPITELGISVGIIGSGPAGLTAAEKLRQQGYQVHVYDRHVRAGGLLTYCIPGFRLDKDIVARRVKRLADWGCHLPYQFARRVKMPALKNCVTHAAILIATGVYKARGLATPGKELNGIVDALDFLISSNRKSFGDKVEAFDNGTLDAKGKKVVVIGGGDTAMDCVRTAIRQGAESVRCLYRRDRVNMPGSAREVKNAEDEGAEFVWLSAPESFVGKDHVQSVKVRGMRLGAPDGSGRRSPEPDPARLFDMDADLVICALGFSPEDLPTLFNAPELSVTPWGTVEADPVTLQTSIEGVFAAGDIVRGASLVVWAIRDGLVASEQMHQWLATRQQDKQDAPTKAKKKAVFA

SEQ ID NO: 31665 - protein, 397 aa, Zymomonas mobilis
MKPKLPLNRRQNPVRIMFLRLLSEQPQVKRRPLSRPMISQQQWPNWMLPRRLWQPMMINMLSVLSVMIELKSKGVDIITLGAGEPDFETPEFIKEAAIQAIHDGKTRYTNVDGTAELKEAIVGKFRRDNHLEYRTDQISVGSGGKHVLFNALTATIDQGDEVIIPAPYWVSYPDIVRFCGGTPVFIQATIDQDYKITAEQLEKAITQKTRWFIFNSPSNPTGAAYSADEIKSLAEVLRRHPHVWILSDDIYEHIVFDNFRFATIAEVAPDLFDRTLTANGCSKAYAMTGWRIGFAGGPTPLIKAMAKLQSQSTSNPCSISQAAAVAALNGPQDFLQGWSDDFARRRNLVVDGLNAIEGISCPKPQVPSMSIRAFPSLLARKPHQVKSLKKTWISQAI

SEQ ID NO: 31666 - protein, 502 aa, Glycine max
MATTRIEAEKKPKTKIVCTLGPASRSVPMIEKLLRAGMNVARFNFSHGSHEYHQETLDNLRAAMENTGILCAVMLDTKGPEIRTGFLKDGKPIQLIQGNEITISTDYDLKGDEKTICMSYKKLPEDVRPGMVILCADGTISFTVLSCDKQAGLVQCRCENSATLGERKNVNLPGVIVDLPTLTDKDKEDILAWGVPNKIDMIALSFVRKGSDLVEVRKVLGKHAKNIMLMSKVENQEGVANFDEILANSDAFMTARGDLGMEIPIEKIFLAQKVMIYKCNIQGKPVVTATQMLESMIKSPRPTRAEATDVANAVLDGTDCVMLSGETAAGAYPDLAVQTMAKICIEAESTLDYGDVFKRIMEHSPVPMSPLESLASSAVRTANSARAALILVLTRGGSTAKLVAKYRPGMPILSVVVPELKTDSFDWACSDEAPARHSLIFRGLVPVLSAASARASHAETTEEAIEFAMQHAKSKGLCHNGDSVVALHRVGTASIIKILTVK

SEQ ID NO: 31667 - protein, 3574 aa, Aeromicrobium erythreum
MNEQDPQDRTAALLRRATTELRAARRRVQQLESDPVAVVSMACRLPAGIDTPEKLWDLLDAGRETLSDFPDDRGWDLTGLFDPDPDHPGTSYVDQAGFLDDATGFDPELFGIAPREAEAMDPQHRILLESCWELFERAGMDPLGLRGSATGVFVGAAKFGYGEGDVGDPDGYAVTGTAPSVASGRLSYTFGLEGPSLTVDTACSSSLVALHLAVDSLRKGESSLAVVGGAAVMGSPDVFVDFSRQRALAADGRSKAFGAGADGFGFSEGVSLVLLERLSDAQRLGHPVLAVVRGSAVNQDGASNGLSAPSGRAQRRVLRAALERCGLEPADVDVVEAHGTGTALGDPIEAGALLEVYGQDRSEPLALGSVKSNLGHTQAAAGTTGLLKVVLALQHECLPRTLHVEEPSTHVDWTSGAVRLLDQARPWPRSDRPRRAGLSAIGISGTNAHVIVEEAPATEEESGPVDREPVSGPVLLPMSARTPEALVEQAHRVAGLLRAESVDLADLAVSLGTTRAHLEHRAVVVASTPAAALDALATVGRDQPDGDVVRGTADAGGRTTAFVFPGQGSQWPEMGRELMATSALFAEAVDACDAAMRPWQDWSVADVLRQEPGAPGLERVDVVQPVLFTVMVALARLWRSRGVEPAAVVGHSQGEIAAAHVAGILTLDGAARLVVLRSQALRRLSSQGGMVAVACDEDAARERISAWGSALSVAAVNGPRSVVVSGDRDALADLVATCERDGLAARTVDVDYASHSAHVDAVREEVLRHAREVRPRDGEIAFYSTVTAGPLAGSRLDAEYWFRNLRERVRLHETVDLMVDQGYDAFVEVGPHPVLLPALTATVESGSGGDGAVVLATLRRGEGGPTGFARAVAAAYVAGVEIAWSTVAPGGRGRALPVTYPFQHRRFWRSERRGGARPAGLVHHVEWSTLDRSDSTAAPAGTWLVVTPDDAAEGWSDVVLDAVGRAGGTAQVVSTAVVDAWADGTAEVPDGLAGTVVLPPSPGQDAVAVAEWGRSTVQALARTTSGAPLWLLTAGAVAAAPGEVPAHPEQATLHGIGHVARLELGDAWGGVVDLPASASEEVAASLADAWGRRRESVMAVRGGRLLGRRLRDGGARTSDRWRPRGTVLVSGAATPVGAVLARWVAQHGADRLVLVGRAPDPQLVRELEEGGVRVSTSPVDLADLRAAIGEDEPTAVVHAESDPVFAPVVEADADGFRRTVSARSSLPDLLDELLDGARLEREVLCSSVAATWGGAGMAAYAAGAAYLEATAARRRSQGHATSVVTWTPWDLPAGHHAAPDLSGSALRALAVPRALEAWESILAAAPSDVVVADADWPALADEFSAARPTALFDGLAQPAAPAAAGPTPSGPTHDAGSEELRAVAALGGEERREAARVLVADVAADVLGQDQASRVSRTRALREQGLDSLGTLALRKSLVARTGLTLPASLVYDHPSVNAIADHLLALVDPEAGAQDERPVARGAAEEPIAIIGVGCRFPGGIRSPEGLWDLLRTGADVTGSFPDDRGWDVEGLYDPEGLRPGTTYVDRGGFLDDVASFDPGFFGITPREALAMDPQQRLVLETSWEAMERAGIDPEAVRGSDVGVYLGMNGQSYASLLDGEGDRVDGYKGLGNAASVLSGRVAYTFGWEGPALTVDTACSASLVAVHLAVRALRSGECSMALAGGVTVMTDPYTFVDFSSQQGLARDGRCKAFSADADGFALADGVATMLLVPLSRAAELGYPVLGVVRGTAVNQDGASNGLAAPNGPSQERVVRAALADAGLGPQDVDVVEAHGTGTQLGDPIEAGALLSTYGRDPGRPVHVGSVKSNLGHTQAAAGAAGMLKVLLALRHGVVPRTLHADEPTPHVDWASGGLRLAQDDVPWPRGERPRRAGVSSFGVSGTNAHVVLEEAPDAGTVERPGADAARAVPLVLSGRSEGAVRGAARQLASRLADGTHDVRDVAWTLSRGRSAMEWRAAVPADDVPAAVAALEALADGSPTADGVGPTLSRPRRAVLVFPGQGSQWDGMARDLLATSTVFRQSMQECAQALSAHVTWDLFDVVEGRADVDPERVDVLQPVLFSMMVSLARTWRGHGLVPAAVVGHSQGEIAAACVAGALSLDEAARVVALRSRALREIDGDGGMVSVAVAADEAERLLAPWADQLAVAAVNGPRMVVVAGPVEQLDAFCAAVEQAGHEPRRVAVGYGSHSGEVERVRAQVVDALGDVRVRTSEVPVYSTVTAERIDSASMDAGYWYDNLRGRVRFTETVEALVRDGHDLFVEASPHPVLLGGVQDVADDLGADVDVVATLRRDRPGARELARATGEAFAHGASVEPATTVPDGRLVDLPTYPFQRERFWPRRHRPAPVTDSGLPGVEHPVLSTVVEVPGSGERVLVGRLDPHAHPWLAEHVVEGRRLVPGSVLVELALATGELVGLPVLEELLLQEPLELPAAGGLRLRLVVGPDDGGRCDLQVHAAPDGMQDPTWTLQASGVLGADASTSRPTSGGSAWPPADADAIELAGHYDTLAGLGFEYGPAFRGLRRAWRAGERVLAEVEVPAARHGFVVDPVLLDVVAQTLGVAAAESGRLPFAWNGVRVHGPVVGALRVVLGGDPRSDASLEVVTPAGVPVLTVDGIVVRDASAGTDLRSGTLQSLTWVPAQPDGPAPTVTTVEVTTLDELDAPGRPDADLVVLRHVDDDPDPITATRRAVAWAAEVVRRWGATDRRRARLVVVTDGAARVGADDPPARPGPAAVWGVLRAAQAESPNRFLLVDGALDVPARPDLPQVAVRDGLTLVPRLQDRPTSWVPGAGQRVAPGSGSIDGLVLEKVPASQLQPGPGEVRVAVCATGLNFRDVMLALQVYPDAALMGTEAAGVVEAVGEGVTSVEVGDRVLGLFAGAYAERAVTDARLVAPLPPGWSFAEGAAVPIAFTTAYYALHDLAGVQRGQTVLVHAAAGGVGMAAVSLALHAGADVLATASPAKHDAVQARGLPADQVRSSRTSGFAEAFLGHTRGRGVDVVLNSLTGPLLDETIRLVAPDGVVVELGKADLRDPADVAARYLPFDLGEVGPDRLGEILRTVVDLLAGGRVPPVPVSARPLADLRAALTEMSRGGHVGKLVVEQSRPAPLEGTVLVVGGTGTLGSLVARHLVSTRGVRHLLLVSRRGPDAPGAADLVAELEAEGARVDVVACEATDRARLAEVVRGVPAEHPLVGVVHAAGVLADSFVVSIDADAVETVVAPKVDVVQHLDELTADLDLGLFAVFSSAASVLAGPGQGVYAAANAVVEACVARRASRGARATALGWGLWQDSSDLTRGLEDQIARTGVAPLSRARALELLDEALGSDEPVLYPMALDVDALAEADVVPEVLRARVAPRDRVVPTRGRRGTGPDRDERGADWASRLRGLDADARRTEVLDLVRAHAAAVAGFSSAAQLPEQRAFRDLGFDSLAAVELRNRLRDATSVRLPSTLVFDYPTAEAVAERLLEDLEPVVEHDASSLEEQLAALERAVRDATPDQLPADLGSRVRGLLDVLPAGEVEGRAWDGGAAAAALVDDDTSDDELFSLLDARLGAEGDQDR

SEQ ID NO: 31668 - protein, 426 aa, Methanococcus maripaludis
MDDSFDIYEIKARQVLDSRGNPTVEAEVLTAGGGYGHTIVPSGASTGTFEAVELRDKKEKYGGKSVLNAVSNVNDIIAQELIGEDARNQRLIDQIMLNLDGTENKGNLGANAILAVSLAVAKAAADTASLPLYKYIGGSNAYVMPAPMMNVLNGGQHAGNALDFQEFMIMPVGADSFAEAVRMCSETYQSLKKVVAEKYGKDAVNVGDEGGFAPPVKTIDEALAVLLEGVKKAGYEDEIVFTIDSAASEFYDEKSGSYMIAGEKVSTDKLIDIYKEMVEQYPIVSIEDPLFEEDFEGFKTATKELKGIQIVGDDLFVTNTKRLKKGIEMGAANSLLLKVNQIGTLSESIDAANMAFRNGYSLVVSHRSGESEDSTIADLAVALNAGQIKTGAPARGERTAKYNQLMRIEEELQISKYAGKDFKIPF

SEQ ID NO: 31669 - protein, 431 aa, Bacillus cereus ATCC 10987
MSTIIDVYAREVLDSRGNPTVEVEVYTESGAFGRAIVPSGASTGEHEAVELRDGDKSRYLGKGVVNAVNNVNEIIAPEIVGFDVTDQAGIDRAMIELDGTPNKGKLGANAILGVSMAVAHAAADFVGLPLYRYLGGFNAKQLPTPMMNIINGGSHADNNVDFQEFMILPVGAPTFKESIRMGAEVFHALKAVLHDKGLNTAVGDEGGFAPNLGSNREALEVIIEAIEKAGYKAGENVFLGMDVASSEFYNKETGKYDLAGEGRTGLTSAEMVDFYEELCKDFPIISIEDGLDENDWDGHKLLTERLGSKVQLVGDDLFVTNTQKLAEGIEKGISNSILIKVNQIGTLTETFEAIEMAKRAGYTAVVSHRSGETEDATIADIAVATNAGQIKTGSMSRTDRIAKYNQLLRIEDELGEIAVYDGIKSFYNIKR

SEQ ID NO: 31670 - protein, 433 aa, Vibrio vulnificus YJ016
MSKIVKVLGREIIDSRGNPTVEAEVHLEGGFVGMAAAPSGASTGSREALELRDGDKARFLGKGVLKAIEAVNGAIADALVGKDAKDQAAIDAIMIELDGTENKSKFGANAILAVSLANAKAAAASKGMPLYEHIAELNGTAGQFSMPLPMMNIINGGEHADNNVDIQEFMIQPVGAKTLKEAVRMGAEVFHNLAKVLKSKGYNTAVGDEGGFAPNLKSNAEALEVIAEAVAAAGYVLGKDVTLAMDCAASEFFDKEAGIYNMKGEGKTFTSEEFNHYLAGLVEQFPIVSIEDGLDESDWAGFAHQTQLLGDKIQLVGDDLFVTNTKILAEGIEKGIANSILIKFNQIGSLTETLAAIKMAKDAGYTAVISHRSGETEDATIADLAVGTAAGQIKTGSMSRSDRVAKYNQLIRIEEALGERAPFNGLKEVKGQA

SEQ ID NO: 31671 - protein, 481 aa, Pinus taeda
MADQISLLLVVFTAAVALLHLIYRWWNAQRGQKRTSNEKNQELHLPPGSTGWPLIGETYSYYRSMTSNRPRQFIDDREKRYDSDVFVSHLFGSQAVISSDPQFNKYVLQNEGRFFQAHYPKALKALIGDYGLLSVHGDLQRKLHGIAVNLLRFERLKFDFMEEIQNLVHSTLDRWVDKKEIALQNECHQMVLNLMAKQLLDLSPSKETNEICELFVDYTNAVIAIPIKIPGSTYAKGLKARELLIRKISNMIKERRDHPHIVHKDLLTKLLEEDSISDEIICDFILFLLFAGHETSSRAMTFAIKFLTTCPKALTQMKEEHDAILKAKGGHKKLEWDDYKSMKFTQCVINETLRLGNFGPGVFRETKEDTKVKDCLIPKGWVVFAFLTATHLDEKFHNEALTFNPWRWELDQDVSNNHLFSPFGGGARLCPGSHLARLELALFLHIFITRFRWEALADEHPSYFPLPYLAKGFPMRLYNRE

SEQ ID NO: 31672 - protein, 487 aa, Pinus taeda
MGSGIMTETLTDSWLVGLLCLVLGFLLLQLYKLVWGASSRAYKLPPGSTGWPLIGETISFFRGINSTAQPRQFIQEREQRYGEIFRSNLFGRSRIVVSVDPEFNKHVLQHEGRQFQANYPKPLRNLIGKYGLLSVHGDLQRKLHGAAVNLLRFERLSVDFMEDIQNLLHITLAKWEAKRDIHLQEECHQLVLNLMAKQLLDLSPSKDTEEICEAFGHFSEALLAVPIKIPGTKYARGFKAREFLIKKIYESIEDRRQHPEAVHNDLLTKLLKEDSFSEEIIADFILFLLFAGHETSSRSMSFAIKFLTDCPRALEELKAEHDALLKRKGNLKNQKLNWDDYQSLKFTQCVIHETLRVGNFGPGVFRETKEDIKTKGGFVIPRGWTVYVFLTGTHLDEKYHSSALKFDPWRWQPHLQDQELLKNPSFMPFGGGARLCPGMHLAKMELALFLHNFVTKFRWEALQDDKISYFPFPRLIKGLPIRLRLRE

SEQ ID NO: 31673 - protein, 493 aa, Picea sitchensis
MVWKEAVSVLQKAQELKEPPLMFTVFLASFIGLAFFFYLISNHRTKAWRGIPPGTFGWPLIGETLEFLGCQRKGNPRDFFDSRTQKYGNVFTTSLVGHPTVVFCSPEGNRFLFSNENKLVVNSWPSSVGNLFRSSLITTVGDDAKRLRRILMTFLRPEALREFVGRVDSMTKRHLAEHWIGKDEVMALPLLKRYTFSLACDLFASINTKDDLDRLWLHFMVFVKGVMQIPIDLPGTRYNKTKHAANAIRQQLGSIINERKIALEAGNASPEQDLLSFLLSNVDEQGESLTDNEIQDNILLLLYAGHDTSSSTLTVLLKFLAENPHCYEEVLREQLNIAGSKEEGQLLEWEDLQRMKYSWRVAQEALRLFPAVQGSFRKAIKEFIYDGFTIPKGWKLHWTVNSTHQKSEYFSNPEKFDPSRFEGEGPPPYTFVPFGGGPRMCPGNEFARMEILIFLHNIVKNFNWNLVNPLEKVIVDPMPAPVNGLPIKLVPHD

SEQ ID NO: 31674 - protein, 497 aa, Picea sitchensis
MVWKEAVSVLQKAQELKEPPLMFTVFLASFIGLAFFFYLISNHRTKAWRGIPPGTFGWPLIGETLEFLGCQRKGNPRDFFDSRTQKYGNVFTTSLVGHPTVVFCSPEGNRFLFSNENKLVVNSWPSSVGNLFRSSLITTVGDDAKRLRRILMTFLRPEALREFVGRVDSMTKRHLAEHWIGKDEVTALPLLKRYTFSLACDLFASINNKDDLGRLWLHFMVFVKGVMQIPIDLPGTRYNKAKHAANAIRQQLGSIINERKIGLEAGNASPEQDLLSFLLSNVDEQGESLTDNEIQDNILLLLYAGHDTSSSTLTVLLKFLAENPHCYEEVLREQLDIAGSKEAGQLLEWEDLQRMKYSWRVAQEALRLFPAAQGSFRKAIKEFIYDGFTIPKGWKMYWTVNSTHRKSEYFSNPETFDPSRFEGEGPPPYTFVPFGGGPRMCPGNEFARLEILVFLHNIVKNCKWNLVNPGEKVIVDPMPAPVNGLPIKLVPHDSVYI

SEQ ID NO: 31675 - protein, 433 aa, Synechococcus elongatus PCC 6301
MVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 31676 - protein, 442 aa, Magnaporthe grisea
MSAEKKTLSKPAAGVPYYTPAQEPPAGTPLQQQDAIPTLFKPLKIRGVELSNRFGVSPMCTYSADDGHLTDFHLVHLGQFALHGTALTIVEATSVTPNGRISPEDSGLWQDSQIAPLRRIVDYVHSQGQKIAIQLAHAGRKASTKAPWHDSFTPSGEYKPREGLQVVGPEYGGWPDDVWAPSAIPFSEDFPNPKEMTVEEIEGLVTSFVDAAKRAIEAGVDIIEIHGAHGYLITEFLSPLSNKRTDKYGGSFENRTRVLIDIIKAVRAVIPEEMPLFVRISATEWMEYAGEPSWDLEQSTQLAKLLPNLGVDLLDVSSGGNSVAQKIELTPYYQIDLAAKIREAVGDRLLIGAVGNINTADIARDVVDEQGAEKVAEAKQTHDTIEVVSESHGGKTKADLVLIARQFLREPEFVLRTAHNLGVNVQWPHQYHRAVWRKGARI

SEQ ID NO: 31677 - protein, 418 aa, Magnaporthe grisea
MSLSNKLSITDVDVKGKRVLIRVDFNVPLDDNKNITNNQRIAGAVPTIKHALDNGAKTVILMSHLGRPNGSPNPKYSLKPVVSELEKLLGGKKVTFAPDCVGPEVEEIVNKAGEGDVVLLENLRFHIEEEGSAKDKEGNKTKADKAKVEEFRKGLTKLGDIYINDAFGTAHRAHSSMVGVDLPQKAAGFLMKKELDYFAQALESPKRPFLAILGGAKVSDKIQLIDNLLDKVNTLIVCGGMAFTFKKVLDNMAIGNSLFDEAGSKTVPELMKKAQEKGVKVVLPVDFITADKFAADAKTGSATDKEGIPEGWMGLDCGEKSVELFQSAIDESQTVLWNGPAGVFEFDAFAKGTKATLDAAVSGCGKGKIVIIGGGDTATVAAKYGVEDKLSHVSTGGGASLELLEGKELPGVTALSSK

SEQ ID NO: 31678 - protein, 350 aa, Magnaporthe grisea
MPLIAQNPTNRVILGLMTFGPDEATGARITSVDEFGKVLDILQKRGYNEVDTARMYIGGKQEAFTREVGWKQRGLTLATKVQYPSEYGMNAPDKVKESVDLSLKELGTDCVDLLYLHAADRGTPFAETLRAINDLHKAGKFVNFGISNFAAYEVAEIVMTCVQNNWVRPTVYQAMYNVITRSIEAELIPACRRYGLDLVVYNPIAGGLFSGKIKTQDMVPAEGRFSDSTTSMGKMYRNRYFKETTFKALQTIEAAVEKHGLSMIETALRWTVHHSALQVTNGGRDGVIIGVSSGAQLEDNLNHLEKGPLPEEVLKALDSAWEIARGDTANYFHMELKYQYDTKEALFGKI

SEQ ID NO: 31679 - protein, 124 aa, Zymomonas mobilis
MQNDQDYGNKLNPAWDEKGLITAVLTDAKTGLLLMVAHMNKESFELSMATKEATFWSRSRKKIWRKGEESGHVMKIQEIRIDCDQDTLWLKVIPMGPACHTGAQSCFYRLVEDGHLVTIPKDKI

SEQ ID NO: 31680 - protein, 476 aa, Magnaporthe grisea
MSLPKDFLWGFATASYQIEGAIDKDGRGPSIWDTFTAIPGKVADGSSGVTACDSYNRTQEDIDLLKSVGAQSYRFSISWSRIIPIGGRNDPINQKGIDHYVKFVDDLLEAGITPLITLFHWDLPDGLDKRYGGLLNREEFPLDFEHYARVMFKAIPKCKHWITFNEPWCSSILAYSVGQFAPGRCSDRSKSPVGDSSREPWIVGHNLLVAHGRAVKVYREEFKAQDKGEIGITLNGDATFPWDPEDPRDVDAANRKIEFAISWFADPIYFGEYPVSMRKQLGDRLPTFTEEEKALVKGSNDFYGMNCYTANYIRHKEGEPAEDDYLGNLEQLFYNKAGECIGPETQSPWLRPNAQGFRELLVWLSKRYNYPKILVTENGTSVKGENDMPLEKILEDDFRVQYYDDYVKALAKAYSEDGVNVRGYSAWSLMDNFEWAEGYETRFGVTFVDYENGQKRYPKKSAKAMKPLFDSLIEKD

SEQ ID NO: 31681 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCRAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 31682 - protein, 292 aa, Malus x domestica
FRPIEFSGPCKSQLTLQIYGTIEASEDRSIYKDIDHWLIFDNVQNLLVVGPGTINGNGNIWWKNSCKIKPQPPCGTYAPTAVTFNRCNNLVVKNLNIQDAQQIHVIFQNCINVQASRLTVTAPEDSPNTDGIHVTNTQNITISSSVIGTGDDCISIVSGSQRVQATDITCGPGHGISIGSLGEDGSEDHVSGVFVNGAKLSGTSNGLRIKTWKGGSGSVTNIVFQNVQMNDVTNPIIIDQNYCDHKTKDCKQQKSAVQVKNVLYQNIRGTSASGDAITLNCSQSVPCQGIKG

SEQ ID NO: 31683 - protein, 231 aa, Phragmites australis
GHEARGIVESVGEGVTDVAPGDHVLPVFTGECKECAHCKSAESNMCDLLRINTDRGVMIGDGKSRFSNNGKPIYHFVGTSTFSEYTVMHVGCVAKINPEAPLDKVCILSCGISTGLGASINVAKPPKGSTVAIFGLGAVGLAAAEGARIAGASRIIGIDLNANRFEEARKFGCTEFVNPKDHNKPVQEVLAEMTNGGVDCSVECTGNINAMIQAFECVHDGWGVAVLVGVP

SEQ ID NO: 31684 - protein, 131 aa, Hordeum vulgare subsp. spontaneum
HGHATDKVEEYGQPVAGHGGFTDGPTGTHGAAGVGGAQLQATRDGHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 31685 - protein, 131 aa, Hordeum vulgare subsp. spontaneum
HGHATDKVEEYGQPVAGHGGFTDGPTGTHGAAGVGGAQLQATRDGHKTDGVLRRSGSSSSSEDDGVGGRRKKGMKEKIKEKLPGGAHKDAAGQQQQTAMAGEYAGTHGTEATGEKKGVMDKIKEKLPGGQH

SEQ ID NO: 31686 - protein, 131 aa, Hordeum vulgare subsp. spontaneum
HGHATDKVEEYGQPVAGHGGFTGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 31687 - protein, 131 aa, Hordeum vulgare subsp. spontaneum
HGHATDKVEEYGQPVAGHGGFTDGPTGTHGAAGVGGAQLQATRDGHKTDGVLRRSGSSSSSEDDGVGGRRKKGMKEKIKEKLPGGAHKDAAGQQQQTAMAGEYAGTHSTEATGEKKGVMDKIKEKLPGGQH

SEQ ID NO: 31688 - protein, 131 aa, Hordeum vulgare subsp. spontaneum
HGHATAKVEEYGQPVAGHGGFAGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 31689 - protein, 131 aa, Hordeum vulgare subsp. spontaneum
HGHATDKVEEYGQPVAGHGGFAGGPTGTHGAAGVGGTQLQATRDDHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 31690 - protein, 131 aa, Hordeum vulgare subsp. spontaneum
HGHATDKVEEYGQPVAGHGGFTGGPTGTHGAAGVGGAQLQATRDGHKTDGVLRRSGSSSSSSDDGVGGRRKKGMKEKIKEKLPGGAHKDAAGQQQQTAMAGEYAGTHGTEATGEKKGVMDKIKEKLPGGQH

SEQ ID NO: 31691 - protein, 146 aa, Hordeum vulgare subsp. spontaneum
AVAYEANKPLVVEDVQVAPPQAGEVRIKILSTALCHTDYYTWSGKDPEGLFPCILGHEAAGIVESVGEGVTDVQPGDHVIPCYQAECKDCKMCKSGKTNLCGKVRGATGVGVMMSDRKSRFSVNGKPIYHFMGTSTFSQYTVVHDV

SEQ ID NO: 31692 - protein, 475 aa, Acinetobacter baumannii
MLPILITQFAQAGFGLIDTIMAGHLSAADLAAIAEGVGLWIPVMLLFSGIMIATTPLVAEAKGARNTEQIPVIVRQSLWVAVILGVLAMLILSLCHFSYMCLAYQKVYNLKPVYSYMQLVWVCPLLTMYAALRGYSEALGHPRPVTVISLLALVVLIPLNMIFMYGLGPIPALGSAGCGFATSILKGLMLITLAGYIYKASAYRNTSIFSRFDKISLTWVKRILQLGLPIGLAVFLKWVFLVQGMVLASREVFIAAHQVAISVTSVLFMIPLSLAIALTIRVGTYYGEKNWASMYQVQKIGLSTAVFFALLTMSFIALGREQIVSVYTQDINVVPVAMYLLWFAMAYQLMDALQVSAAGCLRGMQDTQAPMWITLMAYWVIAFPIGLYLGALYRLGRTGVWLGLIIGLSIACVLLLSRLYLNTKRLSRQTVIKQSDETCGLFYFMQIFARGLAPICQTNGKSVRFTSQSPITFSL

SEQ ID NO: 31693 - protein, 339 aa, Malus x domestica
MATQQPISKKTACVVGGTGFVASLLVKLLLQKGYAVRTTVRDPDNHKKVSHLTALQELGELEIFAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQN

SEQ ID NO: 31694 - protein, 119 aa, Psidium guajava
IGIHVGRSTGVNITGADIRTGDDCVSLGDGSQQVNVESVTCGPGHGISIGSLGKYHDEQPVVGVTVRNCTLTNTPNGIRVKTWPASPGGVATNMHFEDITVKNVSTPILIDQKNYCPSI

SEQ ID NO: 31695 - protein, 394 aa, Saccharomyces cerevisiae
MWKIMRSWKCGGMRWAHRQRPSHELLSQLSFDQHYKIRSNIELLIQDYASKPIAPLNYEYFLQYRPPLTKKEEYMLTIKTINLLLSLTCKRLNAIQRLPYNAVINPHIERTNSLYLKSLQTLLSIAYPYELHNPPKIQAKFTELLDDHEDAIVVLAKGLQEIQSCYPKFQISQFLNFHLKERITMKLLVTHYLSLMAQNKGDTNKRMIGILHRDLPIAQLIKHVSDYVNDICFVKFNTQRTPVLIHPPSQDITFTCIPPILEYIMTEVFKNAFEAQIALGKEHMPIEINLLKPDDDELYLRIRDHGGGITPEVEALMFNYSYSTHTQQSADSESTDLPGEQINNVSGMGFGLPMCKTYLELFGGKIDVQSLLGWGTDVYIKLKGPSKTALLSKK

SEQ ID NO: 31696 - protein, 437 aa, Cicer arietinum
NSARVMTLKLGQVTTVVISSADMAKEVLLTHDLITSNRTVPDALSVLNHDQYSLSFMRVSPRWRDLRKICNYQLFSNKTLDSSQALRRRKLQDLLNDIERCSKVGEAVDVGKAAFKTTVNLLSNTFFSVDFVHSAKEAGEYKEIIVSILKEVGVPNVSDFFPMLKFLDLQGIRKRSIVSVKKVLSIFKRFVGERVKMREGTGSIGNDDVLDALLNMSSDGGKIEMDKDEIEHLLLNIFVAGTDTTTYTLEWAMAELIHNPEMMSKLKEELEKTVGKGIPVEETDIAKLPYMQAVIKETFRLHPPVPLLLPRRAEIDVKIGDYVIPKDAQILINAWVVGRDPTKWENPNVFIPERFLDSEIDIKGHHFELIPFGSGRRTCPGLPLAIRMLPLMLGSLVNCFDWKLEDGLNVEDFNKEDEFGITLEKSQPVRIVPTKLY

SEQ ID NO: 31697 - protein, 310 aa, Arabidopsis thaliana
MRPPVTGGRGGGGFRGGRDGGGRGFGGGRSFGGGRSGDRGRSGPRGRGRGAPRGRGGPPRGGMKGGSKVIVEPHRHAGVFIAKGKEDALVTKNLVPGEAVYNEKRISVQNEDGTKVEYRVWNPFRSKLAAAILGGVDLDNIWIKPGAKVLYLGAASGTTVSHVSDLVGPEGCVYAVEFSHRSGRDLVNMAKKRTNVIPIIEDARHPAKYRMLVGMVDVIFSDVAQPDQARILALNASFFLKTGGHFVISIKANCIDSTVAAEAVFQSEVKKLQQEQFKPAEQVTLEPFERDHACVVGGYRMPKKQKAPAS

SEQ ID NO: 31698 - protein, 1073 aa, Arabidopsis thaliana
MNLQTPRKSSLSGSRKDLWFAIREGSLVDVDSALSILKKTGGNINLRNAYGLTPLHIAVWRNHIPIVRRLLAAGADPDARDGESGWSSLHRALHFGHLAVASVLIDSGASFTLEDIKLRTPVDLVSGPVAQVIGEQQSSVATEVFSWGNGANYQLGTGNQHVQKVPGRVDSLHGCFIKLVSAAKFHSVAISTHGEVYTWGFGRGGRLGHPEFDIHSGQAAVITPRQVISGLGSRRVKAVAAAKHHTVIATEGGDVYTWGSNRESDVVCDALVEGQLGYTSVDTQATPRKVTSLKAKIVAVSAANKHTAVVSDCGEVFTWGCNKEGQLGYGTSNSASNYSPRLVDYLKGKVFTAIASSKYHTLVYTWGHRLVTPRRVIISRNLKKAGNTLLNFHRRRPLRLTAIAAGMVHSLALAEDGAFFYWVSSDSNLRCQQLHSLHGKTVVSISAGKYWASAVTSTGEVYMWDGKNGKDIAPSLSRLHNLKRATTVAVGETHLLVVGSLYHPAYAPIVLKKSQTLQADKCREEENEELDEGFMFDDVESVNVLQSVQYDNPKERIVPSLKSLCEKVAAECIVEPRNAIQLLEIADSLGAEDLKKYCEDIVIRNLDFILTFSPQSIANTSPDVLANLEKLLDDRSSETWSSRPLPTPTATFPVVIDSEEEESESDILRTRDSHVKHFSSIGGTRMDSFLQPEDELTQHNSKEVRALRKKLQQIEILEAKQSRGQLLDGQQIAKLQKKLDIESSLVELGIPVEEFPEAKATTALPLEGKANKKGKKKKKGNQRFVQVETFPEFGEVKVEIDTMQDKEIEEICEAIKPKGGKTMLDTTMISGFPKESDFVSLSQKKDNPPDSPRSKKLATAANKKKNRKGGLSMFLTGALDDVPKPVVAPPPRPKIEGPVWGGAKISKGLSSLRDIQDEQSKTRSHEPVRTTKNQSGDDSPGKSEGKILLSSFLTSKPIPMEPAKSLQQSDVEKGTPPWASSETPRKLSRPSLRDIQMQEVKKQQSLSHSPKTKTSGFTVATGQGSPSDSPGTNRWFKPEIDAPSAIRSIQIEEKAMKDLRRFYSSVKVVRNQP

SEQ ID NO: 31699 - protein, 490 aa, Rhizobium etli
MTVMESTRTEADGQVFAEEDLGYHKALKPRQIQMIAIGGAIGTGLFLGAGGRLAAAGPALVLVYALCGFFAFLVLRALGELIVHRPTSGSFVSYAREFYGEKLAFAVGWMYWLTWAMTAVADVTAVALYMNFFKAYVPWIAMIDQWVFAFAALVLVLSMNLLSVKVFGELEFWFSLVKVLALLIFLIVGVYFVVTGTPIDGHVPGLNTITDFGGMFPNSVLPALVVIQGVVFAYASIELIGTAAGETENARKVMPRAIRTVVLRLVVFYVGSVLLLSLLLPYTAYKGGESPFVTFFGKIGIQGADVVMNLVVLTAVLSSLNAGLYSTGRILHSMAVSGSAPAALAKMNRSGVPYGGIAVTAVVTAFGVVLNAVVPAEAFEIGLNVAALGIIAAWGVIVLCQLKLWQLSRQGKLARPEFRMFGAPYTGLLTLGFLAIVVILMALDYPVGTYTVASLLLIIPALVVGWLLMRERIHMIAAEQGDERGGFDLA

SEQ ID NO: 31700 - protein, 337 aa, Microcystis aeruginosa PCC 7806
MTTTSPKTLTMDIQKPRVLLIGKMYDEAGQKLLEESTNIEILSNPTPEEINEAIQEVSGVFVRYPNNLEASSIRLAKHLKVISTSGFGTDSIDIMAATEQGVIVVNNPGMSTTAVAEHTLSMILALAKKLPFLDHCVKKGNYLIRNQMQPIQLENKTLGIVGLGRIGTLVAHKCNLALGMRVLAYDPYVPASKAETVGATLLKDLDVLLAESDFVSLHTELTSETREMFNISVFKKMKPTAFLINTSRGKVVCEKDLGIALNQKLISGCALDVFEPEPPALDNPLYNFENVILSPHLAGVTPEASLAAAVSAANQILQVLRGEKPPYMINPEAWNLF

SEQ ID NO: 31701 - protein, 3487 aa, Microcystis aeruginosa PCC 7806
MVESIDYKKLMATTLSKMEVMQARINELETRQSESIAVVGMACRFPGGINSPEKYWSFCQAGLDAIVEVPKSRWDISKLYSQKPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDTACASSLVAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALADARIVPEDVSYIEAHGTGTSLGDPIELNAIASVYGKRSDPLYVASVKTNIGHLEAAAGMAGIIKTILILQQGEIPPHLHFQSPNPLINWQDHPIEIPTQNIPWPNNNKVPIAGVSSFGFSGTNAHVIVQQAPVSKISEIQQQIPSHLLTLSAHNKTALKELAKRFHTLLESHPEIGDICYSAAVGRIDLPERLAIVGDTCPELQQRLAAFAEENPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPTLLIGHSVGEYVAACIAGVFSLEAGLALVVKRGQLMQTTTSGKMASIFADEETVIYLIKNYTQTVSIAAINHPQQIVIAGESASIEEVISTCKKQKIPAQYLPVTQAFHSPLMEPILKEFEKEARQISYQRPQILLLSGLDGEVLENAPDATYWSKQCREPVRFLSSLITAFNKGYNLFLEVGPRPILAEQGRRYKDEVIWLSSLNRGLDNWQTILSALAQLYLNGAPFNPEQFNQNYGYKKVRLPNYPFQRKPFQFQPNPRTENQSIDKIFLDSQTSNLTDTETTVFNMQKHQQEIRNQLKSILALLLKEDENDLPEDETLLNLGADSIILTDFSRKVEEKFQVKVKIDQLFTDLQTLVDIAEYLCQFVKEKPLENTSEITTKVIDDETELSNYLQVIEQLQPIATAYIIKALESLGKKLNQGEQWTIENLRQTLPVARKYHILLNRYLQDLEEANILHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDHPYQILEIGGGTGATSEAILNHLNLDHITYSFSEASPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPSIPKFTVFGESSGKEALMMAQLQSLKDLKDLHEKTIIKQLEVLQTATVSPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIEAVQEQMNRGIGLGMQSNLAAETAALISEMGRVERVAFSNTGTEAIMAAVRIARSRTKRQKIVMFAGSYHGTFDGILARVGEDKTTTQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNEDIDRVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKSDHYLLSLKTHHIVADGWSLGLILQEIGQLYSSQNNTTKEVLTPPMQFRQYLTLRAQETQSPQMLEHRDFWLKTYQEELPTFELATDFPRPAVKTYTGGQESQVIPSEVGQNLQKVGRKNKATLFMTMFAAYTAFLRRISGHKDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFIAQVKLTPNTPALIAGKISLSYQELNEKVNRLTHYLQQEYQLGVGKVIGVMLQRNHYLIIGILATFKTGATYVPIDSQYPHSRIEFILKDSGCHVCLTESNFISKLPEKMEKICLDKIDPIVEKYDKDEPKIFRNSSQTAYIFYTSGSTGNPKGVMGRHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIISNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNYLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQSQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLLIDLFKNWLEQVLKFAHEPLINLSLASSENLIQEGQDMFTEDFNF

SEQ ID NO: 31702 - protein, 228 aa, Oryza sativa
MAAAAAAKIAPSMLSSDFANLAAEADRMVRLGADWLHMDIMDGHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGEVISALRKSVEGSQNKS

SEQ ID NO: 31703 - protein, 457 aa, Saccharomyces cerevisiae
MGLIVSIFNIGCAIGGIVLSKVGDIYGRRIGLITVTAIYVVGILIQITSINKWYQYFIGRIISGIGVGGIAVLSPMLISEVAPKHIRGTLVQLYQLMGTMGIFLGYCTNYGTKNYHNATQWRVGLGLCFAWATFMVSGMMFVPESPRYLIEVGKDEEAKHSLSKSNKVSVDDPALLAEYDTIKAGIEIEKLAGNASWSELLSTKTKVFQRVLMGVIIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCFVIVSETFPLRAKSRGMAIATAANWMWGFLISFFTPFITGAINFYYGYVFLGCLVFAYFYVFFFVPETKGLTLEEVNTMWLEGVPAWKSASWVPPERRTADYDADAIDHDNRPIYKRFFSS

SEQ ID NO: 31704 - protein, 347 aa, Camellia sinensis
MKDSVASATASAPGTVCVTGAAGFIGSWLVMRLLERGYIVRATVRDPANLKKVKHLLDLPKADTNLTLWKADLNEEGSFDEAIEGCSGVFHVATPMDFESKDPENEVIKPTINGVLSIIRSCTKAKTVKRLVFTSSAGTVNVQEHQQPVFDENNWSDLDFINKKKMTGWMYFVSKTLAEKAAWEAAKENNIDFISIIPTLVVGPFIMPTFPPSLITALSPITRNEGHYSIIKQGQFVHLDDLCESHIFLYERPQAEGRYICSSHDATIHDLAKLMREKWPEYNVPTEFKGIDKDLPVVSFSSKKLIGMGFEFKYSLEDMFRGAIDTCREKGLLPHSFAENPVNGNKV

SEQ ID NO: 31705 - protein, 363 aa, Musa acuminata
MGFTENQLCFDLIESWLENHPDPAAFKKDGALLFRELALFQDYHGLPAFKRALTKYMGEVRGNKVAFDPNRLVLTAGATSANETLMFCLAEPGEAFLLPTPYYPGFDRDLKWRTGAEIVPIHCSSSNGFRITKPALEAAYQDAQKRSLRVKGVLVTNPSNPLGTTLTRHELDILVDFVVSKDIHLISDEIYSGTNFDSPGFISIAEATKDRNNVSHRIHIVCSLSKDLGLPGFRVGAIYSENEAVVSAATKMSSFGMVSSQTQYLLAALLSDKEFTDKYLLENQKRLKERHDMLVEGLRRIGIGCLKGSAALFCWVDVRHLLKSNTFKGAMELWKKIVYQVGLNISPGSSCHCDEPGWFSVTF

SEQ ID NO: 31706 - protein, 363 aa, Musa acuminata
MGFAENHVSFDLIESWLEDHPDLTGFKKDGGLVFRELALFQDYHGLPAFKNALARYMGEVRGNKVSFEPSKLVLTAGATSANETLMFCLADPGEAFLLPTPYYPGFDRDLKWRTGVEIVPIHCSSSNGFRITRAALEAALRRAQKRRLRVKGVLVTNPSNPLGTTLTRQELDTLVDFAVANDIHLISDEIYSGTTFGSPGFVSIAEATKGRDDVSHRIHIVCSLSKDLGLPGFRVSAIYSDNEAVVSAATKMSSFGLISSQTQYLLAALLSDKEFTEKYVRESQKRLKERHDMLVEGLRRIGIGCLEGNAGLFCWVDMRHLLRSNTFEGEMELWKKIVYRVGLNVSPGSSCHCDEPGWFRVSF

SEQ ID NO: 31707 - protein, 389 aa, Cyanidioschyzon merolae
MLVSNAMYVLVPCSLKAAQATLRNRKKNSTFVRAKPEQTRILGYARRSPRARQRVQLALTAPPSVALARDVSDLVGNTPIVELKKIPEEEGVQAHILCKLESMEPCSSVKDRIGKYMIVEAEKRGDIQPGKTVLIEPTSGNTGIALAYLAAARGYRLILTMPDSMSIERRMVLRAFGAEVVLTPAAKGMKGAVAKAEQLFHTTPNAYMLQQFNNPDNPKAHYETTGPEIWAATGGKVDAFVAGVGTGGTVTGAGRYLREQNPHVYIMAVEPAESPVLSGGRPGPHKIQGIGAGFVPGILDTKIYNEVKQVTSMDSIEMARRLAVEEGLLCGISSGAAVVAALELGRRPEMKGKNIVVIIPSFGERYLTSALFDKQREEAYNMVAVEVET

SEQ ID NO: 31708 - protein, 390 aa, Cyanidioschyzon merolae
MVQHAANGHAQCSFRPLRYKAETRGRVARSTRERVLLRCLFDMRLVHNVYDSFEDAIGNTPLIKLRRASERTGCNIYGKAEFMEPGGSVKDRAALYLLTDAEKRGTLKLGSIVVEGTAGNTGIGLTLLGNSRGYRTVIVIPETQSEEKKEFLRSCGAELVQVPAAPYRNPNNYVRLSERLAKELGAFWANQFDNPANRRAHEETTGPEIWDQLDGHIDAFNCAVGTGGTLAGVSAFLRAKNPGIKIALTDPQGAALVRYYQCGELVSVGDSITEGIGQSRITGNLEGFVPDMSFEISDAEALQAAYDVVRHEGLHIGLSSGINIAGAIRVAESLGPGHTIVTILCDGGSRYQKKMFQPSFLEQKKLPIPTWLSDSMKPDLAAALSKVYVP

SEQ ID NO: 31709 - protein, 131 aa, Solanum melongena
DPKKKPVTRSVKAGLQFPVGRIGRYLKKGQYAQRVGSGAPVYLAAVLEYLAAEVLELAGNAARDNKKNRIIPRHLLLAVRNDEELGKLLAGVTIAHGGVLPNINPVLLPKKTGAEKAPKSPSKATKSPKKA

SEQ ID NO: 31710 - protein, 437 aa, Saccharomyces cerevisiae
MLEHQLTQEDLEFDKKHIWHPYTSITTPLKVYPITKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEKFIKAGAWIRPFGNIIYILPPYIITSEELTVLTEAIRSVLDFI

SEQ ID NO: 31711 - protein, 437 aa, Saccharomyces cerevisiae
MCEHQLTQEDLEFDKKHIWHPYTSITTPLKVYPVTKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEQFIKAGAWIRPFGNIIYILPPYIITSEELTVLTEAIRSVLDFI

SEQ ID NO: 31712 - protein, 200 aa, Cichorium intybus x Cichorium endivia
MATIGHNNLNAKLVLLGDMGAGKSSLVLRFVKGQFLEFQESTIGAAFFSQTLVVNDATVKFEIWDTAGQERYHSLAPMYYRGAAAAIIVYDITSADSFTRAKKWVQELQKQGNPNMVMALAGNKADLEDKRKVTVEEARVYAEENGLFFMETSAKTAANVNDVFHEIAKRLPRAQPTQNPAGMVLVDRPAEGARAASCCS

SEQ ID NO: 31713 - protein, 200 aa, Cichorium intybus x Cichorium endivia
MATIGHNNLNAKLVLLGDMGAGKSSLVLLFVKGQFLEFQESTIGAAFFSQTLAVNDATVKFEIWDTAGQERYHSLAPMYYRGAAAAIIVYDITSADSFTRAKKWVQELQKQGNPNMVMALAGNKADLEDKRKVTAEEARVYAEENGLFFMETSAKTAANVNDVFHEIAKRLPRAQPTQNPAGMVLVDRPAEGARAASCCS

SEQ ID NO: 31714 - protein, 126 aa, Cichorium intybus x Cichorium endivia
FAPMYYRGAAAAIIVYDITSADSFTRAKKWVQELQKQGNPNMVMALAGNKADLEDKRKVTAEEARVYAEENGLFFMETSAKTAADVNDVFHEIAKRLPRAQPTQNPAGMVLVDRPAEGARAASCCS

SEQ ID NO: 31715 - protein, 222 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHAAGTYGYGQQGTGMAGTGGTYGQQGHTGMTGTGGTYGQQGHTGMTGTGATGGTYGQQGHTGMTGAGAHGTTATGGTYGQQGHTGMTGTGMHGAGGTYGQHGTDTGEKKGIMDKIKEKLPGQH

SEQ ID NO: 31716 - protein, 247 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQQGHTGMTGTGMHGTGGTYGQHGTDTGEKKGIMDKIKEKLPGQH

SEQ ID NO: 31717 - protein, 227 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHSDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQHGTDTGEKKGIMDKIKEKLPGQH

SEQ ID NO: 31718 - protein, 222 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGTGGTYGQQGHTGMTGTGATGGTYGQQGHTGMTGTGAHGTTATGGTYGQQGHTGMTGTGMHGAGGTYGQHGTDTGEKKGIMDKIKEKLPGQH

SEQ ID NO: 31719 - protein, 227 aa, Hordeum vulgare subsp. spontaneum
MEYQGQQQQHGRVDEYGNPVAGHGVGTGMGTHGGVGTGAAAGGHYQPMRDEHQTGRGILHRSGSSSSSSSEDDGMGGRRKKGIKEKIKEKLPGGHGDQQHNAGTYGYGQQGTGMAGTGGTYGQQGHTGMTGMGATDGTYGQQGHTGMAGTGAHGTAATGGTYGQQGHTGMTGTGMHGTGGTYGQQGHTGMTGTGMHGTGGTYGQHGTDTGEKKGIMDKIKEKLPGQH

SEQ ID NO: 31720 - protein, 181 aa, Hordeum vulgare subsp. spontaneum
MEYQGQQQSGQATNRVDEYGNPVAGHGVGTGMGAHGGVGTGAAAGGHFQPMRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31721 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRPGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31722 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRSGSSSSSSSEDDGMGGRRKKGIKDKIKEKLPGGHGDQQHAAGTYGKQGIGMAGTGSTYGQQGHTGMTGTGATGTMATGGTYGQPGHTHMTGTGTHGTDGTGEKKGIMDKIKEKLPGQH

SEQ ID NO: 31723 - protein, 184 aa, Hordeum vulgare subsp. spontaneum
MEYQGQQQHGQATDRVDEYGNPVAGHGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31724 - protein, 191 aa, Hordeum vulgare subsp. spontaneum
MEYQGQQQHGQATNRVDEYGNPVAGHGVGTGMGEHGGVGTGMGAHGGVGTGAAAGGHFQPTRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31725 - protein, 191 aa, Hordeum vulgare subsp. spontaneum
MEYQGQQQHGQATNRVDEYGNPVAGHGVGTGMGEHGGVGTGMGAHGGVGTGAAAGGHFQPTRKEHKAGGILQRSGSSSSSSSEDDGMGGRRKKGIKDKIKEKLPGGHGDQQHAAGTYGQQGTGMAGTGSTYGQQGHTGMTGTGATGTVATGGTYGQPGHTGMTGTGTHGTDGTGEKKGIMDKIKEKLPGQH

SEQ ID NO: 31726 - protein, 194 aa, Hordeum vulgare subsp. spontaneum
MEYQGQQQHGQATNRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHATGTYGQQGIGMAGTGGTYGQQGHTGMTGMGATGTMATGGTYGQPGHTGMTGTGTHGTDGTGEKKGIMDKIKEKLPGQH

SEQ ID NO: 31727 - protein, 191 aa, Hordeum vulgare subsp. spontaneum
MEYQGQQQHGQATNRVDEYGNPVAGHGVGTGMGEHGGVDTGMGAHGGVGTGAAAGGHFQSTRKEHKAGGILQRSGSSSSSSSEDDGMGGRRKKGIKDKIKEKLPGGHGDQQHAAGTYGEQGTGMAGTGSTYGQQGHTGMTGTGATGTVATGGTYGQPGHTGMTGTGTHGTDGTGEKKGIMDKIKEKLPGQH

SEQ ID NO: 31728 - protein, 194 aa, Hordeum vulgare subsp. spontaneum
MEYQGQQQHGQATNRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGMGATGTMATGGTYGQPGHTGMTGTGTHGTDGTGEKKGIMDKIKEKLPGQH

SEQ ID NO: 31729 - protein, 183 aa, Hordeum vulgare subsp. spontaneum
MEYQGQQQHGQATDRVDEYGNPVAGHGVGTGMGTHGGVGTGAAAGGGGHFQPTREEHKAGGILQRSGSSSSSSSEDDGMGGRRKKGIKDKIKEKLPGGHGDQQHAAGAYGQQGIGMAGTGGTYGQQGHTGMTGTGATGTMATGGTYGQPGHTGMTGTGTHGTDGTGEKKGIMDKIKEKLPGQH

SEQ ID NO: 31730 - protein, 181 aa, Hordeum vulgare subsp. spontaneum
MEYQGQQQHGQATNRVDEYGNPVAGHGGGTGMGAHGGVGTGAAAGGHFQPTRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31731 - protein, 191 aa, Hordeum vulgare subsp. spontaneum
MEYQGQQQHGQATNRVDEYGNPVAGHGVGTGMGEHGGVGTGMGAHGGVGTGAAAGGHFQPTRKEHKAGGILQRSGSSSSSSSEDDGMGGRRKKGIKDKIKEKLPGGHGNQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31732 - protein, 191 aa, Hordeum vulgare subsp. spontaneum
MEYQGQQQHGQATNRVDEYGNPVAGHGVGTAMGEHGGVGTGMGAHGGGGTGAAAGGHFQPTRKEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31733 - protein, 194 aa, Hordeum vulgare subsp. spontaneum
MEYQGQQQHGQATDRVDEYGNPVAGHGVGTGMGEHGGVGTGMGAHGGVGTGAAAGGGGGHFQPTRAEHKAGGILQRSGSSSSSSSEDDGMGGRRKKGIKDKIKEKLPGGHGDQQHAAGTYGQQGIGMAGTGGTYGQQGHTGMTGTGATGTMATGGTYGQPGHTGMTGTGTHGTDGTGEKKGIMDKIKEKLPGQH

SEQ ID NO: 31734 - protein, 316 aa, Huperzia lucidula
MSLRDWFEDKRKFGGLVGALTEKATKGYVFGEREKNRYLRLDTTKGLWIRCDNCENMLYVRFLRQNKRICEECGYHLQMSSTERIELLIDRGTWHPMDEDMIARDVLKFYDEDSYKNRIIFYQKRTGLTDAIQTGIGKPNGTPVALGAMDFQFMGGSMGSVVGEKITRPIEYAIRKSMPLIIVCSSGGARMQEGTLSLMQMAKISSVLQIYQARKRLLYVAILTYPTTGGVTASFGTLGDITIAEPKAYIAFAGKRVIEQALRQKIPDGFQVAESLFDHGLLDSIVPRNLLKGVLSEILELYGSAPCKERNNYYFR

SEQ ID NO: 31735 - protein, 169 aa, Huperzia lucidula
MPRSQRNDNFIDKTFTLVADTSLQVIPTTQGEKKAFTYYRDGMSAQSEGEYAEASQNYYEAMRLEIDPYDRSYILHNIGLIHTSNGEHARALEYYFQALERNPSLPQAFNNMAVICHYRGEQAIQQGDFETSEAWFGKAADHWKQAVLLAPGNYIEAQNWLKITGRLKD

SEQ ID NO: 31736 - protein, 440 aa, Candida albicans
MPSHFDTLQLHAGQPVEKPHQPRAPPIYATTSYVFNDSKHGAQLFGLETPGYIYSRIMNPTNDVFEQRIAALEGGIGALATSSGQSAQFLAIAGLAHAGDNIISTSYLYGGTYNQFKVAFKRLGIETKFVNGDAAEDFAKLIDDKTKAIYIETIGNPKYNVPDFEKITKLAHEHGIPVVVDNTFGAGGFLVNPIAHGADIVVHSATKWIGGHGTTIAGVIVDSGNFPWTEYPEKYPQFSKPSEGYHGLILNDALGKAAYIGHLRIELLRDLGPALNPFGSFLLLQGLETLSLRVERQSENALKLAQWLEKNPNVESVSYLGLPSHESHELSKKYLNNDAKYFGGALAFTVKDITNTSSDPFNEASPKLVDNLEIASNLANVGDSKTLVIAPWFTTHQQLSDEEKLASGVTKGLIRVSTGTEYIDDIINDFEQAFKKVYNN

SEQ ID NO: 31737 - protein, 440 aa, Candida albicans
MPSHFDTLQLHAGQPVEKPHQPRAPPIYATTSYVFNDSKHGAQLFGLETPGYIYSRIMNPTNDVFEQRIAALEGGIGALATSSGQSAQFLAIAGLAHAGDNIISTSYLYGGTYNQFKVAFKRLGIETKFVNGDAAEDFAKLIDDKTKAIYIETIGNPKYNVPDFEKITKLAHEHGIPVVVDNTFGAGGFLVNPIAHGADIVVHSATKWIGGHGTTIAGVIVDSGNFPWTEYPEKYPQFSKPSEGYHGLVLNDALGKAAYIGHLRIELLRDLGPALNPFGSFLLLQGLETLSLRVERQSENALKLAQWLEKNPNVESVSYLGLPSHESHELSKKYLNNDAKYFGGALAFTVKDITNTSSDPFNEASPKLVDNLEIASNLANVGDSKTLVIAPWFTTHQQLSDEEKLASGVTKGLIRVSTGTEYIDDIINDFEQAFKKVYNN

SEQ ID NO: 31738 - protein, 440 aa, Davidiella tassiana
MPISKIHSRYVYDSRGNPTVEVDIVTETGLHRAIVPSGASTGSHEACELRDGDKSKWAGKGVTKAVANVNEIIAPALIKENLDVKDQAAVDAFLNKLDGTTNKTKIGANAILGVSMAVAKAAAAEKRVPLYAHISDLSGTKKPFVLPVPFMNVVNGGSHAGGRLAFQEFMIVPSGAPSFTEAMRQGAEVYQKLKSLTKKRYGQSAGNVGDEGGVAPDIQTAEEALDLITDAIEEAGYTGQIKIAMDVASSEFYKADEKKYDLDFKNPDSDKSKWITYEQLADQYKQLAAKYPIVSIEDPFAEDDWEAWSYFYKTSGSDFQIVGDDLTVTNPEFIKKAIETKACNALLLKVNQIGTITEAINAAKDSFAAGWGVMVSHRSGETEDVTIADIVVGLRAGQIKTGAPARSERLAKLNQILRIEEELGDKAVYAGDNFRTAINL

SEQ ID NO: 31739 - protein, 411 aa, Arabidopsis thaliana
MKEKAESGGGVGYVRADQIDLKSLDEQLQRHLSKAWTMEKRKSLSDGEDNVNNTRHNQNNFGHRQLVFQRPLLGGGYSNNNNSSKNDIIRSTEVEKSRREWEIDPSKLIIKSVIARGTFGTVHRGIYDGQDVAVKLLDWGEEGHRSDAEIASLRAAFTQEVAVWHKLDHPNVTKFIGAAMGTSEMSIQTENGQMGMPSNVCCVVVEYCPGGALKSFLIKTRRRKLAFKVVIQLSLDLARGLSYLHSQKIVHRDVKTENMLLDKSRTLKIADFGVARLEASNPNDMTGETGTLGYMAPEVLNGSPYNRKCDVYSFGICLWEIYCCDMPYPDLSFSEVTSAVVRQNLRPEIPRCCPSSLANVMKRCWDANPEKRPEMEEVVAMLEAIDTSKGGGMIPPDQQQGCFCFRRHRGP

SEQ ID NO: 31740 - protein, 290 aa, Schizosaccharomyces pombe
DLYGGSDRLLSFNQRQYGFKVDNVDTSDLAAFEAALRPDTNLVLIESPTNPRISICDIRAIVKITRSKAKDALLVMDNTMLSPVLCNPLDFGYDIVYESATKYLSGHHDLMGGVIATKSDEIAKSVFFNINAMGAAMAPFECFLLLRGIKTMGLRVERAQQNAIEIAKFLKSKGLQVNFPGLDPDAKSTAIFYSFARGPGAVMSVFTGDVEVSKTIVNTTKLFEISVSFGAVNSLISMPAYMSHASIKKEVRDARGLSEDLIRICVGIENVDDLKADLENALAQANFKQN

SEQ ID NO: 31741 - protein, 138 aa, Gossypium hirsutum
  misc_feature (106)..(106): Xaa can be any naturally occurring amino acid
GAKTNFKDYKKFPFKKLYLSKGKEIQTNLQIMSSAAATTTKGGRGKSKAKAVSRSSKAGLQFPVGRVARFLKKGRYAERVGSGSPVYLSAVLEYLAAEVLELAGNXARDNKKNRIIPRHIQLAVRNDEELSKLLGGVT

SEQ ID NO: 31742 - protein, 412 aa, Lactobacillus reuteri
MPGGVNSPVRAFKNVGGDPLFIDHGKDEYIYDIDGNKYIDYVLSWGPLILGHADDHVVAELDKAVAKGTSYGAPTLQETELAKIVNKIMPSIEMIRMVSSGTEATMSAIRLARGYTHRKKIVKFVGNYHGHSDSLLVDAGSGLATFGINTSPGVPDDLAYDTLTVAYNDVAGVKKLFAEHGDEIACAIVEPVAGNMGVIPGTQEFLQTLRNVTNEHGALLIFDEVMSGFRAAYHGVQSLVNITPDLTTLGKVIGGGLPVGAFGGRREIMENITPAGDIYHAGTLSGNPLAMTGGISTLEQLTPDDYVEMDKKVTALTEGIKHAADQYGVPMTVHHVGTMWSYFYNSDPINNFDDVKACDQKLFEKCFWELLAHGVYVAPSQFETNFISTKHTDEDIEKTIAAFDAAFNAATK

SEQ ID NO: 31743 - protein, 470 aa, Corydalis nobilis
  misc_feature (19)..(19): Xaa can be any naturally occurring amino acid
  misc_feature (68)..(69): Xaa can be any naturally occurring amino acid
  misc_feature (126)..(126): Xaa can be any naturally occurring amino acid
ETKASVGFKAGVKDYKLTXYTPDYQTKDTDILAAFRVTPQPGVPPEEAGAAVAAESSTGTWTTVWTDXXTSLDRYKGRCYHIEPVAGEDNQYICYVAYPLDLFEEGSVTNMFTSIVGNVFGFKALXALRLEDLRIPPAYVKTFQGPPHGIQVERDKLNKKGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 31744 - protein, 470 aa, Glaucidium palmatum
  misc_feature (78)..(78): Xaa can be any naturally occurring amino acid
  misc_feature (323)..(323): Xaa can be any naturally occurring amino acid
ETKASVGFKAGVKDYKLTYYTPEYAPKDTDTLAAFRVTPQPGVPPEEAGAAVAAESSTGTWTTVWTDGLTSLDRYKGXCYHIEPVAGEENQYICYVAYPLDLFEEGSVTNMFTSIVGNVFGFKALRALRLEDLRIPVAYVKTFRGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHXGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 31745 - protein, 467 aa, Roupala macrophylla
  misc_feature (135)..(135): Xaa can be any naturally occurring amino acid
  misc_feature (348)..(348): Xaa can be any naturally occurring amino acid
  misc_feature (435)..(435): Xaa can be any naturally occurring amino acid
ASVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPXYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEXDRSRGIYFTQDWVSLPGVLPVASGGIHVWHMPALTEIFGDDSVLQFGGGTLGHPWGNAPGAVANRVALEACVQARNEGRDLAREGNXIIREACKWSPELAAACEVWKEIKFEFEAMDTL

SEQ ID NO: 31746 - protein, 155 aa, Hordeum vulgare subsp. vulgare
MEHGHATNRVDEYGNPVAGHGVGTGMGTGAAAGGHFQPTREEHKAGGILQRSGSSSSSSSEDDGMGGRRKKGLKDKIKEKLPGGHGDQQQTGGTYGQHGHTGMTGTGEHGATATGGTYGQQGHTGMTGTGAHGTDGTGEKKGIMDKIKEKLPGQH

SEQ ID NO: 31747 - protein, 486 aa, Hordeum vulgare subsp. vulgare
MAHFQGQQHGHPATRVDEYGNPVTAGGHGGGVTGTDGLGHFQGQQHGRTTTRLDEYGNPVTAGHGVGLGSTGAGAHGPGHAGYGSTGTNDTGGHGRQVGYGATGTGTHDAGGYGGSGIAPRHGGAGTGVHDAGGLGHTTGHGATGTHGTGHTAGYGSTGTGMTGTHGTGHTAGYDATGTGITGTHGTGHTAGYGSTGTGITGTHGTGHTAGYDATGTGIAGTHGTGRTAGYGGTGTGITGTHGTGHTTGYGGGATGTGITGTHGTGHTHGLGGTGTGITGTHGTGHTTGLGGTGTGITGTHGTGHTAGLGGTGTGITGTHDVVGTHPHGGLGEHKTGGILHRSGSSSSSSSSSEDDGMGGRRKKGMKQKIKEKLPGGNKEQTTATGGYGPGYTGTTGTGGAHGATEGTHEKKGVMEKIKEKLPGGHKNNPPHTTATTGGYGAGTTGTGGYGAGTTGTGGTYGATEGTHEKKGMMEKIKEKLPGGHH

SEQ ID NO: 31748 - protein, 212 aa, Gossypium turneri
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEM

SEQ ID NO: 31749 - protein, 206 aa, Gossypium harknessii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQ

SEQ ID NO: 31750 - protein, 211 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 31751 - protein, 219 aa, Gossypium thurberi
DVYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 31752 - protein, 210 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 31753 - protein, 215 aa, Gossypium trilobum
VYYWECKGYTPLFPRILGHEASGIVESVGEGVNDLKPGDHVLPIFTGECKECRHCLSEETNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31754 - protein, 208 aa, Gossypium klotzschianum
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVI

SEQ ID NO: 31755 - protein, 215 aa, Gossypium klotzschianum
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 31756 - protein, 209 aa, Gossypium davidsonii
VYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIV

SEQ ID NO: 31757 - protein, 215 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGG

SEQ ID NO: 31758 - protein, 214 aa, Gossypium aridum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTG

SEQ ID NO: 31759 - protein, 211 aa, Gossypium schwendimanii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVE

SEQ ID NO: 31760 - protein, 216 aa, Gossypium schwendimanii
DVYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31761 - protein, 220 aa, Gossypium schwendimanii
DIYYWECKGYTPLFPRILGHEASGIVESVGEGVNDLKPGDHVLPIFTGECKGCRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 31762 - protein, 220 aa, Gossypium schwendimanii
DVYYWECKGYTPLFPRILGHEASGIVESVGEGVNDLKPGDHVLPIFTGECKECRHCLSEESNNMCELLRTNCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDRS

SEQ ID NO: 31763 - protein, 216 aa, Gossypium lobatum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31764 - protein, 215 aa, Gossypium lobatum
IYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGG

SEQ ID NO: 31765 - protein, 219 aa, Gossypium lobatum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHVGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 31766 - protein, 219 aa, Gossypium lobatum
DIYYWECKGYTPLFPRILGHEASGIVESVGEGVNDLKPGDHVLPIFTGECKECRHCLSEESNNMCELLRINCDRGVMLADGKTRFSINGKPIYHFVGTSTFSQYTVVHAGQVAKISPTAPLDKVCPISCGICTGFGATVNVAKPKKGQTVAVFGLGAVGLAAAEGARVCGASRIIAVDVNPRRFEEAKRFGITEFVNPKDYDKPVQEVIVEMTGGGVDR

SEQ ID NO: 31767 - protein, 308 aa, Nicotiana tabacum
MELLNTEQRAATMETIKDACENWGFFEVVNHGISHELLDTVEKLTKGHYKKCMEERFKEMVASKGLEAVQTEIKDLDWESTFFLKHLPISNISEVPDLEDEYRKIMKEFAEKLEKLAEQLLDLLCENLGLEQGYLKKAFYGSKGPTFGTKVSNYPPCPKPDLIKGLRAHTDAGGIILLFQDDKVSGLQLLKDDKWIDVPPMRHSIVINLGDQLEVITNGKYKSVEHRVIAQPDGNRMSIASFYNPGSDAVIYPAPELLEKENKVIYPKFVFEDYMKLYAGLKFQAKEPRFEAMKAVETTVNSAPIATV

SEQ ID NO: 31768 - protein, 254 aa, Petunia x hybrida
MGRKFFVGGNWKCNGTAEEVKKILATLNAADVPSQDVVEVVVSPPYVFLPLVKNELRPDFHVAAQNCWVKKGGAFTGEVSAEMLVNLSIPWVILGHSERRALLGESNEFVGDKVAYALSQGLKVIACVGETLEERESGSTMDVVAAQTKAIADRVKDWTNVVVAYEPVWAIGTGKVASPAQAQEVHAELRKWLAANVSPEVAASTRIIYGGSVNGANCKELGGQPDVDGFLVGGASLKPEFIDIIKAAEVKRNA

SEQ ID NO: 31769 - protein, 243 aa, Mycoplasma hyorhinis
MSKTIIIGNWKMNKTFTQTKEFFSAFNQLYIENKNKINQNLDFAVALPAINVAAFSKNTTKLELAVQNMSQFEKGAYTGEISAQMLLDLNVKYAIIGHSERRQYFKETDLDVNAKTQQAIKNNIIPVVCVGETLEEYEAQKTSQVIEYQLKNSLKDVDLSKVIVAYEPIWAIGTGKTATPEQAQQVCKFIRKQTNKNLTILYGGSVSQENIEQLLNQADINGALVGGASLKVDSFIKLLTLNK

SEQ ID NO: 31770 - protein, 323 aa, Nicotiana tabacum
MATKTVCVTGSSGYIASWLVKFLLQRGYTVKATVRDPSDPKKTDHLHSLSGAKERLHLFKANLLEEGAFDAVVDGCEGVFHTASPFYHGVKDPQAELIDPALKGTLNVLGSVAKTPSIRRVVLTSSVAAVAFNGKPRTPEVVVDETWGSDPDFCRESQLWYVLSKTLAEDAAWKFVKEKAIDMVTINPAMVIGGLLQPILNTSCAAVLQLINGAETYPNATLGWVNVKDVALAHILAFENPSANGRYLMVEAVAHYSELVKILREHYPTMKLPEKCVDDKPFPPKYQVNIERAKQLGVEFTPLAESIKETVESLKEKKFYSDA

SEQ ID NO: 31771 - protein, 327 aa, Nicotiana tabacum
MSLAAKTVCVTGASGYIASWLVKFLLQRGYTVKASVRDPNDPKKTQHLLSLGGGAERLHLFKANLLEEGSFDAVVDGYEGVFHTASPFPYSVTDPQAELLAPAVKGTLNLLGSCAKAPSVKRVVLTSSIAVAYSGQPRTPEVVVDESWWTSPDYCREKQLWYVLSKTLAEDAAWKFVKEKGIDMVAINPAMVIGPLLQPTLNTSSGAVLNLVNGAETYPNSTFGWVNVKDVANAHILAFENPSANGRYLMVERVAHYSDILKILRDLYPTMRLPEKCADDNPLMQNYQVSKERAKSLGVEFTPLEESIKETVESLKEKRFFGGSSAM

SEQ ID NO: 31772 - protein, 146 aa, Solanum tuberosum
MPRSRFAGSLISPKVDVYIDMGNPFLNHTVDAFLNIGTVAATKTVAEETYGMVTRGSVSSHNFEKSLKKMCKEGAYWGTVAGVYAGMEYGAERIRGTNDWKNAMIGGALTGALISAACNNNRDKIVMDAITGGAVATASEFLNYLT

SEQ ID NO: 31773 - protein, 321 aa, Pseudomonas aeruginosa
MALNPDIAAYLELVGNGRSSGKSLPMHQLTVQQAREQFDQSSALMDPGLDEPLARVETLFVPARDGTPLPARLYSPQGLSASPPLPGVLYLHGGGYVVGSLDSHDALCASLAERAGCVVLSLAYRLAPEWRFPTAAEDAEDAWCWLAAEAARLGIDPQRLAVAGDSVGGSLCAVLSHRLALRGEASQPRLQVLIYPVTDASRTHQSIERYAVGHLLEKDSLEWFYQHYQRSPEDRQDPRFSPLLGVVPADLAPTLLLVAECDPLHDEGIAYAEHLRQGGARVELCVYPGMTHDFLRMGAIVDEADDAKDMIADALVAALAT

SEQ ID NO: 31774 - protein, 2158 aa, Vibrio cholerae
MKEMTAMQAAYWLGRQHDCLLDGVAAHLYAEFDGQALNRQALTEAVRALYAKHPMLRLAITKDGQQKILPLSTFHQLKVDDLSQWKPDEVESFVHTKRQRMTHQMLDLTQGNPIEISLTLLPEGKHRLHIDADMIACDAQSFRLLVDDLTSLYLEAIEHRLEIIESDVVTFFQYLDAQQADRALAKRKEVDKKWWQERLATIPAEPSLPYQPVPTDAVSANSQRFAHWFTPVERKGLAEVARQHHLTLTQLTLALFSQVIANACQERQFRLNVPTFHRGNRSLDIEHTIGDFSNLLIFSADVGTTQTLLSLCQQTANQLHQLLRHESYSGVSVMRDLSRKQGGVQRSPIVFTSGMEMRDEEIFSDHVTQHLGRMNWVISQGAQVTLDAQIAPAYEGILLNWDVRMENFADKDITALFAHYVDLIRCVALHPEMMQQSVQQIDAQLGYARRESIQEMPLTPLQQAYLLGRSTQIALGGVAMHEFREYRGHIDTQSLHSRLLYLVEHIPALRTRIDQEKWIQWVSPCIALNWQAIDLQHLSREQALLAVEPVRQQYQQRMHDLTRSPWQICVVQLPIEEQEEFSSIVLTSFDALIVDGRTHALILAALLGSEEPDITQVVQNARDTQSISPQFASKKAQDEAYWKSKLHPDCPPPALPWKQALETITTSRYARESLQIPKESVGKLNRCGIENGLFLNSLLTATILDVLSYWTTEIGMRVGFPVLIPSSNAIDGNESSFVILEHEKSTLSLLSQASKLQREMLEALEHLAFSGVDLNRLLMNQAPQALVLPVVLTNGLSWKTLNPEDAVTLFDGVTQTPQVALDIRLTYDEQKNLIISFDYALAVLETELIREMLSALHHRLSQITSSASLAAPLEPCIYLSHYRFNTDESASHDCDFLAKLAQQLFVRTEDKTAVICGEQTLSYAQLGEQVQRVMWQLKARGLTTGNVLAICLPRSVEHIVISLASALSGIIWVPIDAASPKERLNYLLENCHADLVVMDKPCEFGNVIAFDALIEPVLFADGVPDVTPLDQLSRLSQSQQTAYYLYTSGTTGKPKCVVVNNQATSNVIGQTGQAWHLTSEDVVMSVTPLHHDMSVFDLFATLSFGATLVLPAGHEEKDALQWNRLIERHQVTIWVSVPAILEMLLSCTQAGQLHSLRLIAQGGDNIKPATIAQLRAGSNPPRLISLGGPTETTIWSIWHELTADDVSVIPYGRPLAGNRYFIMDEIQRHVPQGVVGRIFTSGVNLAQGYLEDGELKQTDFVTVLDEHGHPVRAFRTGDQGYYRADGNIIFASRINGYVKVRGVRVSLPDIEKQLQTHPALASVVVVDYADTNGDTALAALFSVKPQQSASSQALREFAKQSLPSSHIPSRFIALEALPLSANGKVDRKQCQAHVQRQSISVEPVGQPNQSQPLSPHTLSSASLSEFEQRVWRQHQRHGDGRNQYATAYRLSGKVNIARLITALSQLPNHFPVLNRRYVLDEASGLTLYSAKPTPLEIHFEHVESMDEAFEHLVRWQNQPMDLAKQATLSFCLLSLGSEERVLGVISHQIISEQWDWRRVFECVTNGYNQIACDIDPVMEGEDLSLGFTPVMPQTPLSQALLPWLQPASHATWIEQSLPSANSAINTLCSRKYRIAIHSSVLAEHGLAQPDKQEVLALIAALFARYLAASAKLGQFELYVPHDVERKTRELNGSMIESQLVHIALKGFERPLSQLSQEILDAMRQPLTGGVASETHASAAALVTWLVDPSVHLQLEGLRCEKLLFAAMHPKFEVALGVGLNCQGAIVLELALDATVSPHVGAYLLEQFVAAIGGRTMPSSTTSSSHVSAIELTSNNPPTSNNAHAALAESELELSAVNSSAVEECILAEFRSALGVAEMTAEDDFFDFGGHSLIATRVIGRLLSEQGIELHINDMFSFPNAKQLAQQAVLHRKPTSTSFAVSEVVESSKAPLSLAQASLWKAMSKYAKFGLTHIFNLPFALKFLDEVNEQAFGEAFHWLLLRHAGLRTHFGLEDGQPYQHVIAASNIEHYQWFWTSKDNAAQSVARLLAQEAEHTFDLSQELPLRLNFVRDEQTGTQYLSLLFHHIVLDEWSINILMDELAQVYQHSVQGTRPQWQTEPLPFHEFARKQRSSAFNQTHLNYWLTKFAGVPWAQPLFAAD

SEQ ID NO: 31775 - protein, 1142 aa, Saccharomyces cerevisiae
MDRSDKKVNVEEVNVPSNLQIELEKSGTSSSVSLRSPTKSSATNLAGMAEGARDNASIASSSVDSLNMLLERQRVRQLNHPQHQQHISSSLAKTPTTTSSFCSSGSSKNKVKETNRISLTYDPVSKRKVLNTYEIIKELGHGQHGKVKLARDILSKQLVAIKIVDRHEKKQRKFFTFIKSSKISENDKIKREIAIMKKCHHKHVVQLIEVLDDLKSRKIYLVLEYCSRGEVKWCPPDCMESDAKGPSLLSFQETREILRGVVLGLEYLHYQGIIHRDIKPANLLISGDGTVKISDFGVSLAASSTNSSDSSESLDELELAKTVGTPAFFAPEMCLGEDAFTRYNLTKENLFRGSCISFMIDIWAVGVTLYCLLFGMLPFFSDFELKLFEKIVNDPLKFPTFKEIQSNKVSKVSCEEEYEMAKDLLLKLLEKNPQKRMTIPAIKKHPFVSWDFDHVPENDEKLLSSVLEQKLRFQCNQTDQFEPISISKHELKNAVSGVGKKIKESVLKSIPLKDPSDLSNKNYLHPTETTRGRGDANVIVSEGSVLSNIKELSANDGCLNTDSDTNININDDDHYSGDDNDGHLTKRELERELNKFDDKHEAGNMVNLPINSSFASLDSFYIDNFAMARMGMSSPEAGDSVSSVPNLPSAPSSTRLGRSPVFSGVTNQPSPIRPVLPQQKSSFCATGRYDKSHNSLLRNSSSHLTSYNSGRPSSRTGRMNSRNQNLPKIPNSLSKISTTKLTELRVPKDSEIPSPAKNPNADRLRRFPVKKNTKTPAIKDPPRININSSDKSGSKNSPIKSLYQRMKQSKDNSKTFEVRRGNFFSHFNGDDDDSSSQSSVTSSGSESDSELSSTSSSCTSGTQSRNSSNNNAYSETESLPFEFGVDSEDGSGVLLRDLPNEDQIRPFLDIQPCRRMKVKSSLNLEPPSVSSSSSSSSDEDELILNVGTAGHRRRHNSSKLSELSNSPQKGSNNFMYSNGSVHDSETTITPQNMDDLTLHQALSRSQPISKPGPLVLPKRLDQKKATTETSNLTDIVEFNGNNDHRKDKNFDKVLYSRDLLKDALSSTNAGRRRSIPSNKIRGRKDASITMSTNVGNDEHARNTSCHGDKGQENGAIKQRTHERSRSLTVAELNEEKRRSALP

SEQ ID NO: 31776 - protein, 483 aa, Arabidopsis thaliana
MRRNVDNQSYYVLGHKTPNIRDLYTLSRKLGQGQFGTTYLCTDIATGVDYACKSISKRKLISKEDVEDVRREIQIMHHLAGHKNIVTIKGAYEDPLYVHIVIELCAGGELFDRIIHRGHYSERKAAELTKIIVGVVEPCHSLGVMHRDLKPENFLLVNKDDDFSLKAIDFGLSVFFKPGQIFKDVVGSPYYVAPEVLLKHYGPEADVWTAGVILYILLSGVPPFWAETQQGIFDAVLKGYIDFDTDPWPVISDSAKDLIRKMLCSSPSERLTAHEVLRHPWICENGVAPARALDPAVLSRLKQFSAMNKLKKMALKVIAESLSEEEIAGLRAMFEAMDTDNSGAITFDELKAGLRKYGSTLESTEIHDLMDAADVDNSGTIDYSEFIAATIHLNKLEREEHLVSAFQYFDKDGSGYITIDELQQSCIEHGMTDVFLEDIIKEVDQDNDGRIDYEEFVAMMQKGNAGVGRRTMKNSLNISMRDV

SEQ ID NO: 31777 - protein, 348 aa, Escherichia coli O157:H7
MSQKNFVELRNVTKRFGSNTVIDNINLTIPQGQMVTLLGPSGCGKTTILRLVAGLEKPSEGQIFIDGEDVTHRSIQQRDICMVFQSYALFPHMSLGENVGYGLKMLGVSRSEVKQRVKEALAMVDLEGFEDRYVDQISGGQQQRVALARALILKPKVLLFDEPLSNLDANLRRSMRDKIRELQKQFNITSLYVTHDQSEAFAVSDTVLVMNKGHIMQIGSPQDLYRQPASRFMASFMGDANLFPANFSEEYVDIYGYRLPRAAHFPVQGSGTVGVRPEAITLSNHGEESQRCVIRHVAYMGPQYEVTVEWHGQEILLQVNATRLQPDIGEHYYLEIHPYGMFVLADAA

SEQ ID NO: 31778 - protein, 351 aa, Photobacterium profundum
MENDNFVVLKNVCKRFGDNTVINNLDLEIKKGSLVTLLGPSGCGKTTVLRLVAGLEKPTSGQIFIDGEDVTNTSIQQRDICMVFQSYALFPHLSLYDNVGYGLKMLKLPAAEIKQRVDDALKLVDLSGMGDRFVDQISGGQQQRIALARALVLKPKVLLFDEPLSNLDANLRRSMRETIRDLQQRFNITSLYVTHDQTEAFAVSDTVIVMKDGEIMQQGSPDDLYKTPSSMFMANFMGDANIFTGRYDDGQLNINGYCIPADPEVVQGKAEGDYQIGVRPEAILLTSEGEPSQQCIVNNVVYMGSMYEVAVTWHDQELLLQLNSSQFDANLSDHAYLTINPTGIFLLPFDA

SEQ ID NO: 31779 - protein, 431 aa, Vibrio vulnificus YJ016
MTKSAELYQKAQQTIPGGVNSPVRAFNGVGGSPIFVERADGAFIFDADGKAYIDYVGSWGPMILGHNHAVIREAVIEAAQRGLSFGAPTEMEIKMAELVSELVPSMEQLRMVSSGTEATMSAIRLARGFTGRDKILKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYIAPTGPVYQAGTLSGNPVAMAAGYACLTLLREEGNEKRLASKTKHLADGFKSLAAQHGIPLVVNQVGGMFGFFFTEQEQITCYEDVTKCDLERFKRFFHLMIDHGVYLAPSAFEASFTSLAHGSKEIEATLEAADRCFAILAAESK

SEQ ID NO: 31780 - protein, 322 aa, Paenibacillus thiaminolyticus
MNNIGITVYGCEQDEADAFCALSPRFGVMPSIINANVSESNAKSAPFNQCISVGHKSEVSASILLALKRAGVKYISTRSIGCNHIDTTAAKRMGITVGNVAYSPDSVADYTMMLMLMAVRNAKSIVRSVEKHDFRLDSVRGKVLSDMTVGVVGTGHIGKAVIERLRGFGCKVLAYSRSQSIEANYVPFDELLQNSDIVTLHVPLNADTRHIISHEQIQRMKQGAFIINTGRGPLVYTNELVKALENGKLGGAALDVLEGEEEFFYSDCSQKPIDNQFLLKLQRMPNVIITPHTAFYTEQALRDTVEKTNINCLDFERSQEHE

SEQ ID NO: 31781 - protein, 467 aa, Listeria monocytogenes
MTNWLQKRVRLSPKETALVFEGKEETFEEISEAVERLAGKLFALGIRKDEMIALLGKNDRMTFLLIHALQQLGAVTLFLNNRLTKKEIAYQLANAEVKQVIVADTFEDKVGAGISYSELAETDYKEPELLETWDLSRTASIMYTSGTTGKPKGVIQTYENHWWSAVASVLNLGLTEKDSWLCAVPIFHISGLSIMMRSVIYGIPVYLEEHFDEEKITQLLESGKVSTISVVTSMLERLLKIHGGSYHPNVRTILLGGGPASKTVLEICKQRDIPLVQSFGMTETASQIVTLPPKDALNKIGSSGKALFPAEVKIADDGEILLKGPSITPGYLHNKKATEASFVDGWFKTGDIGYLDEEGFLFVVERRSDLIISGGENIYPTEIEHVIGEYVAVKEVAVIGQPDDKWGSVPVAFIVAEETFDEDELQLICQTNLASYKIPKQIIIVEKLPKTASGKIQRNKLKERHSK

SEQ ID NO: 31782 - protein, 448 aa, Methanocaldococcus jannaschii
MRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 31783 - protein, 467 aa, Listeria innocua
MTNWLQKRVRLSPGETALVFEGKQETFEEIYEAVEKLAGKLFARGIRKDEMVALLGKNDRMTFLLIHALQQLGAITLFLNNRLTKKEITFQLANAEVKQVIVADAFVDKVTSGISYEELQQTTYVEPDLCKTWDLSRTASVMYTSGTTGKPKGVMQTYENHWWSAVSSVLNLGLTEKDSWLCAVPIFHISGLSIMMRSVIYGIPVYLEEHFDEEKITQLLESGKISTISVVTSMLERLLKIQGGSYHPNVRTVLLGGGPANKAVLEICKQRDIPLVQSFGMTETASQIVTLPPKDALNKIGSSGKALFPAEVKIADDGEILLKGPSITPGYLHNEKATAKAFIDGWFKTGDIGYLDEEGFLFVLERRSDLIISGGENIYPTEIEHVIGAYEAVEEVAVVGKSDAKWGSVPVAFIVVNEGFDEGVLKDICQTNLASFKIPKQITIVEHLPKTASGKIQRNKLKERHSN

SEQ ID NO: 31784 - protein, 204 aa, Arabidopsis thaliana
MAASANPSGNNQEGSSATQKVSSSSAAAANGAAVNSVDNGGNTGAAADNSQTIGALRHNPGISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQVNS

SEQ ID NO: 31785 - protein, 250 aa, Gracilaria gracilis
NWKCNLSKADIAELVSAFNAAPPIDAAHVQVVVAPPAVYLDSTRQALRADFDTSAQNAWISKGGAFTGELDAAMVKDVGAEWVILGHSERRHIAQLKESDHTIAMKAAYALQHASLGVIYCIGELLEERESGQTIAVCERQLQALSDAISDWSDVVIAYEPVWAIGTGKVATPEQAEQVHEAVRAWLANNVSPQVAASTRILYGGSVSPANCESLAKQPNIDGFLVGGASMKPTFLEIVDSYKATLAEAV

SEQ ID NO: 31786 - protein, 215 aa, Gracilariopsis lemaneiformis
MPFVSVRPVDYLFKVVLIGDAGVGKSNLLSRFTRNEFSLESKSTIGVEFATRSIQCEGKIIKAQIWDTAGQERYRAITSAYYRGAVGALLVYDITKKDSFDNVQRWLKELKDHADANIVIMLVGNKSDLQHLKAVTTDDASAFAESNGLSFIETSALDNSNVEEAFRSILSEIYRLGSKKALEKGSTSNFAPNATQTIVINPPADEGKTEKAKCC

SEQ ID NO: 31787 - protein, 179 aa, Francisella tularensis subsp. holarctica
ERVDLDKLGIYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIDVSPSDSLAIMAANAHLIPVYSKGIKGVARSMPTSTAVDRVAESLRLP

SEQ ID NO: 31788 - protein, 179 aa, Francisella tularensis subsp. novicida
ESVDLDKLGIYKIENTTVEVINSVIDYAELMQQIFDFDKIRELFAKGFKVRFDSMCAVSGPYAKYIFETLLQAPAGTVVNAQPLEDFGGFHPDPNPVNAEDLVKHMRSGKYDFGAASDGDADRNMIVGKQIDVSPSDSLAIMAANAHLIPAYSKGIKGVARSMPTSTAVDRVAESLRLP

SEQ ID NO: 31789 - protein, 179 aa, Francisella tularensis subsp. tularensis
ESVDLDKLGTYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIDVSPSDSLAIMAANAHLIPVYSKGIKGVARSMPTSTAVDRVAESLRLP

SEQ ID NO: 31790 - protein, 179 aa, Francisella tularensis subsp. holarctica
ERVDLDKLGIYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIYVSPSDSLAIMAANAHLIPVYSKGIKGVARSMPTSTAVDRVAESLRLS

SEQ ID NO: 31791 - protein, 150 aa, Wolbachia persica
SDEDVFKKLNKVIDTNITPVVCIGESLDNRQSGRLKQVLATQLSLMLENLSVEQLAKVVIAYEPVWAIGTGVVASLEQIQETHQFIRSLLSKVGESLAKNIKIVYGGSLKAENANDILSLPDVDGGLIGGASLKAAEFNEIINQANKICT

SEQ ID NO: 31792 - protein, 150 aa, Francisella tularensis subsp. novicida
SGEDVFKKLNKIIDTTITPVVCIGESLDDRQSGKLKQVLATQLSLILENLSVEQLAKVVIAYEPVWAIGTGVVASLDQIQETHQFIRSLLAKVDERLAKNIKIVYGGSLKAENAKDILSLPDVDGGLIGGASLKAAEFNEIINQANKICT

SEQ ID NO: 31793 - protein, 150 aa, Francisella tularensis subsp. mediasiatica
SDEDVFKKLNKIIDTTITPVVCIGESLDDRQSGKLKQVLATQLSLILENLSVEQLAKVVIAYEPVWAIGTGVVASLEQIQETHQFIRSLLAKVDEKLAKNIKIVYGGSLKAENAKDILSLPNVDGGLIGGASLKAVEFNEIINQANKICT

SEQ ID NO: 31794 - protein, 150 aa, Francisella tularensis subsp. tularensis
SDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 31795 - protein, 150 aa, Francisella tularensis subsp. holarctica
SDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICT

SEQ ID NO: 31796 - protein, 363 aa, Pseudomonas putida
MSALFEPYTLKDVTLRNRIAIPPMCQYMAEDGLINDWHQVHYASMARGGAGLLVVEATAVAPEGRITPGCAGIWSDAHAQAFVPVVQAIKAAGSVPGIQIAHAGRKASANRPWEGDDHIGADDARGWETIAPSAIAFGAHLPNVPRAMTLDDIARVKQDFVDAARRARDAGFEWIELHFAHGYLGQSFFSEHSNKRTDAYGGSFDNRSRFLLETLAAVREVWPENLPLTARFGVLEYDGRDEQTLEESIELARRFKAGGLDLLSVSVGFTIPETNIPWGPAFMGPIAERVRREAKLPVTSAWGFGTPQLAEAALQANQLDLVSVGRAHLADPHWAYFAAKELGVEKASWTLPAPYAHWLERYR

SEQ ID NO: 31797 - protein, 349 aa, Pseudomonas fluorescens
MATIFDPIKLGDLELSNRIIMAPLTRCRADEGRVPNALMAEYYVQRASAGLILSEATSVTPMGVGYPDTPGIWSNDQVRGWTNITKAVHAAGGKIVLQLWHVGRISHPLYLNGEAPVAPSAIQPKGHVSLVRPLADYPTPRALETAEIAEIVEAYRTGAENAKAAGFDGVEIHGANGYLLDQFLQSSTNQRTDNYGGSLENRARLLLEVTDAAIDVWGAGRVGVHLAPRADSHDMGDDNLAETFTYVARELGKRGIAFICSREKEGADSLGPQLKEAFGGAYIANERFTKDSANAWLAEGKADAVAFGVPFIANPDLPARLKADAPLNEPRPELFYGKGPVGYIDYPTL

SEQ ID NO: 31798 - protein, 281 aa, Mimosa pudica
MSKEVSEEGQTQHHGKDYVDPPPAPLIDMAELRLWAFYRALIAEFIATLLFLYITVATVIGHKKQSGPCDGVGLLGIAWGFGGMIFVLVYCTAGISGGHINPAVTFGLFLARKVSLIRALAYMVAQCLGAICGTGLVKAFMKHSYNSLGGGANEVNSGYSKGTALGAEIIGTFVLVYTVFSAIDPKRSARDSHVPVLAPLPIGFAVFMVHLATIPITGTGINPARSFGAAVIYNNGKAWDDHWIFWVGPFVGALAAAAYHQYILRAAAIKALGSFRSNPTN

SEQ ID NO: 31799 - protein, 250 aa, Mimosa pudica
MVKIAFGSLNDSFSAASIKAYVAEFIATLLFVFAGVGSAIAYGALTKDAALDPAGLVAVAVAHAFALFVGVSVAANISGGHLNPAVTFGLVIGGNITVLTAIFYWIFQLLGSLVACLLLKFVTSAPTVPVHGLASGVGIFEGIVFEIVATFGLVYTVYATAADPKKGSLGIIAPIAIGFIVGANILAAGPFSGGSMNPARSFGPAAVSGDFTNYWIYWVGPLIGGGLAGLIYGDVFIGSYAPVPTSESYP

SEQ ID NO: 31800 - protein, 410 aa, Alcanivorax borkumensis
MENEKQDATVIVGGGHAAGALMTALIQKKYPHEVVLVGEEPYPPYQRPPLSKTYLSGEVNEESLYLKPRSVYEGAGHQLRLGVRVENIDRDNKTLTLSDQSTLKYGRLILATGSHVRRLNAPGSELKGIHYLHDIADTDTLRDQLSPGARLVIVGGGYIGLEVAASASKKGVNVTVLEGAERLMQRVTGVEMSSFLYAKHSGSGVDVRLNTAVTGFKAGDQGRVAGVTLANGETVDADVVLVSIGVIPETALAEAAGLSCEDGILVDEYVRTSDPSILAIGDCTRHRNLFFEKMQRLESVANAVDQARTAAATLMGEDKPYDSAPWFWSNQYDVRLQMVGLSQDHDERVMRGSTEDKAFAVFYLREGCVIAVDAVNMPIAFMVGKQLVQHRKSISADVLSDLDVELKSLI

SEQ ID NO: 31801 - protein, 374 aa, Pseudomonas putida
MAKRDYYEVLGVERGANEGDLKKAYRRLAMKYHPDRNPGDKESEEQFKEANEAYEVLSDASKRAAYDQYGHAGVDPSMGGGGAGFGGANFSDIFGDVFSDFFGGGRGGSRGGAQRGSDLRYTLELNLEEAVRGTTVSIRVPTLFNCNPCDGCGANKGSTPSTCPTCGGIGQVRMQQGFFSVQQTCPRCHGQGKIITDPCGACHGEGRVEEYKTLSVKVPAGVDTGDRIRLSGEGEAGTHGGPTGDLYVVINVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKANGWFDGVKRFFGDL

SEQ ID NO: 31802 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALADFRQVRQEEVMILTRVLAGTEQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVIGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLELEKLNMEEVFGISLQRVQPLLVHPRPRLARHVYGTG

SEQ ID NO: 31803 - protein, 320 aa, Arabidopsis thaliana
MASTAATAALSIIKSTGGAAVTRSSRASFGHIPSTSVSARRLGFSAVVDSRFSVHVASKVHSVRGKGARGVITMAKKSVGDLNSVDLKGKKVFVRADLNVPLDDNQNITDDTRIRAAIPTIKFLIENGAKVILSTHLGRPKGVTPKFSLAPLVPRLSELLGIEVVKADDCIGPEVETLVASLPEGGVLLLENVRFYKEEEKNEPDFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKL

SEQ ID NO: 31804 - protein, 281 aa, Clostridium beijerinckii
MDMNERLVRIPVREQDPKVRAANFEEVCIGYNEEEATKEASRCLNCKNPKCVEGCPVSINIPGFISYVKDEKFEEAAKEISKYSSLPAVCGRVCPQEKQCEGRCVLGIKGDSVSIGKLERFTADWAVSHNVDLSATEPKNGIKVAVIGSGPAGLTCAGDLAKKGYEVTIFEALHKAGGVLEYGIPEFRLPKEKVVKNEVENIKKLGVKIETNVIVGRTITIDQLFEDEGFKAVFIGSGAGLPRFMGIPGENANGVCSANEFLTRVNLMKAAVEGYDTPVRS

SEQ ID NO: 31805 - protein, 197 aa, Raphanus sativus
MPRSRSRVLILLLPLAFVFYLYRYLPSPAIVDQSSYSSIYHISVKDIDGNDVSLSKFTGKVLLIVNVASKCGLTQGNYKELNILYAKYKTKGLEILAFPCNQFGSQEPGSNKEIKDNICTTFKGEFPIFDKIEVNGENASPLYKFLKEQKGGLFGDSIKWNFAKFLVDKQGNVVDRFAPTTSPLEIEKDIEKLLAST

SEQ ID NO: 31806 - protein, 475 aa, Chlamydomonas reinhardtii
  misc_feature (104)..(104): Xaa can be any naturally occurring amino acid
  misc_feature (151)..(151): Xaa can be any naturally occurring amino acid
  misc_feature (201)..(201): Xaa can be any naturally occurring amino acid
  misc_feature (256)..(256): Xaa can be any naturally occurring amino acid
  misc_feature (369)..(369): Xaa can be any naturally occurring amino acid
MVPQTETKAGAGFKAGVKDYRLTYYTPDYVVRDTDILAAFRMTPQPGVPPEECGAAVAAESSTGTWTTVWTDGLTSLDRYKGRCYDIEPVPGEDNQYIAYVAYXIDLFEEGSVTNMFTSIVGNVFGFKALRALRLEDLRIPPAYVKTFVGXPHGIQVERDKLNKYGRGLLGCTIKPKLGLSAKNYGRAVYECLRGGLDFTXDDENVNSQPFMRWRDRFLFVTEAIYKAQAETGEVKGHYLNATAGTCEEMMKRAVXAKELGVPIIMHDYLTGGFTANTSLAIYCRDNGLFLHIHRAMHAVIDRQRNHGIHFRVLAKALRMSGGDHLHSGTVVGKLEGEREVTLGFVDLMRDDYVEKDRSRGIYFTQDWXSMPGVMPVASGGIHVWHMPALVEIFGDDACLQFGGGTLGHPWGNAPGAAANRVALEACTQARNEGRDLAREGGDVIRSACKWSPELAAACEVWKEIKFEFDTIDKL

SEQ ID NO: 31807 - protein, 475 aa, Chlamydomonas reinhardtii
  misc_feature (104)..(104): Xaa can be any naturally occurring amino acid
  misc_feature (151)..(151): Xaa can be any naturally occurring amino acid
  misc_feature (201)..(201): Xaa can be any naturally occurring amino acid
  misc_feature (256)..(256): Xaa can be any naturally occurring amino acid
  misc_feature (369)..(369): Xaa can be any naturally occurring amino acid
MVPQTETKAGAGFKAGVKDYRLTYYTPDYVVRDTDILAAFRMTPQPGVPPEECGAAVAAESSTGTWTTVWTDGLTSLDRYKGRCYDIEPVPGEDNQYIAYVAYXIDLFEEGSVTNMFTSIVGNVFGFKALRALRLEDLRIPPAYVKTFVGXPHGIQVERDKLNKYGRGLLGCTIKPKLGLSAKNYGRAVYECLRGGLDFTXDDENVNSQPFMRWRDRFLFVAEAIYKAQAETGEVKGHYLNATAGTCEEMMKRAVXAKELGVPIIMHDYLTGGFTANTSLAIYCRDNGLFLHIHRAMHAVIDRQRNHGIHFRVLAKALRMSGGDHLHSGTVVGKLEGEREVTLGFVDLMRDDYVEKDRSRGIYFTQDWXSMPGVMPVASGGIHVWHMPALVEIFGDDACLQFGGGTLGHPWGNAPGAAANRVALEACTQARNEGRDLAREGGDVIRSACKWSPELAAACEVWKEIKFEFDTIDKL

SEQ ID NO: 31808 - protein, 457 aa, Schizosaccharomyces pombe
  misc_feature (1)..(1): Xaa can be any naturally occurring amino acid
  misc_feature (99)..(99): Xaa can be any naturally occurring amino acid
  misc_feature (379)..(379): Xaa can be any naturally occurring amino acid
  misc_feature (388)..(388): Xaa can be any naturally occurring amino acid
  misc_feature (435)..(435): Xaa can be any naturally occurring amino acid
XSLCLPTIRKIAIIGAGPSGLVTAKALLAEKAFDQVTLFERRGSPGGVWNYTSTLSNKLPVPSTNPILTTEPIVGPAALPVYPSPLYRDLQTNTPIELXGYCDQSFKPQTLQFPHRHTIQEYQRIYAQPLLPFIKLATDVLDIEKKDGSWVVTYKGTKAGSPISKDIFDAVSICNGHYEVPYIPNIKGLDEYAKAVPGSVLHSSLFREPELFVGESVLVVGGASSANDLVRHLTPVAKHPIYQSLLGGGDIQNESLQQVPEITKFDPTTREIYLKGGKVLSNIDRVIYCTGYLYSVPFPSLAKLKSPETKLIDDGSHVHNVYQHIFYIPDPTLAFVGLALHVVPFPTSQAQAAFLARVWSGRLKLPSKEEQLKWQDELXFSLSGANNXYHSLDYPKDATYINKLHDWCKQATPVLEEEFPSPYWGEKERSIRENXWSIRAKFFGIEPPKEGHHHHHH

SEQ ID NO: 31809 - protein, 174 aa, Lactuca sativa
MASISSSAIATVNRTTSTQASLAAPFTGLKSNVAFPVTKKANNDFSSLPSNGGRVQCMKVWPPIGLKKYETLSCLPPLSDEALSKEIDYLIRNKWIPCLEFELEHGFVYREHHHSPGYYDGRYWTMWKLPMFGCTDSAQVMKEVGECKKEYAGTEFAKGSLKVKLLKWPRSPLQ

SEQ ID NO: 31810 - protein, 337 aa, Streptomyces filamentosus
MYEHIAEAIKKPDLIALRPDLVCLRFETMKIYSALGAVRHLLESGTVKPGDTLVDSSSGIYAQALALACHRYGMKCHIVGSTTVDRTLKAQLEILGATLEQVRPSRNLRLDQELRVRRIAEILEENPSYHWMRQYHDSIHYYGYREVAETIADEVPAGPLTLVGGVGSGASTGAIASYLREAGRDVSLVGVQPFGSVTFGSEHVSDPDMIIAGIGSAIPFENVRHDLYDRIHWVSFDSALAGAVHLLRSSGIFAGLSAGAAYLTTRWERSKDDSRTYVFIAADTGHRYVDSAYAKHTEAPDIEDLEPREITSLDELSHPWSAMTWTDDSTSDQKKAL

SEQ ID NO: 31811 - protein, 465 aa, Comamonas sp. DJ-12
MTSTPINQNTNPTVANVQTVLNENPFSRYQWVIFGLCFLIVLLDGFDTAAIGFIAPSLLGEWGLDKSHLGPVLSAALFGLAFGALGAGPLADRFGRKTVLIIAAVVMGVASIVSGTVHDLNGLTIWRFITGLGLGAAMPNAITLMNEYCPDSKRSFITNCMFCGFPVGSALGGFIAAWMIPHFGWRSLLIVGGVVPLILAAIMIVMLPESVRFMVLKNYSADRVRKIMVRIAASTRNATRFVLDDNAQRAAQVQQGPQGLRLVFSQKYLVGTLALWVTYFMGLVIVYGLVNWMPVLFKDAGVPPSQAAVIAALFQLGGVGAIFFGLLMDRWNANLIIAVGYFLTSIAVAMIGQVLGGGVGMLVASVFIAGLVINAAQSSMQALAAEYYPTECRASGVSWMLGIGRFGGIAGSFLVAELSRRHLELPQVFMVVAIPGVIAALALLIKNRYAGGAPRKSMAGLGGAH

SEQ ID NO: 31812 - protein, 301 aa, Ralstonia solanacearum
MVIWLRREAALGVSSDVIRAADRHRVVELDAAVQAVYEERDAVLAAARAKAEAIVAQARAVADDLIKDANERAANSEQLGYAEGQRKALAEFHASMVARAYSEAESTRRVEARLQTAVMQAVERIVLESDRQALFARVASTLGGVLQSQARLTLRVCPAELDAARAAFARAVEGGLLNATVEVLADAAPSPAIAAANGDHGVADASLSVQLAAVRKAIAPSASVPAEAAQPAAAEDEEEDADIDAPDEYEYDYDDSEDEEDEDAVSHEDGEDEEDDDSDDDDEDEDLYEEDDEDEDEEDDE

SEQ ID NO: 31813 - protein, 383 aa, Schizosaccharomyces pombe
MSIRFLKRLRAPLYIQNAYCSKNYFYRSFIQYYSPSNGPYLKISMNKAPQSLGLCTARGDSPTNQDRMAYGYLNNLKDTTNRDSPFFYGLFDGHGGTECSEFLSTNLGKIIENQDLNDTEKILKEVHSVGGYMAGLKPPFSLRTVLQSRDEDLLWRARLYYSFLQADMDYLTNYARPSPDSAVPGAVGTVAIITSKNNLSYWESDSYIIHLAHVGDTRALLCDSRTGRAHRLTFQHHPADVEEARRLRRYNMGFSRDSFGQKRFAWVANTRSFGDGYKLKKLGVVAEPQLTSIHSLRDDWSFLTLLSDGITDVVSDDEVVDIIKLSESPQDAANNIIRYAQNVGAVDDITCLVVRLPGWKKRTINDFTKNLRLEKSAYHPRRS

SEQ ID NO: 31814 - protein, 188 aa, Brassica rapa
LDNPAPFVSPFQFEISYECLTSLQDDLEWKLVYVGSAEDETYDQTLESVLVGPVNVGNYRFVLQADPPDPSKIREEDIIGVTVLLLTCSYMGQEFLRVGYYVNNDYEDEQLREEPPTKVLLDKVQRNILSDKPRVTKFPINFHPEDEQTPAAADPPPPTEQSDDQQQADDNCDEAQVLPEQPPIPHES

SEQ ID NO: 31815 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 31816 - protein, 510 aa, Petunia x hybrida
MEISSIYIALAWLVALTIISKVIKNKFPKRKLPPGPWPWPVIGNLNLVGSNPHESLHYLSQKYGDLMLLKFGSKPVLIVSSPEMAKEFLKTHDAIFASRPPLAAGKFTSFNFSDMTWAPYGRFWRQARKLYLSEIFNPKRLDSFKHIRVEETQALISRLHALSRSNPVYLRDHLPQFTLSTVSRIAMGRKYYSDESNLNESSPVTFEKLKWMLDDWFMLGGVINLGDWVPFLSWFDPQGYVKRMKPLGKSFIEFYKYVLEDHKAKAKETCVPKDMIDVILQLADDPNLEVKFTSDQIVGLIHGMQTGGIDTSASAVEWAFQELLRKPKIIEKANEELDRAIGKERWIQEEDFTRLPYIEAIIKETFRLHPLCALLPPHYSIEDCCVAGYDIPKGTSVYVNAWSIGRNPKYWDKPEEFIPERFLENDIDIKGQNFTLLPFGSGRRRCPGYSLGIKLVRTTMANLLHGFNWKLAQDMKPEDICMEEVYGLTTHLKKPISMIMEPRLPLHLYN

SEQ ID NO: 31817 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31818 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNCELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 31819 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGGGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITVAYAENAGIANLLLAPYFKKIADEYQQALRDVVAYAVQNGIPVPTFSAAVAYYDSYRAAVLPANLNQAQRDYF

SEQ ID NO: 31820 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIGKVRRALYPGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 31821 - protein, 443 aa, Salmonella enterica
IGVVGMAVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFPEWNNGELSSYLIDITKDIFTKKDEDGNYLVDVILDEAANKGTGKWTSQSALDLGEPLSLITESVFARYISSLKAKRVAASKVLSGPKAQPASDKAEFIEKVRRALYLGKIVSYAQGFSQLPAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 31822 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKEIAYEYQQALRDVVAYAVQNGIPVPTFSAAVAYYDSYRAAVLPANLIQAQRDYF

SEQ ID NO: 31823 - protein, 443 aa, Salmonella enterica
IGVVGMAVMGRNLALNIESRGYTVSILNRSREKTEEVIAENPGKKLVPYYTVKEFVESLETSRRILLMVKAGAGTDAAIDSFKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 31824 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGGIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYFLLKGGLNLSNEELASTFTEWNNGELSSYLIDITKDIFTKKDEDGNYLVDVILDEAANKGTGKWTSQSALDLGEPLSLITESVFARYISSLKAKRVAASKVLFGPKAQPVGDKAEFIEKVRRALYLGKIVSYAQGFSQLRAASEEYHWDLNYGEIAKIFRTGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 31825 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 31826 - protein, 443 aa, Salmonella enterica
IGVVGMAVMGSNLALNIESRGYTDSVFNRSREKTEEVITENPGKKLVPYYTVKEFVESLDTTRRILLMVKAGAGTDAAIDSLKPYLEKGDIIIDGGNIFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLFGPKAHPAGDKAEFIGKVRRALYLGKIVSYAQGFCQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31827 - protein, 443 aa, Salmonella enterica
IGVVGMAVMGRNLALNIESRGYTVSVFNRSREKTEEVIAENPGKKLVPYYTVKEFVESLETPRRILLMVKAGVGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITESYAENAGIANLLLAPYFKKIADEYQQALRDVVAYAVQNGIPVPTFSAAVAYYDSYRAAVLPANLIQAQRDYF

SEQ ID NO: 31828 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSHAQGFSQLRAASDEYHWELNYGESAKIFRAGCIIRAQFLQKITEAYVENAGIANLLLAPYFKKIAYEYQQALRDVVAYAVQNGIPVPTFSAAVAYYYSYRAAVLPANLFQAQRDYF

SEQ ID NO: 31829 - protein, 443 aa, Salmonella enterica
IGVVGMAVMGRNLALNIESRGYTVSVFNRSREKTEEVIPENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRPLYLGKIVSYAQGFSQLRPASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 31830 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAHPVGDKAEFIEKVRRALYLGKIVSYAQGFSQLPAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 31831 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFTFIGTGVSGGEEGALKGPSIMPGGQKDAYDLVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAKRVAASKVLSGPKAHFGGDKADFIEKVRRALYLGKIVPYAQGFSQLPAASDEYHWDLNYGKIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31832 - protein, 443 aa, Salmonella enterica
IGVVGMAVMGRNLALNIESRGYTVSVFNRSREKTEEVIAENPGKKLVPYYTVKEFVESLETPRRILLMVKAGAGTDGAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 31833 - protein, 443 aa, Salmonella enterica
IGVVGMAVMGRNLALNIESRRYTVSIFNRSREKTVEVIAENPGKKLVPYYTVKEFVESLETPRRILLMVKAGAGTDAAIDSLKPYLEKGDIIIDGGNTFSQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFTEKVRRALYLGKIVLYAQGFSQLTAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 31834 - protein, 443 aa, Salmonella enterica
IGVVGMAVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIKYGVMQLIAEAYSLLKGGLNLSNEELANTFTEWNNGELSSYLIDITKDIFTKKDEDGNYLVDVILDEAANKGTGKWTSQSALDLGEPLSLITESVFARYISSLKDQRVAASKVLFGPKAQMGGGKAEFFEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31835 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31836 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRTGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31837 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSALRAASDEYHWDLNYGEIAKIFRAGCSIRAQFLQKITDAYSENAGIANLLLAPYFKKIADEYQQALRDVVAYAVQNGIPVPTFSAGVAYYDSYRAAELPADLSQAQRDYF

SEQ ID NO: 31838 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKTVSYAKGFSQLAARSDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 31839 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 31840 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPTGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 31841 - protein, 443 aa, Salmonella enterica
IGVVGMAVMGRNLALNIESRSYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAKRFAASKVLSGPKAQPVGDKAEFIGKVRPALYLGKTVSYAQGFSKLRAPSDEYHWDLNYGEIAKIFRAGCIIRAQFLQKITDAYAENAGIANLLLAPYFKKIADEYQQALRDVVTYAVQNGIPVPTFSAAVAYYDSYRAAVLPANLIQAQRDYF

SEQ ID NO: 31842 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKGKRVAASKVLSGPKAQPAGDKAEFIEKVRRALYLGKIVSYAQGFSQLRAASDEYHWDLNYGEIAKIFRAGCIIRGEFLQKITDAYAENAGIANLLLAPYFKKIADEYQQALRDVVAYAVQNGIPVPTFSAAVAYYDSYRAAVLPANLIQAQRDYF

SEQ ID NO: 31843 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKIVSYAQGFSQLPAASDEYHWDLNYGEIAKIFRAGCINRGEFLQKITDAYAENAGIANLLLAPYFKKIADEYQQALRDVVAYAVQNGIPVPTFSAAVAYYDSYRAAVLPANLIQAQRDYF

SEQ ID NO: 31844 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGPDGAGHYVKMVHNGIAYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVPASKVLSGPKAQPAGDKAEFIGKVRRALYLGKTVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31845 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31846 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEVGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAGFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 31847 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAADKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 31848 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAHRVAASKVLSGPKAQPAGDKAEFIEKVRRALYLGKIVSYAQGFSQLRAASDEYHWDLNYGEIAKIFRAGCIIRAQFLQKITDTYAEKAGIANLLLAPYFKKIADEYQQALRDVVAYAVQNGNPVPTFSAAVAYYDSYRAAVLPANLNQAQRDYF

SEQ ID NO: 31849 - protein, 129 aa, Yersinia pseudotuberculosis
IGVVGMAVMGSNLALNIESRGYSVSILNRSSDKTDEVVAENPGKNLVPSYTVEEFVDSLEKPRRILLMVKAGEATDKTIASLTPHLDKGDILIDGGNTYYKDTIRRNRELSAQGFNFIGTAVSGGEEGP

SEQ ID NO: 31850 - protein, 336 aa, Schizosaccharomyces pombe
MSGKLVLVTGVTGFIGAHVAEQLLQAGYRVRGTVRSMEKADELIRLNPGLKDKIEFVIVKDVSASNAFDGVLKDVELICHIASPFFVENVTDNKSQLLDPAVKGTLGILEAAQGVKSIKRIVITSSFAAVGNFQIDPHNNKVYTEKDWNPITYEEALTTDNGIVAYCASKKLAEEAAREYVKEKKPSYDICTINPPYVYGPPIHPMKNMDSLNTSNQIFWKLIDGSKEATPFYYYYVDVRDVAAAHVFALENAKLSNGRMLVSKGVFTTGDICKVLRKEFPNKSDVIAEPVDITVDPSFFKLDNSFSKSLGFKYHSDEECYVDTAKKLWERAEEFK

SEQ ID NO: 31851 - protein, 233 aa, Arabidopsis thaliana
MVSPKIAPSMLSSDFANLAAEANRMIDLGANWLHMDIMVPTFYSLLWGHFVPNLTIGAPVIESLRKHTNAYLDCHLMVTNPMDYVAQMAKAGASGFTFHVEVAQDNWQQLVEKIKSTGMRPGVALKPGTPVEQVYPLVEGTTPVEMVLVMTVEPGFGGQKFMPDMMDKVRALRQKYPTLDIQVDGGLGPSTIDTAAAAGANCIVAGSSVFGAPEPGDVISLLRTSVEKAQPTT

SEQ ID NO: 31852 - protein, 339 aa, Pisum sativum
MVQEKKLVDEVSGWLRIYDDGSVDRTWTGPPEVNFMIEPVAPHEEFIDGVATRDVTMSTTTNDNFIHRARLYLPEKTPTENEKLPILIHFHGGGFCITEPDCFMYYKVYTRFVKSTRSICVSPFLRRAPEHRLPAAIEDGFATLRWLQSVAKGDAHDPWLEKHGDFNRVFLIGDSSGGNLVHEVSARASSTDLRPVRLAGAIPIHPGYVRSERSRSENEMPQSPFLTLDMLDKFLSLSLPIGSNKDHPITCPMGEAAPPLAGFKLPPFLLCVAEKDLLRDPQMEYYEAMKKDNKEVDLFVSKNMTHSFYLNKIAVDMDPTVSAELNALMARVKDFIEKH

SEQ ID NO: 31853 - protein, 298 aa, Secale cereale
MAARRPSPPPASPPPPRPRSTTTTRTTSSASAAPAAAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDEFIGKKAAYALSQNLKVMACIGELLEEREAGKTFDVCFKQMKAFADNITDWTNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 31854 - protein, 446 aa, Lactobacillus rhamnosus
MARKAITADEIRQTVKDENVLFLRLMFTDINGIIKNVEVPISQLEKVLNNKIAFDGSSIDGFVRIEESDMLLYPDLNTWLLFPWENDHGKIARLICSVHRPDGTPFGGDPRNNLIRVVNEMKDAGFTAFNIGPEPEFFLFKLDEDGNPTTHLNDRGSYFDFAPLDMGENCRRDIVLELEKMGFEVEASHHEVAPGQHEIDFKYADALEAADNIQTFKLVVKTIARKHGLYATFMPKPLHGINGSGMHINMSLFHDKGNAFFDPDTGDQLSETAMHFLAGVLRHAYALTAINNPTVNSYKRLVPGFEAPVYVAWSGKNRSPLIRVPQSRGLSTRLELRSVDPTANPYLAIAAILQAGLDGVKNQLKPEEAVDRNIYRMQDDERKANHIQDLPSTLHNALKALAADDVVKAALGKHLYQSFMDSKNLEWSAYRQQVSEWERQQYLELY

SEQ ID NO: 31855 - protein, 315 aa, Hyoscyamus niger
MEVTNQSNGCSNNEKESPYISSVLPGWFSEISPLWPGEAHSLKVEKILFQGKSDYQNVMVFQSSTYGKVLVLDGVIQLTERDECAYQEMITHLPLCSIPNPKKVLVIGGGDGGVLREVSRHSSVEQIDICEIDKMVVEVAKEFFPDVAVGYEDPRVNLHIGDGVAFLKNVPAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDDESGPKTIAPLKFYNSEIHQASFCLPSFAKRVIESKGK

SEQ ID NO: 31856 - protein, 308 aa, Hyoscyamus niger
MEEQGNNESAYISSILPGWFSEISPLWPGEAHSLKVEKILFQGKSDYQNVVVFQSSTYGKVLVLDGVIQLTERDECAYQEMITHLPLCSIPNPKKVLVIGGGDGGVLREVSRHSSVEQIDICEIDKMVIDVSKQFFPNVAIGYEDPRVKLHVGDGVAFLKNVPEGTYDAVIVDSSDPIGPAQELFEKPFFESVARALCPGGVVCTQAESIWLHMHIIEDIVSNCRQIFKGSVNYAWTTVPTYPSGVIGFMLCSTEGPAVDFKNPINPIDADDSHTKTRGPLKFYNSEIHSASFCLPSFAKRVIESNAK

SEQ ID NO: 31857 - protein, 316 aa, Coffea arabica
MADAVNSNSKEEAAQLPDGVSSVIPGWFSEISPMWPGEAHSLKVEKILFQGKSDYQNVMVFQSSTYGKVLVLDGVIQLTERDECAYQEMIAHLPLCSIPSPKKVLVIGGGDGGVLREVARHLSVEQIDICEIDKMVVDVSKQFFPDVAVGFEDPRVVLHIGDGVAFLKAVPEGTYDAIIVDSSDPIGPAQELFEKPFFESVAKALRPGGVVCTQAESIWLHMHIIEDIVANCRQIFKGSVNYAWTTVPTYPSGVIGFMLCSTEGPPVDFKHPINPIDANDGRSKTMKPLKFYNSEIHSAAFCLPSFAKKVIDSKAN

SEQ ID NO: 31858 - protein, 314 aa, Nicotiana sylvestris
MEAANHNNNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFESIARALRPGGVVSTQAESIWLHMHIIEEIVANCRQIFKGSVNYAWTTVPTYPSGMIGFMLCSTEGPAVDFKNPINPIDDDASHNKTLGPMKFYNSELHKASFCLPSFAKRVIESKGK

SEQ ID NO: 31859 - protein, 157 aa, Streptococcus pneumoniae
ALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 31860 - protein, 369 aa, Penicillium griseoroseum
MRTSFVTMLALGAAAVSGAPASAPVTDLVERGSSSCTFTSAAAAKAGKSSCSTIVLDNIKVPAGETLDLSKLKSGTKVIFKGETTLGYKEWTGPLIRFSGDNINVSGASGHVVNGGGPSWWDGKGTNGGKKKPKFFYAHGLDNSNISGLNVKNTPVQGFSVQADHLVLDHITIDNSEGDSKGGHHTDAFDVGSSTYITISNANIKNQDDCLAINSGEHITFTGGTCSGGHGISIGSVGVRDNNIVKDVTISDSSVVNSDNGVRVKTIYKATGAVSDVTFSNIKLSNIAKYGIVIEQDYQNGSPTGKPTTGVPITGLKVEKVTGTVKSSGTDVYILCGNGSCKNWTWTGNSVTGGKKSSKCSGVPSGASC

SEQ ID NO: 31861 - protein, 123 aa, Streptomyces coelicolor A3(2)
MSIDKPEVDFPGGEPPADLEIKDIWEGDGPVAEAGQTVTVHYVGVTFSTGEEFDASWNRGAPFRFPLGGGRVIKGWDQGVQGMKVGGRRQLTIPAHLAYGDQSPAPAIPPGSTLIFVVDLLGV

SEQ ID NO: 31862 - protein, 341 aa, Williopsis saturnus
SGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 31863 - protein, 202 aa, Mycobacterium bovis
MHVTQSSSAITPGQTAELYPGDIKSVLLTAEQIQARIAELGEQIGNDYRELSATTGQDLLLITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPNDFVVGYGLDYDERYRDLSYIGTLDPRVYQ

SEQ ID NO: 31864 - protein, 165 aa, Ralstonia solanacearum
MMIPVTDLCDAHEDQLASGAVRVLAPVFRSFGARAAFAGPAATLKVFEDNGLVRAMLEQPGEGRVLVVDGGGSLRCALVGGNLAKLAEDNGWEGVLVNGCVRDTRELAACNVGVHALAAHPRKSFKKNQGERDIGVQMPGAYIHPGEWIYGDEDGVLVSRERLHD

SEQ ID NO: 31865 - protein, 358 aa, Aspergillus oryzae
MGAPPKTAQNLSFVLEGIHKVKFEDRPIPQLRDAHDVLVDVRFTGICGSDVHYWEHGSIGQFVVKDPMVLGHESSGVISKVGSAVTTLKVGDHVAMEPGIPCRRCEPCKEGKYNLCEKMAFAATPPYDGTLAKYYVLPEDFCYKLPENINLQEAAVMEPLSVAVHIVKQANVAPGQSVVVFGAGPVGLLCCAVARAFGSPKVIAVDIQKGRLEFAKKYAATAIFEPSKVSALENAERIVNENDLGRGADIVIDASGAEPSVHTGIHVLRPGGTYVQGGMGRNEITFPIMAACTKELNVRGSFRYGSGDYKLAVNLVASGKVSVKELITGVVSFEDAEQAFHEVKAGKGIKTLIAGVDV

SEQ ID NO: 31866 - protein, 501 aa, Sphingomonas chungbukensis
MATQLKSTENDYGIKSEYGHYIGGEWIAGDSGKTIDLLNPSTGKVLTKIQAGNAKDIERAIAAAKAAFPKWSQSLPGERQEILIEIARRLKARQSHYATLETLNNGKPMRESMFFDMTQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVESYLQLATEEGAEVLTGGTRADAANLAGGNFIKPTVFTNVKNTMRIAQEEIFRPVTTVISWNDQTHMMQQANATTYGLAGGVWTKDLARAHRIARQLETGTVWINRYYNLKANMPLGGYKQNGFGREFSHEVLNHYTQTKSVVVNLQEGRVGMFDQ

SEQ ID NO: 31867 - protein, 493 aa, Schizosaccharomyces pombe
MAPQFKRPELFGFDKSHAQSFVQGKWISSPNNKTFEVDNPATGEIIGKVADVSVEETKKAISAANEAFKTYKNFTHVQRSQLLERWAELIMENKDDLVKMLTLENGKPLSQAEMEVTTCSGYLKWYAAEAVRTFGDVAPSSLQSQNFLISIKQPVGVSALITPWNFPAAMIARKGGAALAAGCTAIFLPAFRTPYVCLGLVRLAQEAGFPDGVLNVITSSDASAHGKELTTNPIVRKVSFTGSTNVGKILMGQSASTIKKVSMELGGNAPFIVFPDFPIDQAVESFCTIKFNSCGQVCVCPNRVYVHKNVYDEFVSKLTEKVKTIKVGDGFDSSSAVGPLISQDGCKKVSKHIEDAVSKGAKITVGGKEISSSKGYFFEPTVLSGVTQDMLVASEETFGPLASVFKFDDTEEVIEWANDSDVGLAGYVFTNNLSTMIHVAKELEVGLVGANIEMVDEPFISFGGIKQSGFGKEAGRLGVQEFMVVKEINLKTL

SEQ ID NO: 31868 - protein, 214 aa, Paeonia sinjiangensis
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAVEGARIAGASRIIGVDLNPKRFEEAKKFGVTEFVNPKDYNKHVQEVIAEMTDGGVDRSVECTGSIMAIISAFECVHD

SEQ ID NO: 31869 - protein, 214 aa, Paeonia sinjiangensis
IAESVGEGVTDLKPGDHVLPVFTGECKECRHCKSEESNMCDLLRINTDRGVMLNDGTSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 31870 - protein, 214 aa, Paeonia parnassica
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 31871 - protein, 214 aa, Paeonia arietina
IVESVGEGVTDLKPGDHVLPVFAGECKVCRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 31872 - protein, 214 aa, Paeonia humilis
IVESVGEGVTDLKPGDHVLPVFTGECKVCRHCKSEESNMCDLLRINTDRGVMLNDGKSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 31873 - protein, 214 aa, Paeonia officinalis
IVESVGEGVTDLKPGDHVLPVFTGECKVCRHCKSEESNMCDLLRINTDRGVMLNDGRSRFSINGQPIFHFVGTSTFSEYTVVHVGCVAKINPEAPLDKVCVLSCGISTGLGATLNVAKPKKGSSIAIFGLGAVGLAAAEGARIAGASRIIGVDLNPKRFEEAKKFGVTEFVNPKDYNKPVQEVIAEMTDGGVDRSVECTGSIMAMISAFECVHD

SEQ ID NO: 31874 - protein, 454 aa, Klebsiella pneumoniae
MSRELYPKQFLRLYGQNSMLQETITRLSGLEIHEPMVICNEEHRFLVAEQLRQLNKLSNNIILEPVGRNTAPAIALAALQATRHGDDPLMLVLAADHIINNQPVFHDAIRVAEQYADEGHLVTFGIVPNAPETGYGYIQRGVALTDSAHTPYQVARFVEKPDRERAEAYLASGEYYWNSGMFMFRAKKYLSELAKFRPDILEACQAAVNAADNGSDFISIPHDIFCECPDESVDYAVMEKTADAVVVGLDADWSDVGSWSALWEVSPKDEQGNVLSGDAWVHNSENCYINSDEKLVAAIGVENLVIVSTKDAVLVMNRERSQDVKKAVEFLKQNQRSEYKRHREIYRPWGRCDVVVQTPRFNVNRITVKPGGAFSMQMHHHRAEHWVILAGTGQVTVNGKQFLLTENQSTFIPIGAEHSLENPGRIPLEVLEIQSGSYLGEDDIIRIKDQYGRC

SEQ ID NO: 31875 - protein, 422 aa, Xenorhabdus nematophila
MRPSDIEFDLRHIWHPYTSMIRPFPAYPVVSATGVELVLSDGRKLIDGMSSWWAAIHGYNHPVLNEAAKSQIDKMSHVMFGGITHPPAVELCKQLVALTPDSLECVFLADSGSVAVEVALKMALQYWQARGEKRQRFLTLRHGYHGDTFGAMSVCDPDNSMHSLYNGYLPNHLFADAPTCQFDDEWQPEDIDSFKRLLRQYHAEITAVVLEPIVQGAGGMRIYHPEYLRQVRQLCDEHQILLIADEIATGFGRTGKLFACEHAQIEPDILCLGKALTGGYMTLSATLTTRHVAEIISQGEAGCFMHGPTFMGNPLACAVASASLKLLSESSWQQHIQSIETQLKTELLPLKIHHSVKDVRVLGAIGVVEMKQPVDVASLQRHFVQQGVWIRPFGRLIYLMPPYIIQSEQLSQLTTAIVDAIN

SEQ ID NO: 31876 - protein, 386 aa, Escherichia coli
  misc_feature (198)..(198): Xaa can be any naturally occurring amino acid
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTXYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 31877 - protein, 144 aa, Lycopersicon pimpinellifolium
KNFGVTEFINPKEHEQPIQQVIVDLTDGGVDYSFECIGNVSVMRSALECCHKGWGTSVIVGVAASGQEISTRPFQLVTGRVWKGTAFGGFKSRSQVPSLVDKYLKKEIKVDEYITHNMTLADINKAFDLMHDGDCLRVVLDMFV

SEQ ID NO: 31878 - protein, 375 aa, Aquifex aeolicus
MKKVKLIGTLDYGKYRYPKNHPLKIPRVSLLLRFKDAMNLIDEKELIKSRPATKEELLLFHTEDYINTLMEAERCQCVPKGAREKYNIGGYENPVSYAMFTGSSLATGSTVQAIEEFLKGNVAFNPAGGMHHAFKSRANGFCYINNPAVGIEYLRKKGFKRILYIDLDAHHCDGVQEAFYDTDQVFVLSLHQSPEYAFPFEKGFLEEIGEGKGKGYNLNIPLPKGLNDNEFLFALEKSLEIVKEVFEPEVYLLQLGTDPLLEDYLSKFNLSNVAFLKAFNIVREVFGEGVYLGGGGYHPYALARAWTLIWCELSGREVPEKLNNKAKELLKSIDFEEFDDEVDRSYMLETLKDPWRGGEVRKEVKDTLEKAKASS

SEQ ID NO: 31879 - protein, 375 aa, Aquifex aeolicus
MKKVKLIGTLDYGKYRYPKNHPLKIPRVSLLLRFKDAMNLIDEKELIKSRPATKEELLLFHTEDYINTLMEAERSQSVPKGAREKYNIGGYENPVSYAMFTGSSLATGSTVQAIEEFLKGNVAFNPAGGMHHAFKSRANGFCYINNPAVGIEYLRKKGFKRILYIDLDAHHCDGVQEAFYDTDQVFVLSLHQSPEYAFPFEKGFLEEIGEGKGKGYNLNIPLPKGLNDNEFLFALEKSLEIVKEVFEPEVYLLQLGTDPLLEDYLSKFNLSNVAFLKAFNIVREVFGEGVYLGGGGYHPYALARAWTLIWCELSGREVPEKLNNKAKELLKSIDFEEFDDEVDRSYMLETLKDPWRGGEVRKEVKDTLEKAKASS

SEQ ID NO: 31880 - protein, 225 aa, Schizosaccharomyces pombe
MLKQAGNQSFRPFISFAQKSLFNRQITGNHWIFARFKFYPLNKIVNYNHFHSSSCQSEAKNFYKQFEGDISDPPPKGPFDIDLGALKSSYLRKMKTLHPDVAQGKDAALAQRDSAELSKAYNTLKAPLTRAEYILQLQGINPVSEDISNSDPEFLMEIMDVHENISASRDSPEKLLQLSQENQGRKVQEINEIRKAMESSNWDSALLYVNRLRYWNTIDKILHDL

SEQ ID NO: 31881 - protein, 492 aa, Delftia tsuruhatensis
MSGKFIEKHGIWSDTQKAAAADVLNKIEKAGLQMVRLSWPDQYGLLRGKMLSVAALRSAFASGSEITMAPFFFDTASAIVFNPFSADGGLGSAELAGSPNVVMVPDPTTFRILPWADRTGWMLADLYMTSGRPFALSPRAILKKALAEMQDLGYDYQAGLEVEWYLTRIVDPCLEPETLGGPGTPAAPPKVMPVAKGYSYLLENHLDEVEPIMAEVRQHLLALGMPLRSIEDEWAPSQMETTFDVMPGLDVADTMVLFRNAVKQVCRRRGYLASFMCKPAIQGFLASGWHLHQSLTARDSGANAFIPQPGEALSALGRSYVGGLLEHACAASSFTTPTINGYRRRRPYSLAPDRVTWAKDNRAAMARVISAPGDPASRVENRIGEPAANPYLYLASQVFSGIDGIRRQLDPGPLQETPYAADVTILPHNLSEALEVLETSKFFREAFGEEFIRYWMHLRRSEWKRFVDAEGQVDFSGDPVTNWEHREYFELF

SEQ ID NO: 31882 - protein, 486 aa, Delftia tsuruhatensis
MKEFLNFINGEYVRNASGKTFQDINPVNGSVIGNIYEAGQAEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNQVGMPKGVYNVVHGFGPGSAGEFLTQHPGVNGITFTGETRTGTAIMKAAADGVRPVSLEMGGKNAAVVFADCDFQVTIDTLTRSCFENAGQVCLGTERVYVERPIFEKVVAALKERAEAMKPGLPFDHDTKIGPLISKKHQAKVLGLYKTAKDEGATIVTGGGVPDMPDALKDGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 31883 - protein, 372 aa, Prunus subhirtella
MPARLSDAFKSHPLNLQLKHPDFSSLQELPDSYAWSQNDDQYPSSPGSFGAEQDSVPVIDLSDPNALKLTGHACRTWGVFQVTNHGIPSKLLDDIESAGRSLFSLPVQQKLKAARSPDGISGYGFARISSFFQKLMWSEGFTIVGSPLDHFRQLWPQDYNKFCNIIEEYEKVMKRLAGRLMWLMLGSLGISMEDVKWAGPKGDFRDASAALQLNSYPACPDPDRAMGLAAHTDSTLLTILYQNNTSGLQVLREGTGWVTVPPLPGALVVNVGDLIHILSNGLYPSVLHRAVVNRSRHRLSIAYLYGPPASVQISPLSKLLGPSQPPLYRPITWNEYLGTKAKHFNKALSSVRLCAPLNALVDVSDHNSVKVG

SEQ ID NO: 31884 - protein, 388 aa, Mesembryanthemum crystallinum
MAEMNKQPSVIQKAAGQFHLSSGLSQITQPRLGGSQGPALHQRRFAYGNYSNAAFQYPTSSTTQDLSFVNTMASPVVAHAPAEKNFKTFAIDFMMGGVSAAVSKTAAAPIERVKLLIQNQDEMLRSGRLSEPYKGIGDCFKRTTADEGMIALWRGNTANVIRYFPTQALNFAFKDYFKRMFNFKKDESYWKWFAGNLASGGAAGASSLVFVYSLDYARTRLANDAKAAKKGGERQFNGLIDVYKKTFASDGIAGLYRGFNISCVGIIVYRGLYFGMYDSLKPVLLTGKLQDSFFASFGLGWLITNGAGLASYPIDTVRRRMMMTSGEAVKYKGSFDCFAQILKNEGAKSLFKGAGANILRAVAGAGVLAGYDKLQVILLGKKFGSGGA

SEQ ID NO: 31885 - protein, 267 aa, Antirrhinum majus
YFWEAKGQTPLFPRIFGHEAGGIVETVGEGVTELQPGDHVLPIFTGECKECRHCKSSESNMCDLLRINTDRGVMIGDGKTRFFKNGQPIYHFLGTSTFSEYTVLHVGCVAKINPEAPLGKVCVLSCGISTGLGATLNVAKPTKGSTVAIFGLGAVGLAAAEGARMAGASRIIGIDLNPSRFNEAKKFGITECVNPKDHNKPIQEVLAEMTDGGVDRSVECTGNVNAMISAFECVHDGWGVAVLVGVPNKDDAFKTHPVNLLNGRTLK

SEQ ID NO: 31886 - protein, 236 aa, Sophora flavescens
YFWEAKGQTPLFPRIFGHEAGGIVESVGEGVTHLQPGDHALPVFTGECGECLHCKSEESNMCDLLRINTDRGVMINGGQSRFSIKGQPIYHFVGTSTFSEYTVVHAGCVAKINPAAPLDKVCILSCGICTGLGATINVAKPKPGSSVAIFGLGAVGLAAAEGPRISGATRIIGVDLVSSRFELAKKFGVNEFVNPKDHNKPVQEVIAEMTNGGVDRAVECTGSIQAMISAFECVHD

SEQ ID NO: 31887 - protein, 236 aa, Sophora flavescens
TSGKLRGKLLYFPRIFGHEAAGIVESVGEGVSNVQVGDHVLPVFTGECGECAHCKSEESNMCALLRIDTIRGVMHSDGKCRFSINGTPINHFVGTSTFSEYTVVHSGCLAKINPQAPMDKVCILSCGISTGLGAALNVAKPKKGSTVAIFGLGAVGLAAAEGARIAGASRIIGVNLNPKRFELAKNFGVTEFVNPKDHDRPVQEVIADMTNGGVDRSIECTGNINFMISAFECVHD

SEQ ID NO: 31888 - protein, 236 aa, Wisteria floribunda
TSGKLRGILLCFPGIFGHEASGIVESVGEGVTDLQVGDHVLPVFTGECGECAHCKSEESNMCDLLRIDTDRGVMHSDGKSRFSINGTPINHFVGTSTFSEYTVVHSGCLTKINPQAPLDKVCILSCGISTGLGATLNVAKPKKGSTVAIFGLGAVGLAAAEGARIAGASRIIGVDLNPNRFEEAKKFGVTEFVNPKDYDKPVQEVIAGMTNGGVDRSIECTGNINAMISAFECVHD

SEQ ID NO: 31889 - protein, 235 aa, Wisteria floribunda
PRIFGHEASGIVESVGEGVTSLKPGDHALPIFTGECGERAHCKSNESNLCDLLRINTERGVMLADGKTRFSKDGKPIYHLVGTSTFSEYTVLHVGCVAKINPAAPLDKVCVVSCGFCTGHGATVNVAKPKPNSTFAVFGLGAVGLAAAEGARLSGASRIIGVDLVPGRFEQAKKFGVTDFVNPKDHNKPVQEVIIEMTDGGVDRAVECTGHIEASIQAFECVHDGWGVAVLVGVP

SEQ ID NO: 31890 - protein, 236 aa, Trillium camtschatcense
PRIFGHEAAGIVESVGEGVTDLQVGVHVLPMFMGECRECAHCKSEESNVCDLLRVNNDRGVMLSDGTTRFSIKGKTIYHFLGASTFSEYTVVHVGCLAKINPSAPLDKVCVLSCGISTGLGATLNVAKPKKGMTVAIFGLGAVGLGAAEGARLAGASRIIGVDNQWHAGLREPSKFGITEFVNPKDHGKPVQQVIAEMTNGGVDRSVECTGNVDAMISAFECVHDGWGVAVLVGVP

SEQ ID NO: 31891 - protein, 441 aa, Streptomyces coelicolor A3(2)
MNAEELGLPRSRQANERLHALVPGGAHTYAKGDDQYPENLAPVISHGRGAHVWDVDGNRYVEYGSGLRSVSLGHAHPRVTEAVRRELDRGSNFVRPSIVEVDAAERFLATVPTAEMVKFAKNGSDATTAAVRLARAATGRPRVAVCADHPFFSVDDWFIGTTPMSAGIPAATNELTVAFPYGDLAATEDLLARHEGEVACLILEPATHTEPPPGYLAGLRELADRHGCVLVFDEMITGFRWSEAGAQGLYGVVPDLSTFGKALGNGFAVAALAGRRELMELGGLRHSGDRVFLLSTTHGAETHALAAAMAVQGTYVEEGVTARLHALGDRLAAGVREAAASMGVGDHVVVRGRASNLVFATLDENGQPSQRYRTLFLRQLLAGGVLAPSFVVSSALGDADLDHTVDVVAEACAVYRKALDAADPTPWMAGRPVKPVFRRLV

SEQ ID NO: 31892 - protein, 136 aa, Schizosaccharomyces pombe
MTAYAAIIGTKDNPVYELEMGPINEKLDRSLNSHLNQFIVHSSLDIVDQLQWTSNAFYMKTIDQFHEMYISAYVTPSNMRFMLLHQNQSADNIKLFFQELHELYIKTLMSPFYQPNQPIRSQAFDLKVRSIARRYL

SEQ ID NO: 31893 - protein, 353 aa, Thermotoga naphthophila
MRHKIRLIDFILLRFIEERMKVARDVAKEKKKTDSPIDIRDIEEQKIKEILDRTDLNPVRMRRIFEEIMKLAKEEEYRLLGISKTVAVLGPMGSFSDEMAMKLIGSRIPLKYCSTTDEIIEMVEKGEVDYGIVPIENSTYGTVIPVLDALLNHEVEVFGEAKLEIHHCLVSKKKLDLKEIKRIYSHPQAISQSLGFINTYLSHAEIRYTSSTSDAVNLLDDESAAIMSENAARMYGLLILRRSIQDLKEKNITRFYIIRRKTGKMEGRYTSLFFGVQDRPGSLKAVLDIFANRGINLRKLESRPARTFLGDYVFFVEVEAPLKEEDIRDLEKVTAFYKIIGVFDEVEELDVFK

SEQ ID NO: 31894 - protein, 368 aa, Thermotoga petrophila
MTVLIVEDDDITREAMGQYLKLSGIDVIEAENGEKAVELSKDVDVALVDVMLPGMSGIEVVNKIKAKNPSCVVFVVTAYDDTGIIKKCVEVGTDDFIKKPVNLELLRLKITHALRNRVFHLYRNSYLKSLKKKLFLLEKTAEEFFTEYEDFLFEVLEILNMLSEYRDMETHRHTERVGWLSGRIAEEMGMSEVFVTEIQFAAPLHDIGKIGIPDRILLKPGILTPEEFEIMKQHTTIGFKILSRSNSPILQLGAEIALTHHERWDGSGYPRGLKGREIPISGLIVAVADSFDAMVSKRPYKNPKPLEEAFREIESLSGKLYSPEVVEAFLKLEKEITDVYRREKDEDTSNNGRRSHQSSSGEGVEGIR

SEQ ID NO: 31895 - protein, 369 aa, Thermotoga sp. RQ7
MTVLVVEDDEITREAVSQYLRLSGFNVLEAESGEKALDLSRKVDVALVDVKLPGMSGIELVSEIKSRNPSCVVFVVTAYDNTETVKKSVEAGADDFIKKPVNLELLKLKITHALRNRVFHLYRNSYLKSLKKKLSLLEKTAEEFFTEYEDFLFEVLDILNMLSEYRDAETHKHTERVGWLSGRIAEEMGMDEAFVTEIQFAAPLHDIGKIGIPDRILLKPGILTPEEFEIMKQHTTIGFRILSRSSSPILQLGAEIALTHHERWNGSGYPKGLKGKEIPLSGLIVAVADSFDAMVSRRPYKKPKTLEEAFQEIEELSGKLYSPEVVKAFLKLEREIMDVYRREEDEDSSNDSRSSHKSSPGEGLEGIRE

SEQ ID NO: 31896 - protein, 370 aa, Thermotoga sp. SG1
MMTVLVVEDDKITREAVSQYLRLSGFNVLEAENGEKALDFSRRIDVALVDVKLPGMSGIELVSEIKSRNPSCVVFVVTAYDDTETVKKSVESGADDFIKKPVNLELLKLKITHALRNRVFHLYRNSYLKSLKKKIFLLEKTAEEFFTEYEDFLFEVLDILNMLSEYRDAETYKHTERVGWLSGRIAEEMGMDEAFVTEIQFAAPLHDIGKIGIPDRILLKPGILTPEEFEIMKQHTTIGFRILSRSSSPILQLGAEIALTHHERWNGSGYPKGLKGKEIPASGLIVAVADSFDAMVSRRPYKKPKTLEEAFREIEDLSGKFYSPEVVKAFLKLEREIIDVYRREEDENSTHGGRSSHKSTPGESMEGLRE

SEQ ID NO: 31897 - protein, 372 aa, Thermotoga sp. KOL6
MKEMSILIVEDDDITREAMAQYLKLSGFEVLETNSGEKAIDFSNMIDVALIDVKLPGMSGIEVVSEIKSRNPSCVVFVITAYDDKETIKKCVEAGADDFIKKPVNLELLKLKITHAIRNKIFHLYRSSYMKSLKERLEIIEKTAEEFFTEYEDFMFEILDILNMLSEYRDVETYRHTERVGWLSGRIAEVMGLDELLVTEIQFSAPLHDIGKIGIPDKVLLKPGILTPEEFEIMKQHTIIGFRILSRSSSPILQMGAEISLTHHERWNGSGYPRGLKRKEIPISGLIVAVADSFDAMVTERPYKRAKTLDEAFQEIELLSGKLYSPEVVEAFLSLEKEIREVYRREKDENSSHQSGGSHKSSSGEGLEGLRE

SEQ ID NO: 31898 - protein, 353 aa, Thermotoga sp. RQ2
MRHKIRLIDFILLRFIEERMKVARDVAREKKKTDSPIDIRDIEEQKIKEILDRTDLNPVRMRRIFEEIMKLAKEEEYRLLGISRTVAVLGPMGSFSDEMAMKLIGSRIPLKYCSTTDEIIEMVEKGEVDYGIVPIENSTYGTVIPVLDALLNHEVEVFGEAKLEIHHCLVSKKKLDLKEIKRIYSHPQAISQSLGFINTYLSHAEIRYTSSTSDAVNLLDDESAAIMSESAAKMYGLLILRRSIQDLKEKNITRFYIIRRKTGKMEGKYTSLFFGVQDRPGSLKAVLDIFASRGINLRKLESRPARTFLGDYVFFVEVEAPLKEEDIRDLEKVTAFYKIIGVFDEVEELDVFK

SEQ ID NO: 31899 - protein, 151 aa, Triticum turgidum subsp. durum
MAQLMDKAKGFVAEKISGVQKPEADLSDLSVQHVGRDGATLSGRLDVRNPYSHTIPICEISYSFKSAGRDVASGTMPDPGSLVASDTTGLDIPVKVPYDFLMSLVKDAGKDWDLDYEMRVGLTVDLPIVGNFTLPLTKAGELKLPTLSDLF

SEQ ID NO: 31900 - protein, 246 aa, Streptococcus pyogenes
QIAGPEGLFYSDKEELESLGAKVYMESPVQSIDYDAKTVTALVDGKNHVETYDKLIFATGSQPILPPIKGAEIKEGSLEFEATLENLQFVKLYQNSADVIAKLENKDIKRVAVVGAGYIGVELAEAFQRKGKEVVLIDVVDTCLAGYYDRDLTDLMAKNMEEHGIQLAFGETVKEVAGNGKVEKIITDKNEYDVDMVILAVGFRPNTTLGNGKIDLFRNGAFLVNKRQETSIPGVYAIGDCATIYD

SEQ ID NO: 31901 - protein, 214 aa, Ageratina adenophora
  misc_feature (29)..(29): Xaa can be any naturally occurring amino acid
TLISLKDDADADGEGVKLTDIEIKALLLXLFTAGTDTSSSTVEWAIAELIRHPRLLKQAQEEIDTVVGRDRLVTELDLNQLTFIQAIVKETFRLHPSTPLSLPRISSEACEVDGYYIPKGSTLLVNVWAIARDPEMWTDPLEFRPSRFLPGGEKPNVDVRGNDFEVIPFGAGRRICVGMTLGLRMVQLLVATLVQTFDWELAKGLEPEKLNMER

SEQ ID NO: 31902 - protein, 234 aa, Saccharomyces cerevisiae
MKADAKQITHLLKPLRLLLLGAPGSGKGTQTSRLLKQIPQLSSISSGDILRQEIKSESTLGREATTYIAQGKLLPDDLITRLITFRLSALGWLKPSAMWLLDGFPRTTAQASALDELLKQHDASLNLVVELDVPESTILERIENRYVHVPSGRVYNLQYNPPKVPGLDDITGEPLTKRLDDTAEVFKKRLEEYKKTNEPLKDYYKKSGIFGTVSGETSDIIFPKLLNLITSKFG

SEQ ID NO: 31903 - protein, 205 aa, Listeria monocytogenes
IGGILVWFGWYGFNVGSALTIDNVAMTAFVNTNTAAAAGIIGWGLVEWLTNKKPTMLGTISGAIAGLVSITPAAGFVTVPSSLIIGFFGGALCFWAVFWLKGKVKYDDALDAFGLHGIGGIWGGIATGLFATTKVNEAGADGLFYGNASLVVKQLIAIGSTVAYVAVVTALIVVIIKLFLPIRVNEEQEYKGLDLTLHGEKAYQE

SEQ ID NO: 31904 - protein, 382 aa, Hibiscus syriacus
MSSAGQVIRCKAAVAWEAGKPLSIEEVEVAPPQKDEVRIKILFTALCHTDVYYWECKGYTPLFPRILGHEASGIVESVGEGVTDVKPGDHVLPIFTGECKQCRHCLSEESNNMCDLLRINCDRGVMLADGKTRFSINGKPIYHFVGTSTFSQYTVVHVGQVAKINPTAPLDKVCPISCGICTGFGATVNVAKPKKGQTVAIFGLGAVGLAAAEGARICGASRIIAVDLNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 31905 - protein, 502 aa, Delphinium grandiflorum
MSISLFLAGAAILFFVTHLLLSPTRTRKLPPGPKGWPVVGALPMLGNMPHVALANLSRRYGPIVYLKLGSRGMVVASTPDSARAFLKTQDLNFSNRPTDAGATHIAYNSQDMVFADYGPRWKLLRKLSSLHMLGGKAIEDWAVVRRDEVGYMVKAIYESSCAGEAVHVPDMLVFAMANMLGQVILSRRVFVTKGVESNEFKEMVIELMTSAGLFNVGDFIPSIAWMDLQGIVRGMKRLHNKFDALLDKILREHTATRSERKGKPDLVDVLMDNRDNKSEQERLTDTNIKALLLNLFSAGTDTSSSTIEWALTEMIKNPSIFRRAHAEMDQVIGRNRRLEESDIPKLPYLQAVCKETFRKHPSTPLNLPRVAIEPCEVEGYHIPKGTRLSVNIWAIGRDPNVWENPLEFNPDRFLTGKMAKIDPRGNNSELIPFGAGRRICAGTRMGIVLVEYILGTLVHAFEWKLRDGEMLNMEETFGIALQKAVPLAAVVTPRLPPSAYVV

SEQ ID NO: 31906 - protein, 426 aa, Escherichia coli [sequence omitted]

SEQ ID NO: 31907 - protein, 426 aa, Escherichia coli [sequence omitted]

SEQ ID NO: 31908 - protein, 426 aa, Escherichia coli [sequence omitted]

SEQ ID NO: 31909 - protein, 489 aa, Sulfolobus solfataricus
MYSFPNSFRFGWSQAGFQSEMGTPGSEDLNTDWYKWVHDPENMAAGLVSGDLPENGPGYWGNYKTFHNNAQKMGLKIARLNSEWSRQFPNPLPRPQNFDESKQDVTEVEINENELKRLDEYANKDALNHYREIFKDLKSRGLYFIQNMYHWPLPLWLHDPIRVRRGDFTGPSGWLSTRTVYEFARFSAYTAWKFDDLVDEYSTMNEPNVVGGLGYVGVKSGFPPGYLSFELSRRAMYNIIQAHARAYDGIKSVSKKPVGIIYANSSFQPLTDKDMEAVEMAENDNRWWFFDAIIRGEITRGNEKIVRDDLKGRLDWIGVNYYTRTVVKRTGKGYVSLGGYGHGCERNSVSLAGLPTSDFGWEFFPEGLYDVLTKYWNRYHLYMYVTENGIADDADYQRPYYLVSHVYQVHRAINSGADVRGYLHWSLADNYEWASGFSMRFGLLKVDYNTKRLYWRPSSLVYREIATNGAITDEIEHLNSVPPVKPLRH

SEQ ID NO: 31910 - protein, 478 aa, Saccharomyces cerevisiae
TINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 31911 - protein, 320 aa, Lupinus cosentinii
FAHYGPQWRLRRKLSSVHMFSGKALEDFTHLRQEEVARLTSNLASSRSKAVNLGQVLNVCTTNALTRVMIGRRVFNDGNDGFDPKADEFKSMVVELMVLAGALNIGDFIPALEWLDIQGVQAKMTKLHKKFDAFLTNIVEEHKNSKIEKHQDMLSTMLSLKDGTEDGGKLTDIEIKALLLNMFAAGTDTSSSTTEWAISELIKNPNIQAKLQQELDSVVGRDRLVTEADLAHLPYLEAVVKETFRLHPSTPLSLPRIASESCEVFGYHIPKGSTLLVDVWAIARDPKEWNNPLEFKPERFLPGGEKANVDIKGNDFEVIP

SEQ ID NO: 31912 - protein, 377 aa, Aspergillus niger
MTVPIDNANGSTAVPEIPAKQKAAIYDQPGTVSTKVVEIDVPEPGTGEVLINLTHSGVCHSDLGVMTNTWRSLPYPTQPGQIGGHEGVGKIVKLGPGAESSGLKIGDRVGIKWVSSVCKTCEPCQAGADGICFKQKVSGYYTPGTFQQYALGPANYVTPIPDGLASDEAAPMLCAGVTVYAALKRSNARPGQWVVISGAGGGLGHIAVQLASKGMGFRVIGVDHGSKEELVKASGAEHFVDITKFPSDDKGQAIASHVKSLAGGLGAHAVIVCTAANAAYAQAVPFLRFNGTLVCVGIPENAPQPIATAFPGKMIAQHYTITGSAVGTQRDAIETLDFAARGIIKAHFRTEKMDALTGVFEEMSQGKLQGRVVLDLS

SEQ ID NO: 31913 - protein, 474 aa, Aspergillus niger
MAFARLAARRLPVARRLVPSIDSLPQQRFFSMSQHVKSQNKASVPNPDPAADSVSVAFVNDQSPYMLPTYVRPAPVMVKGQGCYLWDMENRKYLDLTAGIAVNSLGHCDPEVAQIIAEQAEVLVHASNLYYNAWTGALSKLLIDVTQKSGAMRDASQVFICNSGTEANEAAIKFARKVGRSLDPSGAKHEVVSFHNSFHGRTMGALSATPNPKYQTPFSPMLPGFKYGNYNDVAQLESLVTEKTCGVIVEPIQGEGGINVATPEFLVALRKRCDEVGAVLIFDEIQCGLSRTGSFWAHAHPSLAPASGEAAHPDILTSAKALGNGIPIGATIVSEKTVAKHIKPGDHGTTYGGNPLVCRVAHHIVNRLADPELQKSVEIKGDLLVSGFKDLQKKFPNVISEIRGRGLIRGLQLSPEFVSKAGDLVGAARERGMLIITAGEGCIRFVPPLTITEEQIKSGLKILEQALEAVVAQA

SEQ ID NO: 31914 - protein, 385 aa, Brassica rapa
MVAHKETVCVTGASGFIGSWLVMRLLERGYFVRATVRDPGNLKKVQHLLDLPNAKTQLTLWKADLSDEGSYDDAINGCDGVFHIATPMDFESKDPENEVIKPTVNGVLGITKACDKAKTVRRIVFTSSAGTVNVEEHQKNVYDENDWSDLDFIMSKKMTGWMYFMSKTLAEKAAWDYAKEKGIDFISIIPTLVIGPFITTSMPPSLITALSPITRNEAHYSIIRQGQYVHLDDLCNAHIFLYEQAAAKGRYVCSSHDATILTISEFLRQKYPEYNVPSTFEGVDENLKSIMFSSKKLIDMGFNFKYSLEDMLVESIETCRQKGFLPVTLPEHLKSEDKVPGSDDNKEIKNGSAGLTDGMVACKKTEPGMAGEKADSHMSAQQICA

SEQ ID NO: 31915 - protein, 362 aa, Pisum sativum
MGATTTDPIPLLTPYNMGKFKLSHRVVMAPLTRTRSYNNVPQPHAILYYSQRASQGGLLIAEATGVSDTAQGLPDTPGIWTKQQVEAWKPIVDAVHAKGAIFFCQIWHVGRVSNSSYQPNGQAPISSTDKAITSNDQQQFTAPRRLRTDEIPNIVNDFKLAARNAIEAGFDGVEIHGAHGYLLDQFMKDKVNDRTDEYGGSLENRCRFPLEVVEAVVNEIGAERVGIRLSPFAEFAESGDSNPNALGLYMVNALNKYNILYCHMVEPRIIVTFDPVETPHCLEPMRKAFNGTFMVAGGYNRQDGIKAIAENRADLVVYGRWFISNPDLPKRFALNAPLNKYNRETFYSSDPVIGYTDYPFLE

SEQ ID NO: 31916 - protein, 475 aa, Arabidopsis thaliana
MKERIRFLQVLWILWIEYWHCKAILLSKHRRRWIHKSFKLFVNRLMALQGNAPLNRFSLKCKVRCDSACVDGWIINVLDRGVLDLDLNISSESDYKLPSEVFLNKTLVRLKLGGKDEFIIDVEEVFLPKLKTLYLHGFVCFEDSGVACAKLISGCPVLEELVMINLMWGLMDVCSVSNPTLKRVTICSEIIDYNPQSVSFDTPNLVYLEFTDVVAIKYPKVNLDSLVDARLGLRLTPCQTTKARRSVKSVGQGMMGNAADFLMGISNVKILYLSFDTLEVLNFCCKTIPLFNNLTYLTIETNEDVGWESLSNILENCPNLETIIFKGLHYRDTNQCWDERYRFKDTNKCFEEDADMCMCKPWEATPICLSSSSVKILEVLKFGEVTSYKDDMDRQTEVIKFFLETMPNLEQVILYYDTPFDDDLSILSTELQMLEKVASPKCKIQVISDNISYSSTVHSSSSTSGLVFLNNTFPV

SEQ ID NO: 31917 - protein, 308 aa, Shewanella violacea
GTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 31918 - protein, 1499 aa, Candida glabrata
MSLASDKKDADVASTTTTAQDDDNLSTYHGFDHHVQDQVRQLARTLTQQSSLHQKKEHTLPEEGINPIFTNTEADDYNPRLDPTSDEFSSAEWVQNMSNISNSDPDYYKPYSLGCYWKDLVATGESADIEYQANFLNGPYKGLKTVYNTVVPSTASSKDKNFKILKSMEGAVNPGELLVVLGRPGSGCTTLLKSISSNTHGFNIAKDSTISYSGMTPNDIRKHFRGEVVYNAEADIHLPHLTVYQTLLTVARLKTPQNRLKGIDRETYARHLTEVAMATFGLSHTRNTKVGNDLVRGVSGGERKRVSIAEVSICGSKFQCWDNATRGLDSATALEFIRALKVQASISNAAATVAIYQCSQDAYDLFDKVCVLYDGYQIYLGPAGKAKRYFQKMGYVSPERQTTADFLTAVTSPSERIINQDYINRGIFVPQTPKEMWEYWRASEDHADLIKEIDSKLSDNYDANLAEIKDAHVARQSKRARPSSPYTVSYGMQIKYLLIRNFWRIKQSSGVTLFMVIGNSSMAFILGSMFYKVMKHNTTSTFYFRGAAMFFAVLFNAFSSLLEIFSLFEARPITEKHRTYSLYHPSADAFASILSEVPAKLITAVCFNIIYYFLVNFRRNGGVFFFYFLINIVAVFAMSHLFRCVGSVSKTLSAAMVPASMLLLGLSMYSGFAIPRTKILGWSKWIWYINPLAYLFESLMINEFHDRKFPCSQYIPSGSVYNNVPADSRICSSVGAIRGNDYVLGDDFLRESYSYLHKHKWRGFGIGLAYVIFFLVLYLILCEYNEGAKQKGEILVFPQNIVRRMKKERKLKNVSSDNDVEIGDVSDISDKKILADSSDESEESGANIGLSQSEAIFHWRNLCYDVQIKKETRRILNNVDGWVKPGTLTALMGASGAGKTTLLDCLAERVTMGVITGEVSVDGKQRDDSFARSIGYCQQQDLHLKTSTVRESLRFSAYLRQPADVSIEEKNQYVEDVIKILEMEQYADAVVGVPGEGLNVEQRKRLTIGVELAAKPKLLVFLDEPTSGLDSQTAWSICQLMKKLANHGQAILCTIHQPSAILMQEFDRLLFLQRGGKTVYFGDLGDGCKTMIDYFESHGSHKCPPDANPAEWMLEVVGAAPGSHANQDYHEVWRNSDEYQKVQEELEWMSNELPKKNTNNSETVHKEFATGVLYQCKLVSPRLFQQYWRSPDYLWSKFFLTIFNNIFIGFTFFKADRSLQGLQNQMLAVFMFTVIFNPLLQQYLPSFVQQRDLYEARERPSRTFSWKAFIVSQILVEIPWNILAGTVAFVIYYYAIGFYSNASVAHQLHERGALFWLFSCAFYVYIGSLALFCISFNQVAEAAANMASLMFTLSLSFCGVLVTPNGMPRFWIFMYRVSPLTYLIDGMLSTGVANVAIKCSNYELLRFSPAANLTCGEYLGPYLQTVKTGYIVDPSATDTCELCPYSHTNDFLSSVSSKYSRRWRNWGIFICYIAFNYIAGIFLYWLARVPKKSGKLAKK

SEQ ID NO: 31919 - protein, 456 aa, Botryotinia fuckeliana
MHFQLSTILSIASAAVAVASPTPQDDSWDQALARRGHPKHKSARPNVQFHPKSLDTPAPSPAARTKTCYVKSSGNGTDDSPAIMSALHECNNGGHVIFSKGVTYLIGTAMDWTFLKHIDLDIQGELLFSDDTAYWEANSFKFVFQNATSFFKLGGEDVFMYGGGTLNGNGQTWYDYYASNIYALRPVLIGIDGLKDSILSDLVLRYSPQYYNFIANSSNVVYNNINIAGGSSSKNPAKNTDGWDTYRSDNIVIQNSVINNGDDCVSFKPNSTNILVQNLFCNGSHGISVGSLGQYPGEFDIVENVYVYNTSLHNATDGARIKVWPNTASALSGDLQGGGGSGRVNNITYDTMYIDNVDYAIEVDQCYGQKNLTLCLEFPSPLTITDIIFRNFTGKTSTKYQPQIGTFACSSTSVCNNIVASGIDVLSPKGVDEAYCLNVNETGLDVTCTTGFLGFN

SEQ ID NO: 31920 - protein, 216 aa, Thermoanaerobacter ethanolicus
MENILKELKFDDRGLIPVITQDYKTNEVLMMAYIMKRPLKKSLETGKVHYFSRSRNKLWLKGETSGHFQLIKSISIDCDADTLLIKVEQVEAACHTGHYSCFYREISGNELKETSDKVFDEQKVYEAENAKILQEIYDVIVDRTIHPKEGSYTNYLFEKGLDKILKKVGEEAAEVIIGAKNRDKGEIVYEISDLIYHLLVLMVERGIKLEDIYEEA

SEQ ID NO: 31921 - protein, 279 aa, Mesembryanthemum crystallinum
MCESFKREYQLCEEIGRGRFGVVYRCYNPSSTEDSDTPLAVKSIDKRLFLDDETDRECLDKEPKILHLLSPHPNILQIHNLFDSDTHLLIVTDLCQEETLYERIISNGPFSEPDAAAIFCQLAEALAHCHRNYVAHRDIKPDNILFDSRNRLKLCDFGSAEWFGAGDREMRGVVGTPYYVAPEVLSGKDYNEKADVWSAGVILYIMLGGVPPFYGETVEETFEAVLRGNLRFPARIFRNVSTQARDLLRKMMCKDVSRRFSAEQVLRHPWVTSGGLANM

SEQ ID NO: 31922 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGFPKGMDPSQLIMEEKFGLTLQKEPPLYIVPKTRD

SEQ ID NO: 31923 - protein, 205 aa, Clostridium butyricum
MLIATGRKPNTESLNLHAAGVEVGSRGEIVIDDYLKTTNSRIYSAGDVTPGPQFVYVAAYEGGLAARNAIGGLNQKVNLEVVPGVTFTSPSIATVGLTEQQAKEKGYEVKTSVLPLDAVPRALVNRETTGVFKLVADAKTLKVLGAHVVAENAGDVIYAATLAVKFGLTVGDLRETMAPYLTMAEGLKLAVLTFDKDVSKLSCCA

SEQ ID NO: 31924 - protein, 342 aa, Nicotiana tabacum
MGVDYYKVLGVDKNATDDDLKKAYRKLAMKWHPDKNPNNKKAAEAKFKQISEAYDVLSDSQKRAVYDQYGEDGLKGGVPPPGAGGPGGGSPFFSTGEGPQSFRFNTRSADDIFAEFFGFSSPFGGAGGRGPRFGGMFGDDMFASFGEGGGGGGASMYQSAPRKEAPIQQNLPCNLEDLYKGTTKKMKISREVADASGKRMQVEEILTINIKPGWKKGTKITFQEKGNEQPGVIPADLVFIIDEKPHRVFSRDGNDLIVTQKISLVEALTGTTVQLTTLDGRNLTIPVNSVIQPNYEHVVPGEGMPLPKDPTKKGNLRIKFDIKFPVRLTTTQKAGIKELLGS

SEQ ID NO: 31925 - protein, 166 aa, Vitis vinifera
SRSRKEKENVSFKNHVVQWFEVLDGLLGPYWKAVGLAFNCTFLLIGSVIQLIACASNIYYINDKLDKRTWTYIFGACCATTVFIPSFHNYRIWSFLGLGMTTYTAWYLAIAALIHGQSEGVEHSAPTKLVLYFTGATNILYTFGGHAVTVEIMHAMRKPQKFKYIY

SEQ ID NO: 31926 - protein, 192 aa, Schizophyllum commune
MQTIKCVVVGDGAVGKTCLLISYTTNKFPSEYVPTVFDNYAVTVMIGEDPYTLGLFDTAGQEDYDRLRPLSYPQTDVFLVCFSVTSPASFENVKEKWFPEVRHHCPGVPCLIVGTQIDLRDDSQVIEKLARQKQRPVTSDQGERLARELGAVKYVECSALTQKGLKNVFDEAIVAALEPPVVKKKGPKCVIL

SEQ ID NO: 31927 - protein, 198 aa, Oryza sativa (japonica cultivar-group)
MENQFQDGKEEVIEAWYMDDSEEDQRLPHHREPKEFIPLSKLSELGILSWRLNADDWENDENLKKIREARGYSYMDICDVCPEKLPNYEAKLKNFFEEHLHTDEEIRYCLEGSGYFDVRDQNDQWIRVAVKKGGMIVLPAGMYHRFTLDSDNYIKAMRLFVGEPVWTPYNRPHDHLPARKEYLEKIINRGGTQAVEAR

SEQ ID NO: 31928 - protein, 430 aa, Populus alba x Populus tremula
MQLKPLSTYTITLMLFFTVIILFFSGFLEFPSITTSITSSIKDSNFPIKTAPDPFTDLFIAFKKWDSQVGCVQFREKYKNLDSFGSKGSNGSVSVQVVNGDVGCSELKMQHVSVLVKGWTWIPSNLDNMYSCRCGLSCLWTKSSVLADKPDALLFETAPPPLQRRNGDPLRVYMDLEAGRKRSGREDLFISYHAEDDVQSTYAGALFHNGRNYHVSRRKDNDTLVYWSSSRCLADRNRLAKSLLSLLPHHSFGKCLNNVGGLDMALSFYPECANDASLKPKWWDHLHCAMSHYKFVLAIENTWTESYVTEKLFYALDSGSVPIYFGAPNVLDFVPPHSIIDGNKFNSMEELASYVKDLANDPVAYAEYHAWRRCGVLGNYGKTRAASLDTLPCRLCEAVSRKGVEMLELSGILLILISFGLLSPTVMVNP

SEQ ID NO: 31929 - protein, 301 aa, Capsicum chinense
MEIPVIDFSKLEGDERSATMGLLRQACEKWGFFMIENHGIDIYLMDNVKQLVNQHYEANMKKRFYESEVSISLQKKENISNTDWESTFFVWHRPSSNIYEIQGLSKELCKAVDAYIDQLIELAENLSELMCENLGLEKSYIKEAFSRSKGPSVGTKVAIYPQCPRPDLVRGLREHTDAGGIILLLQDEQVPGLEFFKDGHWVDIPPSKNNRLFVNIGDQIEILSNGMYKSIQHRVMAEKDGNRLSIAPFYNPNGEAIISPAPKLLYPSHLRFHDYLNLYSKTKFAEKGPRFEYAKTLANGH

SEQ ID NO: 31930 - protein, 501 aa, Candida albicans
MDQQEAPIYYGRSVNKVYNQEFIIDSRFKIVKELGHGAYGIVCSAKYDNGSKKVPDSNNGNASSSANASFVAIKKITNIFSKNILCKRALRELKLLQFFRGHKNITCLYDLDIIPNPMTGEFNEIYLYEELMECDMHQIIRSGQPLSDQHYQSFIYQVLCGLNFIHSADVLHRDLKPGNLLVNADCELKICDFGLARGFSENPDENAGFMTEYVATRWYRAPEIMLSFTNYTKAIDIWSVGCILAELLGGKPLFRGKDYVDQLNQILMILGTPPESTLQRIGSHRAQNYVRSLPITRKASYEELFPDANPLALDLLERMLTLDPRERITVRDALNHKYLELWHDPKEEIECQVKFDFKSFETVDGLDEMKQLIMDEVQKFREFVRKPIEEQQRIQMQLHMQKREEQRQEEEEKELLEQQRQFPAQESMDISQTPYNNLETNIGTPQVEDDYPRPQELDEFTFSNLESSSSMNLFQDMAKPSGEEYIKLEEELGFGLDWCYV

SEQ ID NO: 31931 - protein, 166 aa, Streptomyces aureofaciens
MQGADDTIHHRIDELTGIKESARSGDEGATGRQHAKGKLTAHERIALLLDKGSFTEVEPLRRHRASGFGLEAKKPYGDGVVTGWGTVDGRTVFVYAHDFRIFGGALGEAHATKIHKIMDMAEAAGAPLVSLNDGAGARIQEGVSALAGYGGIFRRNTRASGVIPQI

SEQ ID NO: 31932 - protein, 507 aa, Isatis indigotica
MTSVNVKLLYHYVITNFFNLCFFPLTAIVAGKASRLTTNDLHYFYYSHLQHNLLTITLLFAFTAFGSVLYILTRPKPVYLVDYSCYLPPPHLKSSVSKVMDIFYQVRKADPLPNVACDDSSWLDFLRKIQERSGLGDETYGPEGLLQVPPRKTFAAAREETEQVIIGALENLFENTKVNPKEIGILVVNSSMFNPTPSLSAMVVNTFKLRSNIRSFNLGGMGCSAGVIAIDLAKDLLHVHKNTYALVVSTENITYNIYAGDNRSMMVSNCLFRVGGAAILLSNKPGDRRRSKYELVHTVRTHTGADDKSFRCVQQEDDESGKTGVSLSKDITGVAGRTVKKNIATLGPLVLPLSEKFLFFVTFMAKNLLKDKIKHYYVPDFKLAIDHFCIHAGGRAVIDVLESNLGLAPIDVEASRSTLHRFGNTSSSSIWYELAYIEAKGRMKKGNKVWQIALGSGFKCNSAVWVALRNVKASTNSPWEHCIDRYPVKIDSDSAKTSETRVQNGRS

SEQ ID NO: 31933 - protein, 506 aa, Sinapis alba
MTSVNVKLLYHYVITNLFNLCFFPLTAIVAGKASRLTIDDLHHLYYSYLQHNLITIAPLFAFTVFGSVLYIVTRPKPVYLVEYSCYLPPTHCRSSISKVMDIFYQVRKADPSRNGTCDDSSWLEFLRKIQERSGLGDETHGPEGLLQVPPLKTFAAAREETEQVIIGALENLFENTKVNPKEIGILVVNSSMFNPTPSLSAMVVNTFKLRSNVRSFNLGGMGCSAGVIAIDLAKDLLHVHKNTYALVVSTENITYNIYAGDNKSMMVSNCLFRVGGAAILLSNKPRDRRRSKYELVHTVRTHTGADDKSFRCVQQGDDESGKTGVSLSKDITDVAGRTVKKNIATLGPLILPLSEKLLFFVTFIAKKLFKDKVKHYYVPDFKLAIDHFCIHAGGRAVIDVLEKNLALAPIDVEASRSTLHRFGNTSSSSIWYELAYIEAKGRMKKGNKVWQIALGSGFKCNSAVWVALSNVKASTNSPWEHCIDRYPVQIDSDSAKSETRVQNGRS

SEQ ID NO: 31934 - protein, 506 aa, Sinapis arvensis
MTSVNVKLLYHYVITNFFNLCFFPLTAIVAGKASRLTIDDLHHLYYSYLQHNLITIVPLFAFTVFGSVLYIATRPKPVYLVEYSCYLPPTHCRSSISKVMDTFYQVRKADPFRNGTCDDSSWLDFLKKIQERSGLGDETHGPEGLLQVPPRKTFAAAREETEQVIIGAVENLFKNTKVNPKDIGILVVNSSMFNPTPSLSAMVVNTFKLRSNVRSFNLGGMGCSAGVIAIDLAKDLLHVHKNTYALVVSTENITSSIYAGDNRSMMVSNCLFRVGGAAILLSNKPRDRRRSKYELVHTVRTHTGADDKSYRCVQQGDDENGKTGVSLSKDITDVAGRTVKKNIATLGPLILPLSEKLLFFITFMAKKLFKDKVKHYYVPDFKLAVDHFCIHAGGRVVIDVLEKNLGLAQIDVEASRSTLHRFGNTSSSSIWYELAYIEAKGRMKKGNKVWQIALGSGFKCNSAVWVALSNVKASTNSPWEHCIDRYPVKIDYDSAKSEVRVQNGRS

SEQ ID NO: 31935 - protein, 506 aa, Orychophragmus violaceus
MTSVNVKLLYHYIITNFFTLCFFPLTAIVAGKASRLTTNDLHHFYYSHLQHSLITITLLFAFTVFGSVLYIITRPKPVYLVDYSCYLPPPHQKASVSKVMDIFYHLRKADPLRNVACDDSSWLEFLRKIQERSGMGDETYVPAGLLEVPPRKTFSASREESEQVINGAIENLFKNTKVNPKEIGLLVVNSSIFNPTPSLSAMVVNTFKLRSNIRSFNLGGMGCSAGAIAIDLAKDLLHVHKNTYALVVSTENITDHIYAGDNRSMMVSNCLFRVGGAAILLSNKPRDRRRSKYELVHTVRTHTGADDKCYRCVQQGDDESGKNGVSLSKDITAVAGKAIKINISTLGPLVLPLSEKILVFVSFIGKKLLKDKIKNLYVPDFKLVIDHFCIHAGGRAVIDVLEKNLGLEPVDVEPSRSTLHRFGNTSSSSIWYELAYIEAKGRMKKGNKVWQIALGSGFKCNSAVWVALRNVKASTNSPWEHCIDRYPVNIDSDSAESVTRVQNGRS

SEQ ID NO: 31936 - protein, 403 aa, Mycobacterium chlorophenolicum
MTTPRHVAVVGGSLAGLRSAEQLRALGHTGPITVFSAERHLPYNRPPLSKEALGEFESATAEELAGRLAFRRRASIADVDIRLATPVATADLGAHRLTLDSGDEQAYDALVIATGLRPRRLVAPGPARGRHVLRTVEDCVGLRAALRPRSRAVVIGGGFIGCEVAGTLRTLGHHVTVVEPAGPPMQRVLGSDLAAAVQGHLTARGIEFVIGTGVVSFTGDDAVTGVELATGETLSADIVVEAIGSTCNVEWLYGQGLDLSDGVLTDNRLAVAGVADTVAVGDLARFPNPLFDDVPRRVEHWSIPGDTANRAAATLVGPHDNDAPFAPVPAFWSNQLDLRLQSYGSPALADAVHLEEGSVDDLTGGVILTYHRDHRHVGTVAANLSPARLRELRSAFTAVQLPA

SEQ ID NO: 31937 - protein, 382 aa, Solanum pinnatisectum
MASEAHPVVDAHSFPKTPTVCVTGAAGFIGSWLVMRLLERGYNVHATVRDPENQKKVKHLLELPKADTNLTLWKADLAVEGSFDEAIQGCQGVFHVATPMDFESKDPENEVIKPTVRGMLSIIESCAKANTVKRLVFTSSAGTLDVQEDQKLFYDETSWSDLDFIYAKKMTGWMYFVSKILAEKAAMEEAKKNNIDFISIIPPLVVGPFITPTFPPSLITALSLITGNEAHYGIIKQGQYVHLDDLCEAHIFLYEYPKAEGRFICSSHHAIIYDVAKIVRQKWPEYYVPTEFKGIDKDLPIVFFSSKKLMDMGFQFKYTLEDMYKGAIETCRQKQLLPFSTRSTADNGKDKEAIPISTENYSSGKENAPVANCTGKFTNGEI

SEQ ID NO: 31938 - protein, 159 aa, Haemophilus quentini
MFRAAIKAGTQLGKQAKALMDEGKLVPDELTVALVKDRIAQPDCANGFLLDGFPRTIPQADALKDSGVKIDFVLEFDVPDEVIVERMSGRRVHQASGRSYHIVYNPPKVEGKDDVTGEDLIIRADDKPETVLDRLAVYHKQTSPLIDYYQAEAKAGNTQ

SEQ ID NO: 31939 - protein, 156 aa, Haemophilus quentini
NRSNTPVLVDGKDVMPEVNAVLTKMKDFCQRIISGEWKGYTGKAITDVVNIGIGGSDLGPYMVTEALRPYKNHLNMHFVSNVDSTHIAETLKKINPETTLFLVASKTFTTQETMTNAQSARDWLLKAAKDESAVAKHFAALSTNAKDVEKFGIDTN

SEQ ID NO: 31940 - protein, 126 aa, Phaseolus vulgaris
CAGKDLIWADYGPHYVKVRKVCTLELFTPKRLEALRPIREDEVTAMVESIFHHCTSTENLGKGILVRKFLGEVAFNNITRLAFGKRFVNSEDVIDEQGVEFKGVVENGLKLGASLAMAEHIPSPRI

SEQ ID NO: 31941 - protein, 116 aa, Brassica oleracea var. alboglabra
PQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAVVDLYRTKYKFQKGKIGPVMIT

SEQ ID NO: 31942 - protein, 1384 aa, Trichoderma atroviride
MKPEITAINDRDKASGFQARELGVTFQNLTVEAISADAAIHENVVSQFNIPKLIKESRQKPPLKKILDNAHGCVKPGEMLLVLGRPGSGCTTLLNMLANRRNGYAQISGDVSFGSMKAEEAKRYRGQIIMNTEEEIFFPSLTVGQTMDFATRLKVPYNLPNGMTSQEEIRLETRKFLLKSMGIEHTEDTKVGDAFVRGVSGGERKRVSIIECLASKGSVFCWDNSTRGLDASTALEWAKAVRAMTDVLGLASIVTLYQAGNGIYNLFDKVLVLDEGKEIYYGPMREARPFMENLGFICDDGANVADFLTGVTVPTERKVRDEMKLKFPRTAGAIRSEYEQTAVHDQAITEYNYPTTEEAQTKTKLFQEGIAHEKDKGLPASSSFTVSFWTQVRTCIKRQYQIIWGDKATFFIKQFSTIVQALIAGSLFYNAPDTTGGLFVKSGACFFALLFNALLSMSEVTESFKGRPVLIKHKSFAYFHPAAFCIAQIAADIPVILVQVSAFSLILYFMVGLTMSAGHFFTFWIIVVATTFCMTALFRAIGAAFSTFDGASKVSGLIISATIMYNGYMIQKPRMHPWFVWLFWIDPMAYGFDAILSNEFHGKIIPCVGPNIVPNGPGFTDSGAQACAGVGGAVPGQTFVDGDLYLASLSYSHSHVWRNFGIIWAWWALFVAITIYFTTKWKLSSENGPSLLIPREQSKLVNAVRQVDEEGQVSSESGHVSEKDDATVNAQSDNNSTDDTAAQGNLIRNSSVFTWKNLCYTVKTPSGDRLLLDNVQGWVKPGNLTALMGSSGAGKTTLLDVLAQRKTEGTIRGSIQVDGRPLPVSFQRSAGYCEQLDVHEAYATVREALEFSALLRQSRDTPREEKLAYVNTIIDLLELHDIADTLIGEVGAGLSVEQRKRVTIGVELVSKPSILIFLDEPTSGLDGQSAYHTVRFLRKLAAVGQAVLVTIHQPSAQLFAQFDTLLLLAKGGKTVYFGEIGDQAKVVKEYFARYDAACPTEVNPAEHMIDVVSGQLSQGKDWNDVWLASPEYANMTTELDRIIDEAASKPPGTVDDGNEFATTLWEQTKLVTQRMNVSLYRNADYVNNKFALHIFSALFNGFSFWMVKDSIGDLQLKLFTIFNFIFVAPGVLAQLQPLFIHRRNIFETREKKSKMYSWIAFVTALIVSEIPYLIVCAVLYFVCWYYTVGFPGDSHRAGGTFFVMLCYEFLYTGMGQFIAAYAPNEVFAVLANPVVIGTLVSFCGVLVPYAQIQEFWRYWIYYLNPFNYLMGSMLVFNLWGAEIKCSEHEFATFNPPNGTTCGDYLKDYLAAGPGAVADLINPSATANCQVCSYSKGQDYLRTLNLKEYYYGWRDAGIVVLMVFSSYALVYLLMKLRTKMSKKAE

SEQ ID NO: 31943 - protein, 319 aa, Triticum aestivum
MAFALNASCYPSSFQSSLLPRRMAAAVMIPRRRNVLPVIRAVAVAPPALAPAKPAAVRGRTVSDTMAKLMAKGKTALIPYITAGDPDLATTAEALRLLDACGADVIELGVPCSDPYVDGPIIQASSARALAGGATMDGVLAMLKEVTPELSCPVVLFSYYRPILCRGLAEIKEAGVHGLIVPDLPYVAAHALWSEAKKNNLELVLLTTPAIPEERMKEITKASEGFIYLVSVNGVTGPRENVNLRVESLIQEIKKVTDKPVAVGFGISKPEHVKQIAGWGADGVIIGSAMVRQLGEAASPKEGLKRLEAYARSMKNALP

SEQ ID NO: 31944 - protein, 318 aa, Triticum aestivum
MAFALNASCYPSSFSSLLPWRMAAAVMIPRRRNVLPVIKAVAVAPPAPAPAKPAAVRSRPVSVTMAKLMAKGKTALIPYITAGDPDLATTAEALRLLDACGADVIELGVPCSDPYVDGPIIQASSARALAGGATMDGVLAMLKEVTPELSCPVVLFSYYRPILCRGLAEIKEAGVHGLIVPDLPYVAAHALWSEAKKNNLELVLLTTPAIPEERMKEITKASEGFIYLVTVNGVTGPRENVNLRVESLIQEIKKVTDKPVAVGFGISKPEHVKQIARWGADGVIIGSAMVRQLGEAASPREGLKRLEAYARSMKNALP

SEQ ID NO: 31945 - protein, 153 aa, Cucumis melo
TATEGNSPECNNNVDDPIDCRDPEVFHLMMETTIERFKDIHFYRFGKPVRGSNDSTCDMAWRFRPKEGKIAAFYKDYRRFVITRSANCSLSIISIGDYHTGVNARKRKKNPKHNFEKKMEQLEQAVSSLPVVGEVVNDSLPVVESEGSFSQGK

SEQ ID NO: 31946 - protein, 170 aa, Triticum turgidum subsp. durum
MASSATSVAPFQGLKSTDGLPISRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 31947 - protein, 2192 aa, Phaseolus vulgaris
MSSSISFPTVRTPSARTLPCKTEKSLFNSRCPVRVTKFLGTRLRSSGKWLGSERLHVWKSEGPLRRPKLRVVVRSGMSTVPKKPLGLYDPAMDKDSCGVGFVAELSGEGNRNTVTDALEMLVRMTHRGACGCEPNTGDGAGIMVGLPHQFYKEVVDFELPPPGKYAIGMFFLPTSNSLREESKSVFQKVAESLGHSVPGWRSVPTNNSELGKSALLTEPVIEQVFLTPSTLSKVDLERQMYILRKLCMVAITSTLNLHNDGTTDFYICSLSSRTVVYKGQLTPAQLKDYYFADLGNERFTSYMALVHSRFSTNTFPSWDRAQPMRVLGHNGEINTLRGNVNWMKAREGLLKCKELGLSENELKKLLPIVDANSSDSGAFDGVLEFLIQSGKSLPEAVMMMIPEAWQNDKNMDPQRKAFYEYFSALMEPWDGPALIAFTDGHYLGATLDRNGLRPGRFYVTHSGRVVMASEVGVVDIPLEDVSRKGRLNPGMMLLVDFEKHIVVNDDALKEQYSLARPYGEWLKEQKLELKDIVDSVQQSERMPPTIAGVVPAYGDDVDMENMGIHGLLAPLKAFGYTVESLEMLLLPMAKDATEALGSMGNDTPLAVMSNREKLTFEYFKQMFAQVTNPPIDPIREKIVTSMECMVGPEGDLTEITEAQCHRLSLKGPLLSIEEMEAIKKMNHRGWQSKVIDITYSKGRGKKGLEEALDRICAEAHDAIGDGYTTLVLSDRAFSRKRVAVSSLLAVGAVHQHLVKTLERTRVALVIESAEPREVHHFSTLVGFGADAVCPYLAVEAIWRLQVDGKIPPKASGEFYSKDELIKKYFKASNYGMMKVLAKMGISTLASYKGAQIFEALGLSSEVIERCFAGTPSRVEGATFEMLARDALQLHELAFPSRVFSPGSAEAIALPNPGDYHWRKGGEIHLNDPLAISKLQEAARTNSVDAYKQYSKLIHELNKACNLRGLLKFKEAAVKVPLDEVEPASEIVKRFCTGAMSYGSISLEAHTALATAMNKMGGKSNTGEGGEQPSRMEPLSDGSMNPKRSAIKQVASGRFGVTSYYLTNADELQIKMAQGAKPGEGGELPGHKVVGDIAVTRNSTPGVGLISPPPHHDIYSIEDLAQLIHDLKNANPAARISVKLVSEAGVGVVASGVVKGHADHILISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMIAEEMREIMSQIGFRTVKEMVGRSDMLEVDKEVIKSNEKLENIDLSLLLRPAAELRPEAAQYCVEKQDHGLDMALDNKLIALSKAALEKGLQVYIESPILNVNRAVGTMLSHEVTKRYHLNGLPTDTIHIRFKGSAGQSFGAFLCHGITLELEGDGNDYVGKGLSGGKIVVYPSKVSTFDPKQNIVIGNVALYGATSGEAYFNGMAAERFCVRNSGVKAVVEGVGDHGCEYMTGGIVVVLGNTGRNFAAGMSGGIAYVLDIDGGFPSRCNRELVDLDKIEEEDDIATLKMLIQQHQRHTNSVLASEVLADFDSILPKFIKVFPREYKRVLASMKLKEASKDAAESASKHGEEQVEMELVEKDAFKELKELATASPNGKPNEAESFKRPSQVIDPVKHRGFVAYEREGVQYRDPNVRLNDWKEVMKETQPGPLLKTQSARCMDCGTPFCHQENSGCPLGNKIPEFNELVYQNRWREALERLLETNNFPEFTGRVCPAPCEGSCVLGIIENPVSIKSIESAIIDKAFEEGWMVPRPPVNRTGKRVAIVGSGPSGLAAADQLNKMGHTVTVYERADRVGGLMMYGVPNMKADKENIVQRRVNLMAEEGINFVVNASVGHDPLYSLDRLREENDAVVLAVGATKPRDLPAPGRELSGIHFAMEFLHANTKSLLDSNLHDGNFISAKGKKVVVIGGGDTGTDCIGTSIRHGCSSIVNLELLPEPPQTRAPGNPWPQWPRIYRVDYGHQESAAKFGKDPRSYEVLTKRFVGDENGVVKGLEIVRVRWEKDATGRFQFKEIEGSEEIIEADLILLAMGFLGPEPTIAEKLGMERDNRSNFKAEYGRFSTSVSGVFAAGDCRRGQSLVVWAISEGRQAAAQVDNYLSNEDIEHIAGNPDELIKHQQDLTKRGTVAVANTQ

SEQ ID NO: 31948 - protein, 2196 aa, Phaseolus vulgaris
MSNALSFTLPALNNPQISAFNSPNKARLHLRSRVARCPASTVEKKRLFGAQVRSSGFDRIRLLQSGRLPKWRVAVRSAFSAVPEKPLGLYDPAMDKDSCGVGFVAELSGECNRRTVTDALEMLVRMTHRGACGCEANTGDGAGILVALPHVFYQEVVDFELPPQGKYAVGMFFLPKSENRRKESKKLFSKVAESLGHTVLGWRSVPTDNTGLGKSALQTEPVIEQVFLTPSAESKVDLERQMYILRKLSMAAITSALNLQNDGITDFYICSLSSRTVVYKGQLTPAQLRDYYFADLGNERFTSYHGPDTFTVFYKYFSIAGIVLNLCVYIGHNGEINTLRGNVNWMKAREGLLKCKELGLSENKLKKLLPIVDANSSDSGAFDGVLEFLLHSGKSLPEAVMMMIPEAWQNDKNMDSQRKAFYEYFSALMEPWDGPALISFTDGHYLGATLDRNGLRPGRFYVTHSGRVIMASEVGVVDIPPEDICRKGRLNPGMMLLVDFEKHAVVNDDALKEQYSLARPYEDWLKNQKIELKDIVDSVPKSGRVPPPIAGVAPPSNDDEDMVNMGIHGLLAPLKAFGYSVESLEMLLLPMAKDGVEALGSMGNDTPLAVMSNREKLTFEYFKQMFAQVTNPPIDPIREKIVTSMQCMVGPEGDLTEITEEQCHRLSLKGPLLYTEEMEAIKKMNYRGWHSKVIDITYSKERGKGGLEEALDRICAEAHDAISEGYTTLVLSDRAFSRKRVAVSSLLAVGAVHQHLVKTLERTRVALIVESAEPREVHHFCTLVGFGADAICPYLAIETIWRLQVDGKIPPKSSGEFHSKEELVKKYFKASNYGMMKVLAKMGISTLASYKGAQIFEALGLSSKVIEKCFAGTPSRVEGATFETLARDAFQLHELAFPSRVFSPGSAEAVTLPNPGDYHWRKGGEVHLNDPLAIAKLQEAARTNSVDSYKQYAKFIHELNKACNLRGLLKFKETAVKIPIDEVEPASEIVKRFCTGAMSYGSISLEAHTALAMAMNKIGGKSNTGEGGEQSSRMEPLPNGTMNPKRSAIKQVASGRFGVSSYYLTNADELQIKMAQGAKPGEGGELPGHKVIGDIAVTRNSTAGVGLISPPPHHDIYSIEDLAQLIHDLKNANPTARISVKLVSEAGVGIIASGVVKGHADHVLISGHDGGTGASRWTGIKNAGLPWELGLAETHQTLVANDLRGRTVLQTDGQLKTGRDVAIATLLGAEEFGFSTAPLITLGCIMMRKCHKNTCPVGIATQDPVLREKFAGEPEHVINFFFMVAEEMREIMSQLGFRTVNEMVGRSDMLEVDKEVIKSNEKLENIDLSLLLRPAAELRPEAAQYCVQKQDHGLENALDNKLISLSNAALEKGLPVYIETPIYNVNRAVGTMLSHEVTKRYHLAGLPSDTIHIRFTGSAGQSFGAFLCPGITLELEGDSNDYVGKGLSGGKIVVYPPKGSNFDPKENIVIGNVALYGATQGEAYFNGMAAERFCVRNSGAKAVVEGVGDHGCEYMTGGTVVVLGETGRNFAAGMSGGIAYVLDLDGKFQSRCNLELVDLDKVEEEEDVYTLRMLIQQHQRHTNSLLAKEVLDDFENLLPKFIKVFPREYKRVLASVKSEEASKDAVVQAAKDAEDQDDEAQAVEKDAFEELKKLATVSLNEKQSQAETPKRPSQVTDAIKHRGFVAYEREGVQYRDPNVRMADWNEVMEETKPGPLLKTQSARCMDCGTPFCHQENSGCPLGNKIPEFNELVYQNRWREALERLLETNNFPEFTGRVCPAPCEGSCVLGIIENPVSIKSIECAIIDKAFEEGWMVPRPPVKRTGKRVAIVGSGPSGLAAADQLNKMGHAVTVYERADRIGGLMMYGVPNMKSDKVDVVQRRVNLMAEEGVDFVVNANVGNDPLYSLDRLREENDAIVLAVGSTKPRDLPVPGRELSGVHFAMEFLHANTKSLLDSNLEDGSYISAKGKKVVVIGGGDTGTDCIGTSIRHGCSSIVNLELLPQPPPTRAPGNPWPQWPRIFRVDYGHQEAAAKFGKDPRSYEVLTKRFLGDENGVLKGLEVIRVCWEKDETGRFQFKEIEGSEEIIEADLVLLAMGFLGPEPTIAEKLGLDRDNRSNFKADYGRFSTNVKGVFAAGDCRRGQSLVVWAISEGRQAAAQVDNYLVKDDDEHRNQDGLVKRQQGLNKKQQGSSKHTVMT

SEQ ID NO: 31949 - protein, 504 aa, Lycopersicon esculentum
MANRNVPIPRRQLYIGGEWREPVKKNRIPIINPATEEIIGDIPAATAEDVDIAVEAARKAIARDDWGSTTGAQRAKYLRAIAAKVLEKKSVLATLESLDSGKTLYESAADMDDVAGCFEYYAGLAEALDSRRMTPVNLNSDSYKSYVLREPLGVVGLITPWNYPLLMAIWKVAPALAAGCAAILKPSELASITCLELGEICREIGLPSGALNILTGLGPEAGGPLASHPHVDKISFTGSGPTGSKIMTAAAQLVKPVSLELGGKSPIVVFDDIDNLDIAAEWTLFGIFANTGQVCSATSRLIVQENIASAFMDRLLKWTKNIKISDPLEEDCKLGPVVSAGQYEKVLKFISNAKSEGATILCGGERPQHLKKGYYVQPTIITDVNTSMEIWKEEVFGPVLCVKTFKTEEQAIELANDTKYGLGAAVMSKDVKRCERFTKAFQTGIIWINCSQPTFNELPWGGKKRSGFGRDLGKWGLENFLNIKQVTEYTSAEPLAFYKSPSKN

SEQ ID NO: 31950 - protein, 355 aa, Verticillium dahliae
MSRSNAPNPSGSRKISFNVSEQYDIQDVVGEGAYGVVCSAIHKPSGQKVAIKKITPFDHSMFCLRTLREMKLLRYFNHENIISILDIQKPRGYDTFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKCRRAREYIRSLPFKKKVPFRTLFPKTSDLALDLLEKLLAFNPVKRITVEEALKHPYLEPYHDPDDEPTAPPIPEEFFDFDKHKDTLSKEQLKQLIYQEIMR

SEQ ID NO: 31951 - protein, 111 aa, Thiomicrospira denitrificans
WTMVAGGGASVVYADTIADLAGIEDLANYGEYSGGPTTSETKFYAETILDLMTRDKDLKGRDKVLIIGGAIANFTDVAKTFTGIIQAFELYADKMKQVGIKIYVRRGGPNY

SEQ ID NO: 31952 - protein, 507 aa, Lycopersicon esculentum
MEATPTWAIAVVCFILLAISIFIEQIIHHIGEWLLEKRKKSLYEALEKIKAELMLLGFLSLLLTVLQDPVSNLCVPKSVGYSWHPCMAKEDAKSEYDDPCLPKGKVQFASSYAIHQLHIFIFVLAVAHVLYCIATFALGRLKMRKWRAWEDETKTMEYQFYNDPERFRFARETSFGRRHLHFWSKSPVLLSIVCFFRQFFSSVAKVDYLTLRHGFMMAHLTPQNQNNFDFQLYINRAVDKDFKVVVGISPALWLFTVLYFLTTTDRLYSYLWVPFIPLVIILLVGTKLQMIITEMGVRISERGDIVKGVPVVETGDHLFWFNRPALVLFLINFVLFQNAFQVAFFFWSWWKFGFPSCFHKNAADLAIRLTMGVIIQVHCSYVTLPLYALVTQMGSSMKPIIFGDNVATALRSWHHTAKKRVKHGLSGHTTPANSRPTTPLRGTSPVHLLRGYPQYNEDSVQASPRTSNVENEGWANENQEGEILQHASTDHNKQIEITMSDFTFGNK

SEQ ID NO: 31953 - protein, 510 aa, Arabidopsis thaliana
MEKLLAGQTNNGSLKSKTKIVCTLGPASRSVEMVEKLLKAGMNVARFNFSHGSHSYHQETLDNLRTAMENTCIPCAVMLDTKGPEIRTGFLKEGKPVELIQGQEITISTDYTMEGDSNTISMSYKKLAEDLKSGDVILCSDGTISLTVLSCDKNLGLVRARCENSAVLGERKNVNLPGIVVDLPTLTEKDQEDILQWGVPNKIDIIALSFVRKGSDLVEVRKLLGENAKSIMLMSKVENQEGVMNFDKILEYSDAFMVARGDLGMEIPIEKMFLAQKMMIQKANALGKPIVTATQMLESMTKSPRPTRAEATDVANAVLDGTDCVMLSGETAAGAHPETAVLTMSRICKEAEDFIDYDTMHKKIQDIVSLPLSPIESLAASAVSTARSLCAAAIVVLTKGGYTVELVAKYRPSVPILSVIVPEITRTDDFEWSCSESAAHVARRGLIYRGIVPVMATGASARSSNKDSTEETIQFAIEFAKKKGICKTGDSIVALHKIDGSSVVKILNVE

SEQ ID NO: 31954 - protein, 352 aa, Cochliobolus heterostrophus
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAIFPKTNDLALDLLERLLAFNPVKRISVEDALKHPYLEPYHDPDDEPGADPIPEEFFDFDKNKDNLTKEQLKLLIYQEIMR

SEQ ID NO: 31955 - protein, 312 aa, Synechocystis sp. PCC 6803
MKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 31956 - protein, 375 aa, Actinobacillus actinomycetemcomitans
MAKQDYYELLGISRSADEKEIKRAYKKLAMQYHPDRTKGDKEKEEKFKEIQEAYEVLNDKEKRAAYDQYGHAAFEQGTGFGGGSFGGADFGDIFGDMFGDIFGGGGRGRQRVVRGDDLRYDIEITLEEAVKGTTKDIKIHTLAPCDTCHGTGAEAGSKVETCPHCHGAGRLRRQQGFFVTEQPCHFCHGTGKKIEKPCKTCHGDGRVNKAKNLSVKIPAGVDTGNQLRLSGEGAAGENGAPAGDLYVVIHVKEHHIFERDGSNLYCEVPISFTMAALGGEIEVPTLDGRVKLKIPEETQTGKLFRMRGKGVTSTRSGYAGDLTCRIIVETPVKLNEEQKELLRKLEESLEGQTKQRPKSSSFLDGVKRFFDDLTK

SEQ ID NO: 31957 - protein, 337 aa, Agrobacterium tumefaciens
MLEKFERYPLTFGATAIEYLPRLTEALGGDVEIWAKREDCNSGLAMGGNKLRKLEYIVPDAIASNADTLVSIGGVQSNHTRMVAAVAAKLGMKCRLVQESWVPHEDAVYDRVGNILMTRLMGADSRIVDDGFDIGIRQSWEDAIQSVIDEGGKPYAIPAGASVHKYGGLGYVAFAEEVARQEADLGFKFDYIIVCVVTGSTQAGMIVGFAAQDRADRVIGIDASGTPEQTRSQVRQIVDNTAELVELGRPVREDEIVILNDYAYPAYGVPSNETNEAIRLAARTEAMITDPVYEGKSMQGMIDLTRKGFFPKGSKVLYAHLGGAPALNGYSYTYRNG

SEQ ID NO: 31958 - protein, 450 aa, Bacillus cereus ATCC 10987
MSTHVTFDYSKALSFIGEHEITYLRDAVKVTHHAIHEKTGAGNDFLGWVDLPLQYDKEEFARIQKCAEKIKNDSDILLVVGIGGSYLGARAAIEMLNHSFYNTLSKEQRKTPQVLFVGQNISSTYMKDLMDVLEGKDFSINVISKSGTTTEPALAFRIFRKLLEEKYGKEEARKRIYATTDKARGALKTLADNEGYETFVIPDDVGGRFSVLTPVGLLPIAVSGLNIEEMMKGAAAGHDDFGTSELEENPAYQYAVVRNALYNKGKTIEMLVNYEPALQYFAEWWKQLFGESEGKDQKGIFPSSANFSTDLHSLGQYVQEGRRDLFETVLKVGKPTHELTIESEENDLDGLNYLAGETVDFVNTKAYEGTLLAHSDGGVPNLIVNIPELNEYTFGYLVYFFEKACAMSGYLLGVNPFDQPGVEAYKKNMFALLGKPGFEELKAELEERLK

SEQ ID NO: 31959 - protein, 1023 aa, Schizosaccharomyces pombe
MNAQPFHNNTSDVQSFQDIISNSYQKPLSLVDSTDRALPDSSLSSLSRSTFQFHKHHLSGNENPQPSSESPYFTNNERLNSSSFPQIHDNQLSPSFNTSYQAIPSSSSNRSRGGPYTPSIRDDSLLALLSFSSNHRLHSMPSQLQPFNNASSYTTPMAPFTASFSNKVSHSAYPTRRLPSQAKKTSAIERVPVNLNFLQSDNLVVQSSPQTNFENFEFPKKIPSKEDLETREVLLLPPQTSKLSNKNLDTKSFTDVNKISQQGFVEISSNSSKVTPNTSLHQSFGIASSSSNNYMQTSSELTSSTEKMNGSHPLQLSNKSLLSIHLMQSKNQGHVSMTGSDKLSSHVQSETENAPVSKPSKPNTLTEDEKPLQSTKLPGNSLTVGELYQEPKSIQLPELSVSRTTYSAQSSSVKNCNERIPSAKALKKQKHLVPENKSKLQYVWQKKESLPYANLTSASNTHFFLSENQNDTSERLTRTLRKSTKNYTFGSYILGRTIGTGEFGKVKLGWPLPKANSTIHRSTPQVVIKIVLSTKQNCQTSRLMREVAILKGLGNNHPHIVKYLDFVKTKHHFGIVLDYVNGGELFDYILARRRLEDSVACRLFAQLISGVAYLHSRGVVHRDLKLENILLDTNRNIVIADFGFATTFGHFNTLSEHSLPTEKPDLFSTSCGSPCYAAPELVNCKSGMYAGTQADIWSCGVILYAMLAGYLPFDDDPHNPNGENVPRLYRYICSTPLIFPEFFKSKARDILKKILVPDPAKRVRMSAIMNHAYLRSHVSLFETYNDDEATSLRPSPIRLLSQKSLASVSSVSSISTYSSSIELTPQITKTSLNREKPALHGSINLKHSTRPVVPIADGIYASTTLHPIDNAKNRLVSLLRRPKHKVKHAKVETRESPMKNKPTKKQHKRAFSMFERPTSQKAPLSPVESKINLMVAPKRVLNCASDSLRALLAGKTDKSFWGSRIPFLFNKLKSKQKAVSSSFNTENSFLILQAVSPLTFGGCFKEENAYGQKKQHMRHATVF

SEQ ID NO: 31960 - protein, 454 aa, Bacillus cereus ATCC 10987
MKETSTFSQKLKQFVLLFFPIFITQMSLFAMSFFDTTMSGHASPIDLAGVAIGTSIWIPVSTGLTGILMATTPIVAQLVGSKKKEDVPQVVIQAVYLAICASFVVMLIGFFAVTPILNGMRLEEPVERIAAQFLSIIAIGIIPLFTYTVLRGFIDALGKTRTTMIITLLSLPINVILNYVLIFGHFGFPKLGGVGAAIASTATYWCILIITVMIIRTKEPFASFHIFKQLYRPSLSSWKEFLKLGVPIGFAIFFETSIFAAVTLMMSNFSTTTIAAHQAAMNFASLLYMTPLSLAMAMTIAVGFEVGAKRYNNAKQYGFIGIGLALAFALLYSILLYFFDDEIASIYTTDIQVHHLAKEFLIFAILFQISDAIATPVQGALRGYKDVNVSLIMTLIAYWVIGLPLGYILATYTDWAAKGYWIGLIIGLAFGATFLLIRLFQVQRKYTIENRRSR

SEQ ID NO: 31961 - protein, 485 aa, Eupatorium atrorubens
MSPQTETKASVGFKAGVKDYKLTYYTPEYETKDTDILAAFRVTPQPGVPPEEAGAAVAAESSTGTWTTVWTDGLTSLDRYKGRCYGIEPVPGEDNQYIAYVAYPLDLFEEGSVTNMFTSIVGNVFGFKALRALRLEDLRIPTAYVKTFDGPPHGIQVERDKLNKYGRPLLGCTIKPKLGLSAKNYGRACYECLRGGLDFTKDDENVNSQPFMRWRDRFLFCAEALYKAQAETGEIKGHYLNATAGTCEDMMKRAVFARELGVPIVMHDYLTGGFTANTSLAHYCRDNGLLLHIHRAMHAVIDRQKNHGMHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNEIIREATKWSPELAAACEVWKEIKFEFQAMDTLDTDKDKDKKR

SEQ ID NO: 31962 - protein, 475 aa, Rhynchostegium pallidifolium
MSPQTETITGVGFIAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTCEEMMKRAQFARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTSGHPWGNAPGAVANRVALEACVQARNEGRDLAREGNEVIREATKWSPELAAACEVWKEIKFEFDTIDTL

SEQ ID NO: 31963 - protein, 475 aa, Boulaya mittenii
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMMKRAQCARELGMPIVMHDYLTGGFTANTSLAHYCRDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 31964 - protein, 475 aa, Brotherella henonii
MSPQTETKAGVGFKAGVKDYRLTYYTPDYQTKDTDILAAFRMTPQPGVPAEEAGAAVAAESSTGTWTTVWTDGLTSLDRYKGRCYDPEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 31965 - protein, 475 aa, Wijkia hornschuchii
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLIKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLPKASRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 31966 - protein, 475 aa, Hypnum plumaeforme
MSPQTETKAGVGFKAGVKDYRLTYYTPDYQTTATDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTCEEMMKRAQFARELGMPIVMHDYLTGGFTANTSLAHYCRDNGLLLHIHRAMHAVIDRQKIHGMHFRVLAKALRLSGGDHIHAGTVVGKLEGERQVTLGFVDLLRDDYIEKDRSRGIYFTQEWVSLPGVLPVASGGIHVWHMPALTEIFGDDSVLQFGGGTLGHPWGNAPGAVANRVAVEACVQARNEGRDLAREGNEIIREATKWSPELAAACEVWKEIKFEFDTIDTI

SEQ ID NO: 31967 - protein, 475 aa, Platyhypnidium riparioides
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQSETGEIKGHYLNATAGTCEEMMKRAQFARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTSGHPWGNAPGAVANRVAVEACVQARNEGRDLAREGNEIIREATKWSPELAAACEVWKEIKFEFDTIDTL

SEQ ID NO: 31968 - protein, 475 aa, Plagiothecium nemorale
MSPQTETKAGVGFKAGVKDYRLTYYTPDYQTKETDILAAFRMTPQPGVPAEEAGAAVAAESSTGTWTTVWTDGLTSLDRYKGRCYDLEAVAGEEIQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTCEEMMKRAQFARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTI

SEQ ID NO: 31969 - protein, 475 aa, Leucobryum scabrum
MSPQTETKAGVGFKAGVKDYRLNYYTPDYQTLETDILAAFRMTPQPGVPPEEAGAAVAAESSTGTWTTVWTDGLTSLDRYKGRCYDIEAVPGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFVFVAEAVYKSQAETGEIKGHYLNATAGTCEEMLKRAEFARELGVPIVMHDYLTGGFTANTTLAHYCRDNGLLLHIHRAMHAVIDRQKNHGMHFRVLAKALRLSGGDHVHSGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREAAKWSPELSAACEVWKEIKFEFETIDTV

SEQ ID NO: 31970 - protein, 475 aa, Myuroclada maximowiczii
MSPQTETKAGVGSKAGVKDYRLTYYTPDYQTKETDILAAFRMTPQPGVPAEEAGAAVAAESSTGTWTTVWTDGLTSLDRYKGRCYDLEAVPGEENQYIAHVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKNHGMHFRVLAKALRSSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPESAAACEIWKEIKFEFDTIDTI

SEQ ID NO: 31971 - protein, 475 aa, Hypnum lindbergii
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKNHGMHFRVLAKALRLSGGEHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 31972 - protein, 475 aa, Heterophyllium nematosum
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRASRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 31973 - protein, 205 aa, Arabidopsis thaliana
MGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 31974 - protein, 131 aa, Arabidopsis thaliana
LIIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELLEGKPLPGVLALDEA

SEQ ID NO: 31975 - protein, 506 aa, Arabidopsis thaliana
MASISLLQVSVAILCFLILHYFLFKKPHGRYPRNWPVLRMLPAMLKALHRIYDYSVEILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 31976 - protein, 494 aa, Arabidopsis thaliana
MVLCFQDPDNIYSPKKTKKDDGERVITKQKSFLGLSILDISNPSSTTLSEDLSISLAGSDLHVFTQAELRVITQSFSSSNFLGEGGFGLVHKGFIDDKLRPGLKAQPVAVKLLDLDGLQGHREFMTEVMCLGKLKHPNLVKLIGYCCEEAHRLLVYEFMPRGSLESQLFRRCSLPLPWTTRLNIAYEAAKGLQFLHEAEKPIIYRDFKASNILLDSDYTAKLSDFGLAKDGPQGDDTHVSTRVMGTQGYAAPEYIMTGHLTAKSDVYSFGVVLLELLTGRKSVDIARSSRKETLVEWARPMLNDARKLGRIMDPRLEDQYSETGARKAATLAYQCLRYRPKTRPDISTVVSVLQDIKDYKDDIPIGIFTYTVPTKPRREVKETSLQNFDKPRRETKVTSLQNFGKTRREVKDTSLQNFDKTRREVKETSLQNFDKTRREVKETSLQNFDKPRNVSTTDNHQKFRSPAHTARNHRITLRNGYNSPMRNEAGGERY

SEQ ID NO: 31977 - protein, 378 aa, Arabidopsis thaliana
MERIIGGKYKLGRKIGGGSFGEIFLATHIDTFEIVAVKIENSKTKHPQLLYEAKLYRTLEGGSGIPRIRWFGVDGTENALVMDLLGPSLEDLFVYCGRKFSPKTVLMLADQMLTRIEYVHSKGYLHRDIKPDNFLMGLGRKANQVYLIDFGLAKRYRDANTNRHIPYRENKNLTGTARYASCNTHLGIEQGRRDDLESLGYVLLYFLRGSLPWQGLKAVDKKQKYDKICEKKISTPIEVLCKSHPVEFASYFHYCHTLTFDQRPDYGFLKRLFRDLFSREGYEFDYIYDWTIIKYQQSQKTRSQSQAVPGSSNARAIPMDTSNHRGGTKISHEAQVSDRVRPANASGPSPQINTAVGRSLGFDQVHKNVRAYSFASSK

SEQ ID NO: 31978 - protein, 351 aa, Arabidopsis thaliana
MKKQYLKSGSGTRKEKDKAKRWFLDNGSIFLRELVADCNGKSIPIRSFSPEQILKATNNFDSSCFVSQDVYYKWYRGEIEDRSYMIKRFSEDEITGKRHRVKEVYNDIVLSARMSNHSNFLQPLGCCLEFPFPVLVFEFAEHGAMNQRGGVIVNGEESLLPWSVRLKIGKEIANAVTYLHTAFPKIIIHRDVKPMHVFLDKNWTAKLSDLSFSISLPEGKSRIEAEWVLGTFGYIDPLYHKTCFVTEYTDVYSFGICLLVIITGKPAIMTISDGDLQGILSLVRELCENGKLDEVIDPRLMKDITSGQRLQVEACVVLALRCCKERDEDRPKMIQVAKELKQIEASLKNSS

SEQ ID NO: 31979 - protein, 383 aa, Arabidopsis thaliana
MASNQQPPSNLQTYGVPIYAVDWILEEAVRSKITKDQDDDDDDGSSSSSYIVLSGGGGEGRSGIPNVILICRVDLHTNSLSEQPIGRRVIGTDLPYRMAIHPRQGGLICALPNSCRLFDWENIIEDDNEEESEKVVKELKDVGQQLSLSFNQDGTVLATGAEDGTLRVFEWPSMKTLLNESKTHASVKSLTFSESGKFLVSLGAPLCRVWDVNASAAIASLSKEKDEMFASCRFSVDNSGSEVLYVAANTQRGGSIITWDTTSWRRRSSKLIKRNNSISAFNVSADGKLLAVGTLEGDVLIIDSTKMQTNQIVKKAHLGLVTALTFSPDSRCLVSVSFDSRARLTVIKQKGEKRRVYLWVAALLFVLVYVVLYYLMVAMGIIH

SEQ ID NO: 31980 - protein, 490 aa, Arabidopsis thaliana
MEIILVTLCLTTLLALLLLKSILKRTTTNNLNLPPSPWRLPVIGNLHQLSLNTHRSLRSLSLRYGPLMLLHFGRTPVLIVSSADVAHDILKTYDVICANRPKTKVIDKILRGGRDVAFAPYGEYWKQMKSICIQNLLSNKMVRSYKKIREDEIKLMIEKVENASSCSPPSPVNLSQLFMTLTNDIICRAALGRKYSSKEDGIDVENIVRAFSALVGEFPIGEYIPSLSWIDKIRGQDHKMEEVDKRFDEFVERVVKEHEDANKDTRSDLVDTLLTIQSDKSALKLIIWDMFLAGTATSLSFLEWAMTELMRNPKVMKKLQEEIRSSSRQGLFVTEKEAEKMDYLQAVIKEALRLRPPAPLMVPRVFSEDVTLKGYNIPAGTQVIINAWAIQRDTTTWGIDAEEFRPERHLDSILDFQGQDFKFIPFGSGKRICPGIGFTSALIGVTLANIVKRFNWRMDVEPQRVQHDLTEATGLVVFRKFPLIAIPSSA

SEQ ID NO: 31981 - protein, 487 aa, Arabidopsis thaliana
MAMMRTSPRDSISNLPDEILGKILSLLPTKVAASTSVLSKRWRNLLGLVDNLCFDESMVVYPNEEEETSGSLRFCDFVDKTFALLSNSHIEKFSLSRVYKYNDDVDGMVRRWIRTVMERGLLEIHLHATPMSFVAIETKLLTSNTLVKLTLSARCFVEVERVFFPALKSLSLFSILGDYTNYIRLIDGCPVLEELYMRDGDYPFLRLTCGTNVESASLKRLVIFTHNPNEMIWHELIYFEAPSLVYLDYSSYVSAKYDVVDFDLLVEARLSLRLWVSTNDYDYSDDDDDDDDDDDDDDDGDYYIVEPKAPIFGDVTELLAAIRNITTLHLSPDSLEVFHFCCKSMPVFNNLLNLSIESNKDKGWQVMPLLLKSCPNLHTLVIKGLVHRVTSRCGDACACIPKKQRKIVQKEEALCCLRTCQVKVLQISEYGGYFQELKQMRHFLGKLECLETVKVGVHAENNNNSEFLRANVLTLPRVSAKCNVHFI

SEQ ID NO: 31982 - protein, 382 aa, Arabidopsis thaliana
MVSQKETVCVTGASGFIGSWLVMRLLERGYFVRATVRDPGNLKKVQHLLDLPNAKTQLTLWKADLSEEGSYDDAINGCDGVFHVATPMDFESKDPENEVIKPTVNGMLGIMKACVKAKTVRRFVFTSSAGTVNVEEHQKNVYDENDWSDLEFIMSKKMTGWMYFVSKTLAEKAAWDFAEEKGLDFISIIPTLVVGPFITTSMPPSLITALSPITRNEAHYSIIRQGQYVHLDDLCNAHIFLYEQAAAKGRYICSSHDATILTISKFLRPKYPEYNVPSTFEGVDENLKSIEFSSKKLTDMGFNFKYSLEEMFIESIETCRQKGFLPVSLSYQSISEIKTKNENIDVKTGDGLTDGMKPCNKTETGITGERTDAPMLAQQMCA

SEQ ID NO: 31983 - protein, 285 aa, Arabidopsis thaliana
IGDDEHCWSEAGVSNIEGGCYAKCIDLARDKEPDIWNAIKFGTVLENVVFDEHTREVDYTDKSVTENTRAAYPIEYIPNSKIPCVGPHPKNVILLACDAFGVLPPISKLNLAQTMYHFISGYTALVAGTEEGVKEPRATFSACFGAAFIMLHPTKYAAMLAEKMQAQGATGWLVNTGWSGGSYGTGSRIKLAYTRKIIDAIHSGSLLNASYRKTHIFGLEIPNEVEGVPSEILEPINAWPDKMAYEDTLLKLAGLFKSNFETFTSHKIGDDGKLTEEILAAGPNF

SEQ ID NO: 31984 - protein, 239 aa, Arabidopsis thaliana
MPTSAALDVVAKSLNLKFFEVPTGWKFFGNLMDAGMCSVCGEESFGTGSDHIREKDGIWAVLAWMSILAHKNKGNIDGNAKLVSVEDIVRQHWATYGRHYYTRYDYENVDAGKAKELMEHLVKLQSSIPEVNKIVKGIRSDVASVASADEFEYKDPVDGSISKHQGIRYLFEDGSRLVFRLSGTGSEGATIRLYIEQYEKDASKTGRESQEALSPLVDLALKLSKMEEFTGRSAPTVIT

SEQ ID NO: 31985 - protein, 350 aa, Arabidopsis thaliana
GQTYERAYIQRWIDCGNLTCPKTQQKLENFTLTPNYVLRSLISRWCAEHNIEQPAGYINGRTKNSGDMSVIRALVQRLSSRSTEDRRNAVSEIRSLSKRSTDNRILIAEAGAIPVLVNLLTSEDVATQENAITCVLNLSIYENNKELIMFAGAVTSIVQVLRAGTMEARENAAATLFSLSLADENKIIIGGSGAIPALVDLLENGTPRGKKDAATALFNLCIYHGNKGRAVRAGIVTALVKMLSDSTRHRMVDEALTILSVLANNQDAKSAIVKANTLPALIGILQTDQTRNRENAAAILLSLCKRDTEKLITIGRLGAVVPLMDLSKNGTERGKRKAISLLELLRKACQ

SEQ ID NO: 31986 - protein, 455 aa, Arabidopsis thaliana
MDEHTFMVNRERAVDYLNSLEKVFVNDQYLNWDPENRIKVRIVSARAYHSLFMHNMCIRPTQEELESFGTPDFTIYNAGQFPCNRYTHYMTSSTSVDLNLARREMVILGTQYAGEMKKGLFSVMHYLMPKRRILSLHSGCNMGKDGDVALFFGLSGTGKTTLSTDHNRYLIGDDEHCWTETGVSNIEGGCYAKCVDLSREKEPDIWNAIKFGTVLENVVFDEHTREVDYSDKSVTENTRAAYPIEFIPNAKIPCVGPHPTNVILLACDAFGVLPPVSKLNLAQTMYHFISGYTALVAGTEDGIKEPTATFSACFGAAFIMLHPTKYAAMLAEKMKSQGATGWLVNTGWSGGSYGVGNRIKLAYTRKIIDAIHSGSLLKANYKKTEIFGFEIPTEIEGIPSEILDPVNSWSDKKAHKDTLVKLGGLFKKNFEVFANHKIGVDGKLTEEILAAGPIF

SEQ ID NO: 31987 - protein, 371 aa, Arabidopsis thaliana
MEKQYLTFISFCFSITICGFLIVSWLARSIIRNGIRTLTWRKETKRKKKNQEDENKMSLLDLPDLTLDCILEKLSPSELCAMTSVCSELRDKCVSDHLWEKHMETKWGRLMGDAAIQKWKSHVATIMRCLTSSSSSSRKSKPNWSSRFVANLKPFAWLSSNHGCENRGSSSYLAPIDSVMYWYSNLENGKFWFPAQVYNRENGHVGFMMSCYDAKIRYDFKTDTFQARYSAHGRRAAEEKVTWQRLRPSQDDTKSRDLHVSDCLHGLRPGDHFEIQWRRTKEFPYGWWFGIVGHLQNCDGVQNCRCDSDENVVMEFRQFRPESPWRRTVIKRKDHRETGNEENGFYGGVKKLGTEEEISTWKQLWPSQALE

SEQ ID NO: 31988 - protein, 185 aa, Arabidopsis thaliana
MVQNGDILLQNVFVPDEDRLPGVNSFQDTSKVLAVSRVMVAWQPIGISMGIYDMCHRYLKERKQFGAPLAAFQLNQQKLVQMLGNVQAMFLMGWRLCKLYETGQMTPGQASLGKAWISSKARETASLGRELLGGNGILADFLVAKAFCDLEPIYTYEGTYDINTLVTGREVTGIASFKPATRSRL

SEQ ID NO: 31989 - protein, 480 aa, Arabidopsis thaliana
MEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 31990 - protein, 455 aa, Arabidopsis thaliana
MGSRDFISSLPDEVLGKKILSLLPTKLVVSTSVLSKRWRNLFHFVDSFDLEDSTPIRNADSFSDFMKDTVALLSNCPIKRLTLNSHYEKSSVNRWIRSALKRGCLELNLQSQYDHYLDIGIFFRNNTLVKLTLSSYRTFLRGNVPPEGRVFFPALKTLSLGAVVAKPALYNWLISGCPVLEELFILDVGSGDDQPTWTRSVVSASIKRLTIVFHFPHNTYPYEDDVEIKTPNLEFLDYSALRSDGSDVDYLDSLAEARLDLRLWELTNTFDFGEVTNLVSAIRNVKTLHLSSSSLEAFYYRCYTMPVFDKLIHLSIESDKENGWQALPRLLLKSPNLQTLAIKGLLHKVTYRCGNACACTSKPKKRYLYKRYEDDSPTSEVEGRCCLSTCRVKVLEISGYGGSLREVKQMEHFLRKLKYLETVKIGVEEDNDSEHLRTELMTLDIASSKCNIQFI

SEQ ID NO: 31991 - protein, 380 aa, Pseudomonas viridiflava
MVKPSLFSANKLASAVVASLLFASAGAQADIATDVATTGWATQNGGTKGGSKAAANNIYTVKNAAELKAALKASVGTNGRIIKISGVIDVSEGNAYTKTADMKARGRLDIPGKTTIVGITNNAEIREGFFYAKENDVIIRNLTIENPWDPEPIWDANDGSAGNWNSEYDGLTIEGANNVWVDHVTFTDGRRTDDQNGTANGRPKQHHDGALDVKNGANYVTISYTAFKSHEKNNLIGSSDSRTTDDGKLKVTIHNSLFENISARAPRVRFGQVHLYNNYHVGSASHSVYPFSYAHGIGKSSKIFSEKNAFEISGISGCTKIAGDYGGSVYRDSGSTLNGTALTCTWSSSIGWTPPYSYTPLNADKVKADVTAKAGAGKIL

SEQ ID NO: 31992 - protein, 380 aa, Pseudomonas fluorescens
MTNPSTFTASKLASAVIGALLLSSVPAHAADIWLDSATTGWATQNGGTKGGSRAAANNIYTAKNAAELKTALKASVGANGRIIKITGIIDISEGKAYTTTADMKVRGRLDIPGKTTIVGTTSNAEIREGFLYAKENDVIIRNITIENPWDPEPKWDPTDGSAGNWNSEYDGLTIEGANNVWVDHVTFTDGRRTDDQNGTANGRPKQHHDGALDVKNGANYVTISYSAFKSHEKNNLIGSSDSRTTDDGKLKVTIHNTLFENISARAPRVRFGQVHLYNNYHVGSTSHKVYPFSYAHGMGKNSKIFSERNAFEISGISGCDKIAGDYGGNVYRDTGSTVNGTALTCPWSTNIGWTPPYSYTPLAADKVAADVKAKAGAGKL

SEQ ID NO: 31993 - protein, 334 aa, Triticum monococcum
MATPTTTPATMRAVQYDACGGGAAGLKHVEVPVPSAKKNEVLLKLQAATINPVDWKIQKGDLRPLLPRRLPFIPVTDVAGVVVDVGPGVKGLTVGDQVVAMLNSFNGGGLAEYAVASANLTVKRPAEVSAAEGAGLPIAAGTALQALRSIGAKFDGTGKPLNVLVTAASGGVGLYPVQLAKLTNLCYRHLRGRNMDLVKSLGADEVMDYRTPEGASLQSPSGRKYDGVVHCTVGVSWSSFQPLLSDAGRVIDITPNFSAILTSALHRMTFSKKRLVPLLLSPNKADLEFLVGLLKEGKLKTVVDSKFLLSEADKAWQSSIDGHATGKIVVEMES

SEQ ID NO: 31994 - protein, 477 aa, Elegia asperiflora
MSPQTETKASVGFKAGVKDYKLTYYTPDYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVLPVASGGIHVWHMPALTEIFGDDSVLQFGGGTLGHPWGNAPGAVANRVALEACVQARNEGRDLAREGNEVIREACKWSPELAAACEVWKAIKFEFEPVDKLDK

SEQ ID NO: 31995 - protein, 480 aa, Dovea macrocarpa
  misc_feature (477)..(477): Xaa can be any naturally occurring amino acid
MSPQTETKASVGFKAGVKDYKLTYYTPDYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVLPVASGGIHVWHMPALTEIFGDDSVLQFGGGTLGHPWGNAPGAVANRVALEACVQARNEGRDLAREGNEVIREACKWSPELAAACEVWKAIKFEFEPVDKLDXQAK

SEQ ID NO: 31996 - protein, 476 aa, uncultured bacterium
MEDGRMTPEQVLEFAKENNVEFVDVRFLDFPGLWQHLTVPVTELTLQSFTQGFGFDGSSIRGWQAINESDMLIIPVPDTAIIDPFCQHPTLSMICDIQDPLTRQRYSRDPRSIARKASDHMCSTGIADTAYFGPELEFFIFDQVCYDQGMNYAHYRVDSREGTWRRGQDEPDNLGNQLRPKEGYFPVPPADTMHNLRSEMVAVLQQCGIEVETHHHEVATGGQAEIDMRFDKLVRMGDKMMLYKYILKNVAARHGKVVTFMPKPLHGDNGSGMHTHFSLFKGDQPLFFDKDKYAEFSDLGRWSIGGLIKHAGAVVAFTNPTTNSFKRLVPGFEAPVNLFWSMRNRSAFVRIPVYQHNPNTKRIEFRCPDSSCNPYLAFSAILMAALDGIENRLDPGPAVDENLYEMSPERVAEIGQTPTSLEGALDALGRDHQFLLKGGVFTEDVIHYWIQYKMDNEVNQLRSRPHPYEFCLYFDI

SEQ ID NO: 31997 - protein, 226 aa, uncultured bacterium
MAGVQLGAGCWICEYLSPWDVYAHGVAKTLVHRKTKFQEMHIIETGTFGKALILDGFWQSCTGDEFLYHEPLVHPAMLLHGRPRRVLVLGGAEGAAVREVLRWKSVEQVVMVDIDGEVVEACRQHLPEMHQGACDDPRVEVRIQDALVYLDETRSTFDVIISDLSDPIEDGPSFKLFTRETFERARGSWRRRGCSSCKPAASRRPSCTCTPAWSARSDGCSPTPPH

SEQ ID NO: 31998 - protein, 340 aa, uncultured bacterium
MKAVVFHGKDAGLKIEDIPVPQIKGDQILVKVAACGVCHTDLHYIEHGVPTFKKPPIVLGHEASGIVEKAGANVTNVKPGQRVLIPAVLTCGHCPACRQGRENICSNMTMLGNHFDGAYAEYVAVPAKDVLGLPEAIPLQEASIIADAISTPYHAVKNRAQVKPGDTVVVFGCGGVGINAVQMASAAGGYVIAVDINPRKLEWAREFGAAKTVDASKVDRVSKEIKKLTGGGADIAMEVIGNPRTIEQAFECVRVGGRLCVVGYTHEAISIVAGKIMFKELEIVGSLGCRPVDYVPLIRMVEQGKIDLKRQVTHRFGLDELGQAFEVMKEGLSLRSIVIP

SEQ ID NO: 31999 - protein, 412 aa, Rhodococcus opacus
MTSDIVVIGGGVAGVSAVQSLRSEGYDGRLFLIGKERELPYDRTSLSKAVLAGDLADPPPLSPADWYDELQVETVLDRTVLQVDVTRKEVLLDGGRSLEVDRVLLATGASARVPSFSGADLPGVTTLRTVDDAQRLRQDWEPGQRLVVVGGGLIGCEVATTARKLGLEVSILEASDELLQRVLGRRIGGWCRARLEELGISVMVNTGVAEFDGVDRITAVIGTDGRRFPADSAIVCVGAEPETAIAEQAGLACSRGIIVNDSGGTALEGVFAAGDAASWPLRTGGRRSLETYINSQKEATAVASAMLGKAVHAPQLPLSWTEIAGHRIQMIGDIEGSGEYVMRGAPDDGPALLFRLTDGKLTAALSVDAPREFAMATRLVESGAQVGRDVLADTSVELRELNRAARERTTAA

SEQ ID NO: 32000 - protein, 475 aa, Entodon rubicundus
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQGETGEIKGHYLNATAGTSEEMLKRAQFARELGMPIIMHDYLTGGFTANTTLAHYARDNGLLLHIHRAMHAVIDRQKNHGMHFRVLAKALRLSGGDHIHAGTVVGKLEGERQVTLGFVDLLRDDYIEKDRSRGIYFTQDWVSLPGILPVASGGIHVWHMPALTEIFGDDSVLQFGGGTLGHPWGNAPGAVANRVALEACVQARNEGRDLAREGNEIIREATKWSPELAAACEVWKEIKFEFDTIDTI

SEQ ID NO: 32001 - protein, 482 aa, Lactobacillus gasseri
MTGYTMPKGFLWGGAVAAHQLEGAWNEDGKGMSVADVMTVGSATKPREITDGVIPGKNYPNHDAIDFYHHYKGDIKLMAEMGFKAFRTSIAWTRIFPKGDEKEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYGLVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLQRSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGEGTLERSKKDSFDWYKKVIESNGKDLD

SEQ ID NO: 32002 - protein, 210 aa, Escherichia coli
GALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRA

SEQ ID NO: 32003 - protein, 355 aa, Alternaria brassicicola
MAEFVRAQIFGTTFEITSRYTDLQPVGMGAFGLVCSAKDQLTSQAVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLSNKFKNAEPQAVDLLENMLVFDPKKRVRAEQALAHPYLAPYHDPTDEPIAEEKFDWSFNDADLPVDTWKIMMYSEILDYHNVDAAAQEQENNGS

SEQ ID NO: 32004 - protein, 437 aa, Mangifera indica
MAVSPRWISSVCALLILCLFLGVKASTVKHELNYRLLNSKNTSIADSSDDSWSQHAVDNPEEVAAMVDISIRNSTERRRLGYFSCETGNPIDDCWRCDPKWHLHRKHLADCAIGFGRNAIGGRDGKFYVVSDSSDDNPVDPKPGTLRHAVIQDRPLWIVFKQDMAITLKQELIMNSFKTIDGRGVNVHIANGACITIQYITNVIIHGIHIHDCKPTGNAMVRSSPSHYGWRTMADGDGISIFGASHIWIDHNSLSNCADGLIDAIMASTAITISNNYFTHHNEVMLLGHSDSYTRDKQMQVTIAYNHFGEGLIQRMPRCRHGYFHVVNNDYTHWEMFAIGGSADPTINSQGNRYLAPSNPFAKEVTKRVDTSDGVWKSWNWRSEGDLLLNGAYFISSGARSAASYARASSLGAKSSSLVGALTSSAGAMSCRVGRQC

SEQ ID NO: 32005 - protein, 144 aa, uncultured bacterium
MIFLPLTVAEDDWAGWKILHGALGEQIELVGDDLFVTNVKYIQRGIDENLANSALIKLNQIGSLSETFDAVQLCHDNNWGTFISHRSGETVDSFIADMTVAMRAGHLKTGAPCRGERIEKYNQLMRIEDELGSSAQFAGKSAFK

SEQ ID NO: 32006 - protein, 435 aa, Saccharomyces cerevisiae
MTLSKYSKPTLNDPNLFRESGYIDGKWVKGTDEVFEVVDPASGEIIARVPEQPVSVVEEAIDVAYETFKTYKNTTPRERAKWLRNMYNLMLENLDDLATIITLENGKALGEAKGEIKYAASYFEWYAEEAPRLYGATIQPLNPHNRVFTIRQPVGVCGIICPWNFPSAMITRKAAAALAVGCTVVIKPDSQTPLSALAMAYLAEKAGFPKGSFNVILSHANTPKLGKTLCESPKVKKVTFTGSTNVGKILMKQSSSTLKKLSFELGGNAPFIVFEDADLDQALEQAMACKFRGLGQTCVCANRLYVHSSIIDKFAKLLAERVKKFVIGHGLDPKTTHGCVINSSAIEKVERHKQDAIDKGAKVVLEGGRLTELGPNFYAPVILSHVPSTAIVSKEETFGPLCPIFSFDTMEEVVGYANDTEFGLAAYVFSKNVNT

SEQ ID NO: 32007 - protein, 263 aa, Oryza sativa (japonica cultivar-group)
MTKIVGTLGPKSRAVDTISSCLKAGMSVARFDFSWGDAEYHQETLENLKLAIKSTKKLCAVMLDTVGPELQVVNKSEAAISLEANGTVVLTPDQGQEASSELLPINFSGLAKALKPGATIFVGQYLFTGSETTSVWLEVSEVKGDDVVCVIKNSATLAGSLFTLHCSQIHIDLPTLSDEDKEVIRRWGAPNKIDFLSLSYTRHAEDVRQAREFLSKLGDLSQTQIFAKIENVEGLNHFDEILQEADGIILSRGNLGIDLPPEK

SEQ ID NO: 32008 - protein, 136 aa, Oryza sativa (japonica cultivar-group)
MGEKRRSPLPLLSQGPPLSNLCYLGAEFRFQRAELGAEMMTDDVVTAFELSRAIDDGVLQPLPFGSLTCCSFYIACFFHRYKSEQPSTYRKNGKPAAIQYGTGSVDGFFNEDSVTVGDLVVKDQKIAIGDEVNIWL

SEQ ID NO: 32009 - protein, 172 aa, Oryza sativa (japonica cultivar-group)
MGFERWWLPPPPEVKKPRSLYNAASLAYLGDCIYELYARRHFFFPPLSINDYNKRVMDVVKCESQDLLLNKLLGEDFLTQEERDILRWGRNIVSSKTRTRKRAGIAVYNRASSLETLIGYLYLTNFKRLEQLMFQLGFTSGASSQHIADELRSSFQTKNSSRSVQSKQEAAK

SEQ ID NO: 32010 - protein, 480 aa, Oryza sativa (japonica cultivar-group)
MASEKVETIVAGNYVEMEREGAATAGEGVGGAAAASGRRRGKLAVSSLFWHGGSVYDAWFSCASNQVAQVLLTLPYSFSQLGMASGVAFQVFYGLMGSWTAYLISVLYVEYRTRRERDKVDFRNHVIQWFEVLDGLLGRHWRNAGLLFNCTFLLFGSVIQLIACASNIYYINDRLDKRTWTYIFGACCATTVFVPSFHNYRVWSFLGLLMTSYTAWYLTVAAVVHGKVDGAAPRAGPSKTMVLYFTGATNILYTFGGHAVTVEIMHAMWRPRRFKMIYLAATAYVLTLTLPSAAAMYWAFGDALLDHSNAFALLPRTPWRDAAVVLMLIHQFITFGFACTPLYFVWEKAIGVHGGAGVLRRAAARLPVVLPIWFLAVIFPFFGPINSTVGSFLVSFTVYIIPAMAHMATFAPAAARENAVEPPPRALGGWPGTFAANCFVVAWVLVVGFGFGGWASTVNFVRQVDTFGLFTKCYQCPPRH

SEQ ID NO: 32011 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 32012 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 32013 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 32014 - protein, 1121 aa, Oryza sativa (japonica cultivar-group)
MGRGPSKKLAKRPRAAARGDQEEGDGKEVKEEEEDEALLFPVGAEVEVGSDDPGFVGSFYEGTVEAHLPGGDGYVVAYTTLEEGGAALREEARARDVRPQPPPVAGAPGAPGAGGFAMHDMVEAFHNEGWWSGVVTGLPLPLDVLPVDPRRRVYTVAFPTSREVMEFEEAALRPHRVFRRGSWVPAADVDNGGPAFREGSLVEVSRSAESFGQSWNPATILKVIGSTNFLVQYRHVGDDGELVTEIVDTEYIRPARSIIRMDSKYRFSPSSHVEVFHEGSWWPGIILETSSGVFGKMYVVKLKSYTTGMDNVDGVDKLTVENTKLRPQFEWDGRKWMRCMTKKKDTKAKKLVIRGSQLTSRKKPIPADLASCNDSDEIRDKPSSDKLLETADVVPRPKETMKQQNAVLALASQIKLPLQLSMTGSGHLKYTSSLILGSPIELPSSQMDVMPSVPQTAGLQASLFGVFGKLRPIPQDPLLVMQSPHPDLSRNEGSKASTDQEKQSTDEGCCLISSAANSFNFVSFAGIDVSRKRKECVSFQAPEELGVNPETLSSFHIQEMKKNRVDETIEGTHDIAAISEEQTKLIFRDEHNELPTNVIAGPAIPSEKNQPTPLEDNKGPRDSSIVDKISQSGINDVRQDENLVLHATSTLDNSGDVNLLSSVSSTENQKKISKSEGCEISMDEDSGEEFCRSILVMPDDTRMDQFPSAKSGQATRHDDLICKENLGAIVECVTNTPTENLSFLSPAMFDDGVPNQSPVSENCQDNKQDGMDNVDHGANVVELASIIPETQHASVGGPLSTISLAALEGKTVLSHSLTWESALNEQSGVSQQYHSSAMVESPECVAESSQSIDDSTITQLCSFDMSQCIDAELGNSLIVSNNTQDTPISKYVARTHNSSCPLMQKFLHVHENIMVDQPSESLAIIELPFVKTSPMWAQIEAMEVFSKVPQRPNFHQLQQHPPEFREGIALGLMYSFTNLAESINMLNVHDDNAVFEHKMRCISVLEADGFDVRHLRSRLETLLSLKNSWSKIQDMMKRSEKKIAQEEIDDQQRCAEISVLSMVVRQLEQHAHLFRCIKNRAISQQMSHAMENSRLKVEASQLKQSSMSTEQRFSSVVAAPW

SEQ ID NO: 32015 - protein, 387 aa, Oryza sativa (japonica cultivar-group)
MARKKIREYDSKRLLKEHLKRLAGIDLQILSAQVTQSTDFTELVNQQPWLSTMKLVVKPDMLFGKRGKSGLVALNLDIAQVKEFVKERLGVEVEMGGCKAPITTFIVEPFVPHDQEYYLSIVSERLGSTISFSECGGIEIEENWDKVKTIFLSTEKPMTPDACAPLIATLPLEARGKIGDFIKGVFAVFQDLDFSFLEMNPFTIVNGEPYPLDMRGELDDTAAFKTSRSGEISNSHYHSVEFSVLQKALSMTWMRSASLKFTVLNPKGRIWTMVAGGGASVIYADTCATADPDGRKRALLIGGGIANFTDVGATFSGIIRALREKESKLKAARMHIYVRRGGPNYQTGLAKMRKLGAELGVPIEVYGPEATMTGICKQAIECVMAAA

SEQ ID NO: 32016 - protein, 458 aa, Oryza sativa (japonica cultivar-group)
MLHLRRRLLPLLRVPSSPHASASYYAHLRRLRLPLSTAAAATATPFSAEDYLVATCGLTGDQALKASKKISHLRSAANPDAVLAVLSGVGLSRADLAAVVASDPHLLCARPDNVSRRVTSLRDRVGLSDPQIGRFLLAGGAMAVRKCDVAERLEFWIPFLGGSFETLLKMLRRNNAIVRADVEKVIKPNIALFQESGLTVRDIVKMPGWLFTFNPKRVEAAVERTGKLGVELASSRLKYMLSIAGNITEGNASARMKYLSSTLNCSMDKVEYMVGKMPTIITLSEEKLRSKIEFLSSTLNCCVDKIGHMVCKEPFILAISEEKLRINTKFLSSALGCSIDNICVMVYKMPSILGLSVNNLCRKIEFLVTKVGLEPDYILSKPVLFACSLEKRLMPRHYIVEVLLAKGLIKNAGFLTYAILREKDFVARYIDQHKNAVPGLADAYATICSGKVPPELQP

SEQ ID NO: 32017 - protein, 406 aa, Oryza sativa (japonica cultivar-group)
MLRLSCCRPTAGGGLAGAMLHLLPLLRARAATHLPTSSLDLSRRRRLLLSTAARSAAATPFSVEEYLVDTCGLTGAQALKASKKLSHLRSPAKPDAVLAVLSGVGLSRADLAAVVASDPQLLCARADNIARRIASLRDRVGLSDPQIGSFLLAGGAKGIHACDVASRLEFWIPFLGSFETLLRILKGNNVLVLSDLEKVIKPNIALLQECGLTVCDIAKMARFAPRMFTSNPKQVEGFVRRADELGVPRTSGQFKYMVGIFANISEGSATARMEYLSRSLGCSMDKLRSAVQKLPQILGLSETNLGSKIEFLVGKVRLEPEYLLKTPKLFTYSLEKRLVARHYIVQVLAAKGLKGLKKDVPFCSYVQLGESCFVKNFIDQHENVVPGLSDAYAALRAGKVPPEVQH

SEQ ID NO: 32018 - protein, 388 aa, Oryza sativa (japonica cultivar-group)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 32019 - protein, 326 aa, Oryza sativa (japonica cultivar-group)
MAHFQGQQHGHPAARVDEYGNPVAAGHGITGTQEAGAGGYGAAGNVAQPQHAFGGATDAGGYGRQAGYGATGTGTHDAAGYGGSGQPAYGATGTGVHDAGGLMPGHTAGHGTTGTGVHHGAGAGLPAGQTAGYGTTGVTGAQHGAGGLGTGHTAGYGTTGAHHGAGGLGTRHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 32020 - protein, 105 aa, Medicago sativa
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 32021 - protein, 242 aa, Oryza sativa (japonica cultivar-group)
MASHQRSASLPSRLHSTESNVEEELHGLRSCISSPSATIGTMCDGLRRLGEVYNSIEEIMFLPSNQAGISLHQQRKMVEEELDMSLLLIDLCNAMQESLSEMKMSIHELQLLLKRGDSVAVHNKIESFVRLAKKAQKMPFKKTSIGAISESCKMIRLLGEAREMAVSVLESTSLLLPKQIAKNSASKWSLVSKRFQRRNVVVCEEQQLQELEHSMGDLEDGAEFLFRRLIQIRVSLLNILSS

SEQ ID NO: 32022 - protein, 240 aa, Oryza sativa (japonica cultivar-group)
MVMRKHLSMVAFNNITRLTFGKRFIDAAGELDEQGSELKAIVNNGIKIGASLTIAEHIRVLRWLNPVDEELYNAHSARRDRFTRRIMDEHARELERHGAKQHFVDALFTLRDKYDLSDDTVIGLLCDMIAAGTDTTVITVEWAMAELVRNPRVQMKAQEELDRVIGRGRVMLEADIPNLPYLQAVVKESFRLHPPTPLMLPHKASTSVKIAGYDVPKDASVVVNVWAVARDPGVWDNPLE

SEQ ID NO: 32023 - protein, 354 aa, Lycopersicon esculentum
MVSDSIVNVAIPVASSNSRDFGKKKRANRTAKLKQSKRDARREQWLSQGKNKVSKQELNGGGGVCEQGMQVTNEKGQLMKKFAIKPRGEAEESGGYMNTYSDFDSPSNSPTSHTSSVLEGNYSGTNFTGGSGSSSSSSSGGFSSSGGCCSVSMSEEDNEGDDDCLDDWEAVADALAATDKEQEQHNSSLDSAPQVHMSFQQEVSDGKVPALDTSQQNPKGRGTIPVFPVSFQAWRPDDEFRPQSLPNLSKQYTFPMNSGRHCRGGSVWGCKSAAIPTSCPICCEDLDFTDTSFLPCPCGFRLCLFCHKKILEEDGRCPACRKQYKHDTVGGETTKDAGGLMFKVARSCSMISRS

SEQ ID NO: 32024 - protein, 243 aa, Oryza sativa (japonica cultivar-group)
MAAAANLEDVPSMDLMNELLRRMKCSSKPDKRLILVGPPGSGKGTQSPIIKDEYCLCHLATGDMLRAAVAAKTPLGVKAKEAMDKGELVSDDLVVGIIDEAMKKPSCQKGFILDGFPRTVVQAQKLDEMLEKKGTKVDKVLNFAIDDSILEERITGRWIHPSSGRSYHTKFAPPKVPGVDDVTGEPLIQRKDDTAEVLKSRLEAFHKQTEPVIDYYSKKALVANLHAEKPPKEVTAEVQKVLS

SEQ ID NO: 32025 - protein, 172 aa, Oryza sativa (japonica cultivar-group)
MEHQGQHGHVTSRVDEYGNPVGTGAGHGQMGTAGMGTHGTTGGMGTHGTTGGMGTHGTTGTGGGQFQPMREEHKTGGVLQRSGSSSSSSSEDDGMGGRRKKGIKEKIKEKLPGGNKGEQQHAMGGTGGAYGQQGHGTGMTTGTTGAHGTTTTDTGEKKGIMDKIKEKLPGQH

SEQ ID NO: 32026 - protein, 164 aa, Oryza sativa (japonica cultivar-group)
MDNYQGQHGYGADRVDVYGNPVGAGQYGGGATAPGGGHGAMGMGGHAGAGAGGQFQPAREDHKTGGILHRSGSSSSSSSSEDDGMGGRRKKGIKEKIKEKLPGGNKGNNHQQQQMMGNTGGAYGQQGHAGMTGAGTGVHGAEYGNAGEKKGFMDKIKEKLPGQH

SEQ ID NO: 32027 - protein, 164 aa, Oryza sativa (japonica cultivar-group)
MENYQGQHGYGADRVDVYGNPVAGQYGGGATAPGGGHGVMGMGGHHAGAGGQFQPVKEEHKTGGILHRSGSSSSSSSSEDDGMGGRRKKGIKEKIKEKLPGGNKGNNQQQQQMMGNTGGAYGQQGHAGMTGAGTGTGVHGAEYGNTGEKKGFMDKIKEKLPGQH

SEQ ID NO: 32028 - protein, 184 aa, Oryza sativa (japonica cultivar-group)
MSRDPLVVGHVVGDIVDPFVTTASLRVFYNSKEMTNGSELKPSQVLNQPRIYIEGRDMRTLYTLVMVDPDAPSPSNPTKREYLHWMVTDIPETTDARFGNEIVPYESPRPTAGIHRFVFILFRQSVRQTTYAPGWRQNFNTRDFAELYNLGSPVAALFFNCQRENGCGGRRKLELRIVPIDYMV

SEQ ID NO: 32029 - protein, 438 aa, Oryza sativa (japonica cultivar-group)
METSSSRGRSGSAGLKRRRGPGGGGGGSGSTAQALNDDTLRSVFSRLDDHFDLARCSTVCNSWNRVIDTAHLMRDLYYKRNPQARSSGSNTSIKSYFKELALDEHASSFSRGPAEVYQWIGHPNQATICRMKSGSILTGVGDKTLRLWSAESCKYMNEYIVPSSKMLVNFDFDENKIVGLTSSQLCIWRRSEPRSIFQSRGASFNRGLCMSYADPEVIIGCEDGRAFVYDMYSRSCSSIYRLHSSPLTCLTITDDQLIAAGSTFGNVAIADQTSGQKLGVLKSAFAPTAIRCLSFSTSGHLIFAGSSAGYAHCWDLRTLRPLWEKRVSPNVIYSAHHLPGDTATLAVGGIDGVLRLICQRTGETIRSFIVNADRPAASSSHQQVEKKSVRQVAPNARLDNIPTRLRPQITCLAVGMKKIVTTHGENYIRVWKFRPKSS

SEQ ID NO: 32030 - protein, 494 aa, Oryza sativa (japonica cultivar-group)
MAEEEVAAVVGELRGSFRSGRTRAAEWRAAQLRGIVRMVEEREGDISDALHSDLAKPRMESYLHEISLAKAACTFALKGLKNWMKPEKMLIMLTLINDDQVPAALTTFPSTAQIVSEPLGVVLVISAWNYPFLLSIDPVIGAIAAGNAVVLKPSEIAPATSALFAKLLPEYVDSSCIKVVEGGVPETTALLEQKWDKIFYTGSGNVGRIVMAAAAKHLTPVALELGGKCPAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 32031 - protein, 325 aa, Oryza sativa (japonica cultivar-group)
MARKKIREYDSKRLLKEHLKRLAGIDLQILSAQVTQSTDFTELVNQQPWLSTMKLVVKPDMLFGKRGKSGLVALNLDIAQVKEFVKERLGVEVEMGGCKAPITTFIVEPFVPHDQEYYLSIVSERLGSTISFSECGGIEIEENWDKVKTIFLSTEKPMTPDACAPLIATLPLEARGKIGDFIKGVFAVFQDLDFSFLEMNPFTIVNGEPYPLDMRGELDDTAAFKTSRSGEISNSHYHSVEFSVLQKALSMTWMRSASLKFTVLNPKGRIWTMVAGGGASVIYADTCATADPDGRKRALLIGGGIANFTDVGATFSGIIRALREK

SEQ ID NO: 32032 - protein, 329 aa, Streptomyces aizunensis
MTAHPNGVTPPLPPTETDRTLHFAGPATFGRIPRIDQVEKTDIAVVGVPFDSGVTYRPGARFGGNAIREASRTLRPYNPAQNVYPFHFSQVADAGDISANPFDLNDAVETIEAAADDLISSGARLMTLGGDHTIALPMLRAVAKKHGPLAVLHFDAHLDTWDDYFGQQYTHGMPFRRAVEEGILDTSALSHVGTRGPIYGKKDLDDDEKLGFGIVTSADVMRRGVDEVAQQLRERVGDRPLYISIDIDVLDPAHAPGTGTPEAGGLTSRELLEILRGLADCHLVSADIVEVAPAYDHADITSVAASHAAYELISIMSKQIAPVRWGATQ

SEQ ID NO: 32033 - protein, 506 aa, Streptomyces aizunensis
MTRSVAAVLAESAGRWPSRTALVCGAERISYARLWDRARRYAAALRGQGIGPDDKVALLMPNTPEFAAVYFAVLALGAVVVPVHTLLKPAEVSHLLRDSGARALVWAGTLPQETARDAGETGVLLLTVGEALHGSVLLDDGVEPIDTYVERGADDLALVLYTSGTTGRPKGAMLTHGNVATNIAVTAVSPFAFGEDDVLLGALPLSHTFGQICGMAVTFHAGATLVVMERFEAHDALRLMREHGCTVFMGVPTMYHALLEAVAAGAPAPRLTRVYSGGSALPVPVLDRVRAAFGCEVYEGYGLTETSPCVAYNQPGIPCKPGTVGLPIDGVRVAIADAELEGRIRLLKQGDIGEIVVSGHNVMAGYLGRPQETAEVLVDGWFRTGDMGVQDEDGYLSIVDRKKDMIVRGGYNVYPREVEDVLLRHPAVDGACVVGVPSVKHGEEVCAVVRVKPGQRASGLLAEEIVAWSRVHMAAYKYPRRVEFVETFPLGSSGKVLKRELAHRYA

SEQ ID NO: 32034 - protein, 447 aa, Paenibacillus polymyxa
TIFQFPQDFMWGTATAAYQIEGAYQEDGRGLSIWDTFAHTPGKVFNGDNGNVACDSYHRYEEDIRLMKELGIRTYRFSVSWPRIFPNGDGEVNQEGLDYYHRVVDLLNDNGIEPFCTLYHWDLPQALQDAGGWGNRRTIQAFVQFAETMFREFHGKIQHWLTFNEPWCIAFLSNMLGVHAPGLTNLQTAIDVGHHLLVAHGLSVRRFRELGTSGQIGIAPNVSWAVPYSTSEEDKAACARTISLHSDWFLQPIYQGSYPQFLVDWFAEQGATVPIQDGDMDIIGEPIDMIGINYYSMSVNRFNPEAGFLQSEEINMGLPVTDIGWPVESRGLYEVLHYLQKYGNIDIYITENGACINDEVVNGKVQDDRRISYMQQHLVQVHRAIHDGLHVKGYMAWSLLDNFEWAEGYNMRFGMIHVDFRTQVRTPKQSYYWYRNVVGNNWLETRR

SEQ ID NO: 32035 - protein, 494 aa, Thermotoga maritima MSB8
MGSDKIHHHHHHMKEALTFDDVLLVPQYSEVLPKDVKIDTRLTRQIRINIPLVSAAMDTVTEAALAKALAREGGIGIIHKNLTPDEQARQVSIVKKTENGIIYDPITVTPDMTVKEAIDLMAEYKIGGLPVVDEEGRLVGLLTNRDVRFEKNLSKKIKDLMTPREKLIVAPPDISLEKAKEILHQHRIEKLPLVSKDNKLVGLITIKDIMSVIEHPNAARDEKGRLLVGAAVGTSPETMERVEKLVKAGVDVIVIDTAHGHSRRVIETLEMIKADYPDLPVVAGNVATPEGTEALIKAGADAVKVGVGPGSICTTRVVAGVGVPQLTAVMECSEVARKYDVPIIADGGIRYSGDIVKALAAGAESVMVGSIFAGTEEAPGETILYQGRKYKAYRGMGSLGAMRSGSADRYGQEGENKFVPEGIEGMVPYKGTVKDVVHQLVGGLRSGMGYIGARTIKELQEKAVFVKITPAGVKESHPHDIIITKESPNYWVQA

SEQ ID NO: 32036 - protein, 398 aa, Thermoplasma acidophilum DSM 1728
GGGGGGMNVFNTASDEDIKKGLASDVYFERTISAIGDKCNDLRVAMEATVSGPLDTWINFTGLDEVLKLLEGLDVDLYAIPEGTILFPRDANGLPVPFIRVEGRYCDFGMYETAILGFICQASGISTKASKVRLAAGDSPFFSFGIRRMHPAISPMIDRSAYIGGADGVSGILGAKLIDQDPVGTMPHALSIMLGDEEAWKLTLENTKNGQKSVLLIDTYMDEKFAAIKIAEMFDKVDYIRLDTPSSRRGNFEALIREVRWELALRGRSDIKIMVSGGLDENTVKKLREAGAEAFGVGTSISSAKPFDFAMDIVEVNGKPETKRGKMSGRKNVLRCTSCHRIEVVPANVQEKTCICGGSMQNLLVKYLSHGKRTSEYPRPKEIRSRSMKELEYFKDIS

SEQ ID NO: 32037 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 32038 - protein, 436 aa, Achromobacter obae
MTKALYDRDGAAIGNLQKLRFFPLAISGGRGARLIEENGRELIDLSGAWGAASLGYGHPAIVAAVSAAAANPAGATILSASNAPAVTLAERLLASFPGEGTHKIWFGHSGSDANEAAYRAIVKATGRSGVIAFAGAYHGCTVGSMAFSGHSVQADAAKADGLILLPYPDPYRPYRNDPTGDAILTLLTEKLAAVPAGSIGAAFIEPIQSDGGLIVPPDGFLRKFADICRAHGILVVCDEVKVGLARSGRLHCFEHEGFVPDILVLGKGLGGGLPLSAVIAPAEILDCASAFAMQTLHGNPISAAAGLAVLETIDRDDLPAMAERKGRLLRDGLSELAKRHPLIGDIRGRGLACGMELVCDRQSREPARAETAKLIYRAYQLGLVVYYVGMNGNVLEFTPPLTITETDIHKALDLLDRAFSELSAVSNEEIAQFAGW

SEQ ID NO: 32039 - protein, 306 aa, Gerbera hybrid cultivar
MVIQATTRVESLSTSGIRQIPKEYIRPQEELRSITNIFDEETNKQKPQVPTVDLTDIESDDPEKRHKCLEELKKAAMEWGVMHVVNHGISGDLIGRVKAAGEGFFGLPVEEKERYRNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLFYDGQWVSAQCVPDSIILHIGDTLEILSNGKYKSILHRGLVNKEKSDFLGGFL

SEQ ID NO: 32040 - protein, 355 aa, Gerbera hybrid cultivar
MVIQATTRVESLSTSGIHQIPKEYIRPQEELRSITNIFDEEANKQKPQVPTVDLTDIESDDPEKRHKCLEELKKAAMEWGVMHVVNHGVSGDLIGRVKAAGEGFFGLPVEEKEKYGNDPDGGRTQGYGSKLANNASGQLEWEDYFFHLVFPEEKRDLTIWPTTPSDYTDATTEYAKQLRALATKILPALSLGLGLEEGRLEKEVGGIEELILQLKINYYPKCPQPELALGVEAHTDVSALTFILHNMVPGLQLFYDGQWVSAQCVPDSIILHIGDALEILSNGEYKSILHRGLVNKEKVRISWAVFCEPPKEKIVLKPLPETVSEAEPPLFPPRTFRQHMEHKLFRKNKDEVMQN

SEQ ID NO: 32041 - protein, 355 aa, Gerbera hybrid cultivar
MVIQATTRVESLSTSGIHQIPKEYIRPQEELRSITNIFDEETNKQKPQVPTVDLTDIESDDPEKRHKCSEELKKAAMEWGVMHVVNHGVSGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLIYDGQWVSAQCVPDSIILRIGDTLEILSNGKYKSILHRGLVNKEKVRISWAVFCEPPKEKIVLKPLPETVSEAEPPLFPPRTFQQHMEHKLFRKNKDEVMQN

SEQ ID NO: 32042 - protein, 441 aa, Lotus corniculatus var. japonicus
MNQPKIKRRVGKYEVGRTIGEGTFAKVKFARNSETGEAVALKILDKEKVLKHKMAEQIKREVATMKLIKHPNVVQLYEVLGSKTKIYMVLEFVTGGELFDKIVNHGRMCEDEARRYFQQLINTVDYCHSRGVYHRDLKPENLLLDACGNLKVSDFGLSALSQQIKDDGLLHTTCGTPNYVAPEVLNDKGYDGATADLWSCGVILFVLVAGYLPFDDPNLMELYKKISAAEFTCPPWLSFSARKLITRILDPNPMTRITIAEILEDEWFKKDYKPPIFQENGETNLDDVEAVFKDSEEHHVTEKKEEQPTAMNAFELISMSKGLNLENLFDVEQGFKRETRFTSKSPANEIISKIEEAAKPLGFDVQKKNYKMRLANVKAGRKGNLNVATEVFQVAPSLHMVEVRKAKGDTLEFHKFYKKLSTCLEDVVWKTEDDMQKQEAK

SEQ ID NO: 32043 - protein, 426 aa, Lotus corniculatus var. japonicus
GRVLGQGNFAKVYHGRNLATNENVAIKVIKKEKLKKDRLVKQIKREVSVMRLVRHPHIVELKEVMATKGKIFLVMEYVKGGELFTKVNKGKLNEDDARKYFQQLISAVDFCHSRGVTHRDLKPENLLLDENEDLKVSDFGLSALPEQRRDDGMLVTPCGTPAYVAPEVLKKKGYDGSKADIWSCGVILYALLSGYLPFQGENVMRIYRKAFKAEYEFPEWISPQAKNLISNLLVADPEKRYSIPEIISDPWFQYGFMRPLAFSMKESAVGEDSTIDHFGGEEEEVPELVAAMGKPARPFYNAFEIISSLSHGFDLRSLFETRKRSPSMFISKYSASAVVAKLEGMAKKLNFRVTGKKEFTVRMQGMKEGRKGKLAMTMEVFEVAPEVAVVEFSKSAGDTLEYVKFCEEQVRPSLKDIVWSWQGDSN

SEQ ID NO: 32044 - protein, 367 aa, Torenia hybrida
MARAGPLTLTSLALEKSLHEKFIRDEDERPNLAYDQFSSQIPLISLSGIDDECNKRKELCKRIAQACEDWGIFQVIDHGIDLKLVNDMTRLAREFFDLPDEEKLRFDMSGGRKGGFIVSSHLQGEVVQDWREIVTYFTYPIKGRDYSLWPDKPEAWRAVTETYSSQLMCLGCKLLGILSEAMGLEREALTKACLNMDQKVVVNFYPKCPQPNLTLGLKRHSDPGLITLLFQDNVGGLQATRDGGKSWITVQPVEGAFVVNLGDFAHYLSNGRFKNADHRAVVNSNTNRMSIATFQNPSPEAIVYPLKIGDDGKPIIEKPITYGEMYKRKMAKDIELAKLKKLAKEQKLQEEVVNNVEDHHLNNGKTK

SEQ ID NO: 32045 - protein, 216 aa, Pinus resinosa
  misc_feature (151)..(151): Xaa can be any naturally occurring amino acid
  misc_feature (176)..(176): Xaa can be any naturally occurring amino acid
MEGKEEDVKLGANKYSERQPLGTAAQTREKDYTEPGPAPLFEPGELASWSFWRAGIAEFMATFLFLYITILTVMGVKRADNVCTDSVGIQGIAWAFGGMIFCLVYCTAGISGGHINPAVTFGLFLARKLSLPRAVFYMICQCLGAICGAGXVKGFMEGEYQADGGGANSVAHGYTXGDGLGAEIVGTFVLVYTVFSATDAKRSARDSHVPLLAPLP

SEQ ID NO: 32046 - protein, 148 aa, Polytrichum juniperinum
APHLLQFSRDILVNEGPRALYRGLIPSLLGIVPLTGIDLAAYETLKNMSRQFMPPDTEPGPLVHLGCGIVSGALGSTCVYPLQLVRARLQAQPLNAADRYKGMREVFSRTFQAEGIRGFYKGLLPNMLKVVPSASITYLVYEEMKTRL

SEQ ID NO: 32047 - protein, 446 aa, Lotus corniculatus var. japonicus
MKKVRRRIGKYEVGRTIGEGTFAKVKFAKNSETGESVAIKIMDKTTILKHRMVEQIKREISIMKIVRHPNIVRLHEVLSSQTKIYIILEFVMGGELYDRIVQRGKLSEDESRRYFQQLIDAVAHCHKKGVYHRDLKPENLLLDAFGNLKVSDFGLSALTKQGVDLLHTTCGTPSYVAPEVLSNQGYDGAAADVWSCGVILYVLKAGYLPFEEADLSTLYRRTSAAEFVCPSWFSTGTTTLIHKILDPNPKTRVKIGEIRKDPWFQRNYLPLKLNEDEQVNLDDVQAVFDDIEDQYVPVQSEITEGGPLVMNAFEMITLSQGLNLSPLFDRHQDYVKRQTRFVSRKPAKVIISSIKVVAESMGLKLQSRNYKMRIEGLSANKAGQFAVVLEVYEVAPCLYMVDVRKAAGDTLDYHKFYKNLCAKLENIIWRPTETMPDSGLLRQMTL

SEQ ID NO: 32048 - protein, 376 aa, Penicillium griseoroseum
MASSLKLGLIALLGATAVNAAPAAEPVLGTSLLTSRASCTFSGSSGAAEAIKSKTSCSTITLSNVEVPAGTTLDLTGLKSGTTVIFEGTTTFGYKEWEGPLVSVSGTSITVQGASGAQLNGDGARWWDGKGTNGGKTKPKFFYAHSLTNSKIENIYIKNSPVQVFSINGAKELTLSGITVDTADGDSNGGHNTDAFDVGSSNGVYITSPIVHNQDDCLAVNSGTNVHFTGAQCTGGHGISIGSVGGRSDNTVDGVTVESCTIKDSDNGVRIKTVYGATGAVQGVTYKDITLSGIAKYGIVIEQDYENGSPTGTPTSGVPITDLTLDNVHGTVASSGVDTYILCASGACSDWSWSGVSITGGQTSKKCKGIPSGASC

SEQ ID NO: 32049 - protein, 250 aa, Streptomyces griseus subsp. griseus
MNPTYRTTSRGGSMQKRIVASEFLGTLLLVFFAVGSAVVAVEYLGTVGIALTFGFTLLALAYALGPISGCHVNPAVTLGMYMAGRIDIRSAVERWVSQFLGAIVGAALLFLLAKQIPGLETSGEFGTNGYDDRSAVGINIGGAFLAEVVLTFLLVYVVLAVTHKVAVTGFDGLPIGLALAAIHLVGIPLTGTSVNPARSFGPALFAGGAALSQLWLFIVAPLVGGAIAAYAHRLTHPYPNVLPAETEDAV

SEQ ID NO: 32050 - protein, 400 aa, Streptomyces griseus subsp. griseus
MTGTGTGLTSRWQGALMDNYGTPRLPLVRGEGAHVWDEEGTRYLDFVGGIAVNALGHAHPAVVEAVSTQIASLGHVSNLFIAEPPVALAERLLQLFGRAGRVFFANSGAEANEAAFKIGRLTGRPHMVATDGGFHGRTMGALALTGQPGKQEPFRPLPGDVTHVPYGDADALRAAVTTDTALVIIEPTQGENGVVVPPKGYLEAAREITRATGTLLVLDEVQTGIGRCGQWFEHQAHQGVEPDIVTLAKGLGGGLPIGATVAFGPAADLLKPGHHGTTFGGNPVACAAGLAVIDTLAADGVLADVKRLGERIRDGVEALGHPLVSHVRGAGLLLGIVLTGPLAPQVQQAAQGAGLLVNAPAPDVVRLMPPLIIGDAEVDAFLEILPSALDAAHGDGRSGA

SEQ ID NO: 32051 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWAVHWFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNIPLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 32052 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPANTCPS

SEQ ID NO: 32053 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFPTTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 32054 - protein, 360 aa, Fusarium oxysporum f. sp. radicis-lycopersici
MFSSTVLLSGLVASVLAAPALEPRAGSWTFTDAATAIKKKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 32055 - protein, 360 aa, Fusarium oxysporum f. sp. radicis-lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKATGTVKSSGTDVYILCAHCKNWTWTNNKVTGGKTSTKCKGIPSGASC

SEQ ID NO: 32056 - protein, 360 aa, Fusarium oxysporum f. sp. radicis-lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSDGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 32057 - protein, 464 aa, Fusarium oxysporum f. sp. radicis-lycopersici
MKVSSFFSTLSLFAGVLAEAIDLPAGVPRSIEEFRAKHPFELPVKRSHRKVYTIRHSKNDNDDVSSEFYKGLKKANKGGTLYLPKGQTFVIGKPLDLTFLNDIHVHLEGEIKFTNDTEYWQKNVYKHPFQNSIMFWKWGGKNIKLYGKGVLNGNGQRWWNEFAGKEILDTTNAYLRPILFYAQNATNLDIQGVHFKDSPCWTNFVVTSKDISFKDVICTARSTNATALPKNTDFFDSLNVENLSVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGKYGNAVAKLTCSTSKDAVRENIKFKDFNIKTPCGGDPVFLCDGVKDIGVDCVSATSAAGKAALANKCVAPQASASPFKVRKFNG

SEQ ID NO: 32058 - protein, 464 aa, Fusarium oxysporum f. sp. radicis-lycopersici
MKVSSFFSTRSLFAGVLAEAIDLPAGVPRSIEEFRAKHPYELPVKRSHRKVYTIRHSKNDNDDVSSEFYKGLKKANKGGTLYLPKGQTFVIGKPLDLTFLNDIHVHLEGEIKFTNDTEYWQKNVYKHPFQNSIMFWKWGGKNIKLYGKGVLNGNGQRWWNGFAGKEILDTTNAYLRPILFYAQNATNLDIQGVHFKDSPCWTNFVVTSKDISFKDVICTARSTNATALPKNTDFFDSLNVENLNVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGKYGNAVAKLTCSTSKDAVCENIKFKDFNIKTPCGGDPVFLCDGVKDIGVDCVSATSTAGKAALANKCVAPQASASPFKVRKFNG

SEQ ID NO: 32059 - protein, 464 aa, Fusarium oxysporum f. sp. radicis-lycopersici
MKVSSFFSTLSLFAGVLAEAIDLPAGVPRSIEEFRAKHPYELPVKRSHRKVYTIRHSKNDNDDVSSEFYKGLKKANKGGTLYLPKGQTFVIGKPLDLTFLNDIHVHLEGEIKFTNDTEYWQKNAYKHPFQNSIMFWKWGGKNIKLYGKGVLNGNGQRWWNEFAGKEILDTTNAYLRPILFYAQDATNLDIQGVHFKDSPCWTNFVVTSKDISFKDVICTGRSTNATALPKNTDFFDSLNVENLNVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGEYGNAVAKLTCSTSKDAVCENIKFKDFNIKTPCGGDPVFLCDGVKDIGVDCVSATSTAGKAALANKCVAPQASASPFRVRKFTG

SEQ ID NO: 32060 - protein, 464 aa, Fusarium oxysporum f. sp. radicis-lycopersici
MKVSSFFSTLSLFAGVLAEAIDLPAGVPRSIEEFRAKHPYELPVKRSHRKVYTIRHSKNDNDDVSSEFYKGLKKANKGGTLYLPKGQTFVIGKPLDLTFLNDIHVHLEGEIKFTNDTEYWQKNAYKHPFQNSIMFWKWGGKNIKLYGKGVLNGNGQRWWNEFAGKEILDTTNAYLRPILFYAQNATNLDIQGVHFKDSPCWTNFVVTSKDISFKDVICTARSTNATALPKNTDFFDSLNVENLNVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGKYGNAVAKLTCSTSKDAVCENIKFKDFNIKTPCGGDPVFLCDGVKDIGVDCVSATSTAGKAALANKCVAPQASASPFRVRKFNG

SEQ ID NO: 32061 - protein, 455 aa, Fusarium oxysporum f. sp. radicis-lycopersici
MLFNNVISAVAVSALVSSVVGTSSRNSALPTRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLDLEAKSLNGVKIPNSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDATNG

SEQ ID NO: 32062 - protein, 455 aa, Fusarium oxysporum f. sp. radicis-lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGFLVCSAPDRCSNIVAEDIKVQVPSKKPPVYDCQNIDTSTLDITCRDPTNARDTTNG

SEQ ID NO: 32063 - protein, 455 aa, Fusarium oxysporum f. sp. radicis-lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQILLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 32064 - protein, 368 aa, Mycoplasma hyopneumoniae
MAKQDFYKILGVEKSASLTEIKKAYRNLVNIYHPDKNTKKSAEEQKQAEAKFKEIQEAYEILSDETKRKQYDKFGHAAFDQQFGGGSSGFSGFDFGDIFSSFTSGFGFGGSQEQKYSRPLKGENFQAKIYISFIESILGKEISQKLTKYDQCDNCKGSGANSSSDITTCYNCQGRGMQTEVLNIPGFGRVQNKTTCSVCLGSGKNITKNCKKCRGKTIVETKEEVTIKIPAGIQDGMFIRVAGFGGPGHKGGPSGDLHLEINVRQHKHFTRSGNDIHVNMPVSIIDVINQNTVEVPSPTGLKKVRLYDYYKSGQIVNVLRAGAPDPKNPRIIGDLKVHLIFYIPEFSPRQKDDLNQVFAQINDKTKAK

SEQ ID NO: 32065 - protein, 371 aa, Bacillus cereus ATCC 10987
MSKRDYYEVLGLSKGASKDEIKKAYRRLAKKYHPDVSKEENAIEKFKEVQEAYEVLSDDQKRAQYDQFGHAGANQGFGGFGGGGDFGGGFGFEDIFSSFFGGGGGRRRDPNAPRQGADLQYQVTLDFEEAIFGKELNVEIPVEDPCDTCKGSGAKPGTSKETCKHCSGSGQVSVEQNTPFGRIVNRQACGHCSGTGQIIKEKCTTCHGSGKVRKRKKINVKIPAGIDNGQQIRVSGKGEAGVNGGPAGDLYVVVHVRNHEFFEREGDHIICEMPLTFAQMALGDEVEVPTVHGKVKLKIPAGTQTGTEFRLKGKGAPNVRGYGQGDQYVVVRVVVPTKLTSQQKDLLREFAGQEEQDDSLFGKLKRAFKGE

SEQ ID NO: 32066 - protein, 391 aa, Mycoplasma gallisepticum
MSSKRDYYEILEVSRSATQQDIKKAFRKLAMKYHPDRNKDSDAEEKFKEVNEAYEVLSDEEKRKLYDTYGHEGLNASGFHQGGFNPYDVFNSVFSGFDFEGGFGDVFSQFFGGGGSGFHNQEYIEEVDVNLVHEIKINFLEAANGCIKNVKYTRQVTCPDCNGSGSADGDVITCSDCNGEGFLVEQRRTLLGMFQTKKTCPSCKGEGQTIKNKCKKCKSRRMVDEVVERKVSIDSNVFYQDVVIVRGEGHIYKNLVGDLFLRVKIEPSRVFELRDNHVVVNVLVDPLVAITGGTILIPTLKEIKEINLKAGTKNGDIITIANGGINLKLDSRVYGANYNQKGDLIVVINYARPSEYSKQEITKLKEFIKPNKEVNLYETLMKKELNNKDSQ

SEQ ID NO: 32067 - protein, 387 aa, Clostridium perfringens
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCHGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPHVNGGGRGNQYVHMVVEVPKHLNKEQEEALKAFMKASGESVDDIDEKDEGFFSKFKKKK

SEQ ID NO: 32068 - protein, 377 aa, Mycoplasma pulmonis
MNKKEDYYKILGIDKSANEKEIKKAYRKLAMEHHPDRSSSKESEAKMREINEAYEVLSNPEKKAIYDKYGHEAANNPGFNGFNAGSAGFGNFGGFSNFGGFDSIFEEFFGGSRSHSKQNSNYPYPGESYSTQVKISFLDSVHGRVISQKLDKYKDCESCNGTGARSKSDIKTCSTCNGRGSVEKLVNSLFGKIKQSVTCSTCNGLGQEITHKCPSCKGAKKIKESISQKISIPAGVISGQEVLLRGFGGPGFNGGPNGDLYIRVYVTEHPYYQRINDDIYVDFPISIVNLILEKPVVVPTPYGDEKIKIKSTFKNDQIITFKGKGFKRKNRVGDLKIRLKFEIPNFSSKVKKNLESLLSETNDSINEDFVKKVNSIK

SEQ ID NO: 32069 - protein, 380 aa, Geobacillus thermoglucosidasius
MAKRDYYEILGVSKNATKEEIKKAYRKLSKKYHPDINKEPDAAEKFKEIKEAYEVLSDDQKRAHYDQFGHADPNQGFGGFRSDDFDFGGFSGFSGFDDIFSTFFGGGRRRDPNAPRAGADLQYTMTLTFEEAVFGKETDIEIPREETCNTCHGTGAKPGTKKETCSYCHGTGQISTEQSTPFGRIVNRRTCPYCGGTGQYIKERCTTCGGTGRVKRRKKIHVKIPAGIDDGQQLRVAGQGEPGINGGPPGDLYIVFHVEPHEFFERDGDDIYCEIPLTFAQAALGDEIEVPTLHGKVRLKIPAGTQTGTKFRLKGKGVPNVRGYGYGDQHVIVRVVTPTKLTEKQKQLLREFDQLGGSSMHQGPHGRFFEKVKKAFKGES

SEQ ID NO: 32070 - protein, 381 aa, Mycobacterium avium subsp. paratuberculosis
MARDYYGLLGVSRGASDAEIKRAYRKLARELHPDVNPDEAAQAKFKEISVAYEVLSDPEKRRIVDLGGDPLEGAAAAGGGFGGFGGLGDVFEAFFGGGFGGGTTSRGPIGRVRPGSDSLLRMRLDLEECATGVTKQVTVDTAVLCDRCHGKGTNGDSAPVPCDTCGGRGEVQTVQRSLLGQVMTSRPCPTCRGVGVVIPDPCHQCMGDGRVRARREISVKIPAGVGDGMRVRLAAQGEVGPGGGPAGDLYVEVHEQPHDVFVREGDDLHCTVSVPMVDAALGATVTVDAILDGVSEITIPPGTQPGSVITLRGHGMPHLRSGTRGDLHVHVEVVVPSRLDARDTELLREFKGRRGRDVPEVRSTHAGGGLFSRLRETFTGR

SEQ ID NO: 32071 - protein, 375 aa, Zymomonas mobilis
MSELDYYSLLEVERTADDKTIKTSYRRLAMRYHPDRNPGDSDAEERFKAISEAYDCLKDPQKRAAYDRYGKDAFQGGGGFGGFGGGAQDFGGFSDIFESVFGEFMGGRGQARSSVQRGADLRYDLKISLEEAFKGKTVDIEIDVASVCDACHGSGAKAGSGRKTCDTCHGSGRIRVQQGFFVVEQSCPVCQGKGEVISDPCPECHGEGRCEKHKTLSVNIPAGVDDGTRIRLSGEGEAGVHGGPAGDLYIFIHVTPHQVFQRESYNLFAHVPISFTKAALGGSIHVPSLDGEQYEISIPAGIQSGKQLKRRGAGMPVLNGRGRGDLIIQIDVETPTRLTAKQRELLEQFRETETGEECPKSSGFFSKLKTILTGE

SEQ ID NO: 32072 - protein, 374 aa, Wigglesworthia glossinidia endosymbiont of Glossina brevipalpis
MAKSDYYDILGISKNASDREIKTAYKRLAVKFHPDRNPGNLEAESKFKEIKEAYEVLLDPKKRAAYNQYGHTAFDQGSSNTEFTSNADFSDIFGDVFGDIFGNNRRKRSNRGSDLQYNINLSLEEAVKGISKEITIPKLERCNICSGKGMQPGTSAQNCSTCNGQGQIQMRQGFFSVQQTCPSCRGKCKIIRFPCRNCSGQGRVERSKNISIRIPAGVDNGDKIRLSGEGEAGKLGGSSGDLYVKISVKEHPIFKREEHNLYCEVPINFAMAALGGDIEVPALDGRVKLRIPAETQTGRLFRMRGKGVKSIRSGHQGDLLCRVVVETPVRLSEKQKSLLKELGISFVGRTGMYNSPRSKSFFDGVKKFFDGLTN

SEQ ID NO: 32073 - protein, 386 aa, Tetragenococcus halophilus
MATKRDYYEVLGVDKGASDDEIKKAYRKLSKKYHPDVNQEADAEEKFKKFQKPMNTLSDPQKRAAYDQYGHAGADANFGGGGAGGFGGFGGGFSDAGGFGGFEDIFESFFGGGRSADPNAPRQGDDLQYSINLTFEEAVFGKDTEVSYKRNEVCHTCGGNGAKPGTQPETCHKCKGSGTINAERQTPLGRVMTRQTCDVCHGTGKEIKEVCETCHGTGHEKKTHSVNVSVPAGVEDGQQMRLANQGEAGTNGGPYGDLYVVLYCSHETCNIFDRDGSEIYYELPINFVQAALGDEVDVPTVHGNVKLKIPAGTQTSTKFRLRGKGAPRLRGNSTGDQQVTVKIITPKNLNEEQREALRNFAELTGQSTEEQQSEGFFDKMKDAFKK

SEQ ID NO: 32074 - protein, 311 aa, Streptomyces anulatus
RRIAGLLVAPLLLLSAVACGSDDKASDSASSKNGVPAITAGAKFGEKPTLSKGEGDPPKELKTDVISEGDGAKLKNGDAIQVNYLGQAWDSTKPFDNSFDRKQPFDLTLGAGMVIQGWDKGLVGQKVGSRVELVIPPELGYGEQGQGDIKPNATLVFVVDILKATQIPASAKGTEVAQDNVDLPKVGVKTDGKAPTVTIPKSDPPKKLVSNYVLESDGEVVKESDSVVVNYVGMIWKGAKEFDNTYTTGKTQTFPLSQVTLKGLKNGLIDKKVGSRVLLVIPPDQAFGDQQQQAIPKNSTLVFAVDILAKV

SEQ ID NO: 32075 - protein, 285 aa, Phaseolus vulgaris
MAKDVEVQEQGEYAAKDYQDPPPAPLFDPEELTQWSFYRALIAEFIATLLFLYVTVLTIIGYKRQTDANVGGTECDGVGILGIAWAFGGMIFILVYCTAGISGGHINPAVTFGLFLGRKVSLIRALLYIVAQCAGAICGTGLAKGFQKAYYNRCGGGANSVADGYNKGTALGAEIIGTFALVYTVFSATDPKRNARDSHVPVLAPLPIGFAVFMVHLATIPVTGAGINPARSFGAAVIYNNEKIWDDQWIFWVGPIIGAAVAAFYHQYILRAAAIKALGSFRSNA

SEQ ID NO: 32076 - protein, 107 aa, Phaseolus lunatus
NEINLGDYKGRVLIIVNVASQCGLTNSNCTELSQLYEKYKQKGLEILAFPCNQFGAQEPGSNEQIQEFVCTRFKAEFPVFDKVDVNGDKADPLYKYLKSSKGGLFGD

SEQ ID NO: 32077 - protein, 500 aa, Streptomyces cinnamonensis
MTKTVNHWIGGKAVEGASGNHGPVTDPATGAVTTQVAFASVDEVDAAVGAAREAFATWGTSSLAKRTAILFKFRALLDANRDAIAELIVAEHGKVHSDALGEVARGLEIVDLACGITVQLKGELSTEVASRVDVSSIRQPLGVVAGITPFNFPAMVPMWMFPLAIACGNTFVLKPSEKDPSASMKIAELLSEAGLPDGVFNVVHGDKVAVDRLLEHPDVAAVSFVGSTPIARHIHATASANGKRVQALGGAKNHMLVLPDADLDAAADAAVSAAYGSAGERCMAISAVVAVGSIADELVAKIKERAEKIKIGPGNDPTSEMGPLITAAHRDKVASYVTGAAAEGCEVVLDGTGYTVEGYEDGHWIGLSLLDRVPTTAKAYRDEIFGPVLCVLRVDTYDEGVALMNASPFGNGTAIFTRDGGAARRFQLEIEAGMVGVNVPIPVPVGYHSFGGWKDSLFGDHHIYGNDGTHFYTRGKVVTTRWPDPSDAPAGVDLGFPRNH

SEQ ID NO: 32078 - protein, 240 aa, Gibberella fujikuroi
QLRARRASTLVPSHRPSVTATPTRHHAALAVGGSGPAVNRAHARAVSSAAQPEQEPASSSAPPSTHYDLFPETLPDGPPPAGHFPIDTRALRREFLRLQARAHPDMHPTQDKARAEAMSARINEAYKTLSNPLLRAQYLLSLRGVDVANDETLKVEEPELLMLVLEAREEIEDAEHEEDLDEPRAANDARIVESEQVLERAFQHDDIEAAKHEAVRLRYWVNIKESLDNWERGHHVVLQH

SEQ ID NO: 32079 - protein, 377 aa, Lactobacillus sanfranciscensis
MADKNYYDILGISKDATDKDISHAYRHLSKKYHPDINKEPGAEAKFKEITEAYEALSDKQKRANYDQYGSADGPQGFGGGGQGGGFGGGANYGDFSDIFSDLFGGGRRQRQDPTAPRRGEDLQYQLNLTFDEAIFGAKKTITYHRQAQCPDCHGTGAKPGTHPETCPDCYGSGVVMRTVNTPMGQMQTQTACPKCHGTGKIIKEKCPKCGGIGKIEEEHKVEVNVPAGVEEGQQMRLQGQGNAGENGGPYGDLYIIFSVSPSKEFRRNGSTIYYDKTISFTDAALGNEIDVKTVYGDGKLKIPAGTQTGTVFKLRGKGAPRLHSESKGDELVKVMIDTPKKLNADQKLALRAFAEASGDKSQENKGFFEKLKDKLNK

SEQ ID NO: 32080 - protein, 482 aa, Oryza sativa (japonica cultivar-group)
MAEEEVAAVVGELRGSFRSGRTRAAEWRAAQLRGIVRMVEEREGDISDALHSDLAKPRMESYLHEISLAKAACTFALKGLKNWMKPEKVPAALTTFPSTAQIVSEPLGVVLVISAWNYPFLLSIDPVIGAIAAGNAVVLKPSEIAPATSALFAKLLPEYVDSSCIKVVEGGVPETTALLEQKWDKIFYTGSGNVGRIVMAAAAKHLTPVALELGGKCPAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 32081 - protein, 321 aa, Oryza sativa (japonica cultivar-group)
MAEEEVAAVVGELRGSFRSGRTRAAEWRAAQLRGIVRMVEEREGDISDALHSDLAKPRMESYLHEISLAKAACTFALKGLKNWMKPEKVPAALTTFPSTAQIVSEPLGVVLVISAWNYPFLLSIDPVIGAIAAGNAVVLKPSEIAPATSALFAKLLPEYVDSSCIKVVEGGVPETTALLEQKWDKIFYTGSGNVGRIVMAAAAKHLTPVALELGGKCPAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQL

SEQ ID NO: 32082 - protein, 428 aa, Cynara cardunculus
MDAQYFGEIGIGTPPQKFTVIFDTGSSNLWVPSSKCYFSVACLFHSKYRSTDSTTYKKNGKSAAIQYGTGSISGFFSQDSVKLGDLLVKEQDFIEATKEPGITFLAAKFDGILGLGFQEISVGDAVPVWYTMLNQGLVQEPVFSFWLNRNADEQEGGELVFGGVDPNHFKGEHTYVPVTQKGYWQFEMGDVLIGDKTTGFCASGCAAIADSGTSLLAGTTTIVTQINQAIGAAGVMSQQCKSLVDQYGKSMIEMLLSEEQPEKICSQMKLCSFDGSHDTSMIIESVVDKSKGKSSGLHDEMCTMCQMAVVWMQNQIRQNETEENIINYVDKLCERLPSPMGESAVDCSSLSSMPNIAFTVGGKTFNLSPEQYVLKVGEGATAQCISGFTAMDVAPPHGPLWILGDVFMGQYHTVFDYGNLRVGFAEAA

SEQ ID NO: 32083 - protein, 441 aa, Nostoc commune
MLERMYNQGAVEGAANTELGSRIFLYEVVGLRQSEETDQTNYPIRKSGSVFIRVPYNRMNQEMRRITRLGGTIVSIQPATALQPVNGKASLGNATSEVSELATSGETANTEGNGKATPVNAHSAEEQNKDKKGNTMTQAKAKKDHGDVPVNTYRPNAPFIGKVISNEPLVKEGGIGIVQHLKFDLSGSNLKYIEGQSIGIIPPGLDKNGKPEKLRLYSIASTRHGDDVDDKTVSLCVRQLEYKHPETSETVYGVCSTHLCFLKPGEEVKITGPVGKEMLLPNDPDANVIMMATGTGIAPMRAYLWRQFKDAERAANPEYQFKGFSWLIFGVPTTPNLLYKEELEEIQQKYPDNFRLTAAISREQKNPQGGRMYIQDRVAEHADELWQLIKNEKTHTYICGLRGMEEGIDAALTAAAVKEGVTWSVYQKELKKAGRWHVETY

SEQ ID NO: 32084 - protein, 112 aa, Prunus persica
KVLVIGGGDGGVLREVARYSSIEQIDICEIDKMVVDVSKQFFPAVAVGYEDPRVKLHVGDGVAFLKAVPAGTYDAVIVDSSDPIGPAQELLEKPFFQTVANALRPGGVVTTQ

SEQ ID NO: 32085 - protein, 103 aa, Prunus persica
ECAYQEMIALLPLCSIPSPKTVLVVGGGDGGVLREVSRHPSVEHIDICEIDKMVVDVSKKFFPQLAVGFQDPRVHLHIGDATEFLRHAPKGKYDAVIVDSSDP

SEQ ID NO: 32086 - protein, 162 aa, Eucommia ulmoides
RATFATCNPQKDLIDPAVKGSVNVLGSCAKSPSVKRVVLTSSVAAVAINSRPKNPDVVVDETWHSDVEFCTQRKLWYVLSKTLAEDAAWKFAKEKGLDLVTINPAMVIGPLLQPSLNTSASAILNFLNGAKTYPNSSMGWIDVRNVANAHIQAFEIPSATGR

SEQ ID NO: 32087 - protein, 336 aa, Sinorhizobium fredii
MLHTTVTQLIGQTPVMSIDVPGRNATLVLKIEKNNPGGSMKDRMARSMVVAALEDGRLAPGGTIVESSSGNTGTGLALAALEFGLRFIAVVDHHAAPEKIRMMRALGAEIRYVEGDFRDDEVAVVERQRLAAQLGAQLPGALFMNQSDNPANPEGYAGLVDELVAQLPGGIDAFVGCVGTGGSMTGISQRLKRHNPAVRTIAVEPAGSIVFGKPGHPYYQSGTGTPAGDEVGKVLDYGCIDEGVQVTDTQAFETARYIARRKGLLVGGSTGGAIYKPPEFIAAGTLTGTVVTTVADGGEKYLGTIFDEEWMAKRRLLDPAIAAQLDGWLFGKARAA

SEQ ID NO: 32088 - protein, 399 aa, Hevea brasiliensis
MAETGTEGTGITTLFSPYKMGKFSLSHRVVLAPMTRCRALNGIPNAALVDYYTQRSTPGGFLITEGTLVSPTAPGFPHVPGIYTEEQAEAWKRVVDAVHAKGSIIFCQLWHVGRASHQVYQPNGAAPISSTGKAISNRWRILMPDGSYGKYPTPRPLETPEILEVVKNYRQSALNAIRAGFDGIEVHGAHGYLIDQFLKDGINDRTDEYGGSINNRCRFLMQVIQAVVAAIGADRVGFRMSPAIDHLDAIDSDPLNLGLAVIERLNKLQLNLGSKLTYLHVTQPRYTAYGQTESGRHGTEEEEARLMRTWRRAYKGTFICSGGFTRELGMEAIAQDDADLVSYGRLFISNPDLVLRFKLNAPLNKYVRKTFYTQDPVVGYTDYPFFRKVDGSQEPRSRL

SEQ ID NO: 32089 - protein, 294 aa, Pisum sativum
MTGILAGAAAISGAQRSIITAINTGASSLSFVGSAFIVLCYCIYKDINKYTFKLVFYLALSDMLCSFFLIVGDPSKAYLSFAQGYTTHFFCVASFLWTTTIAFTLHRTILKHKSQANDLEAMFHLYVWGTSLVVTVIRSFGEEHTCIAPWCWSDSAILAKAVHFLTFYAPLWGAILYNGFTYFDLLEMIEQGNNMGLATTQNAQDAQRNGELKVLNRWGYYPLILIGSWAFGTINRIHEYLNPAHKIFWLSVLDVGTAALMGLFNSIAYAFRTSLNNGLGNRELLYIPDNIYRW

SEQ ID NO: 32090 - protein, 354 aa, Oncidium cv. 'Gower Ramsey'
MGIENKGTVAVTGASGYVGSWLVMKLLQKGYEVRATVRDPTNFEKVKPLLDLKGSNELLSIWKADLNDINESFDDVTRGCVGIFHVATPMNFQSKDPENEVIKPAINGMLGILRSCKRAGTVKRVIFTSSAGTVNVEEHQAEVYDESSWSDLEYITRVKMTGWMYFLSKTLAEKAAWEFVRDNDIHFITIIPTLVMGSFLISGMPPSMITALSLITGNEAHYSIIKQAQFVHLDDLCDAHIFLFEHPEANGRYICSSHDSTIYGLAKKLKNRYVTYAIPQKFKDIDPDIKSVSFSSKKLMDLGFKYKYTMEEMFDDAIKACRDKNLIPLNTEKMVSAAEKFNEIKEKFCLVNNE

SEQ ID NO: 32091 - protein, 334 aa, Oncidium cv. 'Gower Ramsey'
MRSGLQSEIQVSNISNCNFIANFEKVKPLLDLKGSNELLSIWKADLNDINESFDDVTRGCVGIFHVATPMNFQSKDPENEVIKPAINGMLGILRSCKRAGTVKRVIFTSSAGTVNVEEHQAEVYDESSWSDLEYITRVKMTGWMYFLSKTLAEKAAWEFVRDNDIHFITIIPTLVMGSFLISGMPPSMITALSLITGNEAHYSIIKQAQFVHLDDLCDAHIFLFEHPEANGRYICSSHDSTIYGLAKKLKNRYVTYAIPQKFKDIDPDIKSVSFSSKKLMDLGFKYKYTMEEMFDDAIKACRDKNLIPLNTEKMVSAAEKFNEIKEKFCLVNNE

SEQ ID NO: 32092 - protein, 354 aa, Oncidium cv. 'Gower Ramsey'
MGIENKGTVAVTGASGYVGSWLVMKLLQKGYEVRATVRDPTNFEKVKPLLDLKGSNELLSIWKADLNDINESFDDVTRGCVGIFHVATPMNFQSKDPENEVIKPAINGMLGILRSCKRAGTVKRVIFTSSAGTVNVEEHLAEVYDESSWSDLDFITRVKMTGWMYFLSKTLAEKAAWEFVRDNDIHFITIIPTLVVGSFLISGMPPSMITALSLITGNEAHYSIIKQAQFVHLDDLCDAHIFLFEHPEANGRYICSSHDSTIYGLAKKLKNRYVTYAIPQKFKDIDPDIKSVSFSSKKLMDLGFKYKYTMEEMFDDAIKSCRDKNLIPLNTEKMVSAADKFNEIKEKFCLVNNE

SEQ ID NO: 32093 - protein, 495 aa, Eschscholzia californica
MEEMKFLIMNNPWVLFATSATLLISIFLFFRRKSPNMAWPEGPKTLPIIGNMHLLGGTALQVVLYNLAKVHGRVMTIWIGSWRPVIVVSDIEQAWEVLVNKSSDYSARDMPDITKIVTADWRTISTSDSGPHWSNLRKGLQNIAISPNNLAAQFQFQEKDIIKMIQILEQEAKDNNGIVKPLDHLKKATIRLISRLVFGRDFEEDKYVEDMHHAIEELIRISGYARLAEAFYYAKYLPSHRKAVRYVEELKQIVKNLIRPFLSVNPPTNTYLHFLRSQNYDEEVVIFAIFETYLLGVDSTSSTTAWALAYLVREPSVQDRLHQELDHFAKQNDRKILKVEDMNKLQYLQAVIKETMRMKPIAPLAIPHKACKDTSLMGNKINKGTRVMVNLYALHHNKNVFNDPFKFMPERFLKVDNQDAKGKAMEQSLLPFSAGMRICAGMELGKLQFSFALANLIFAFKWSCVDDGVLPDMSDELGFVLLMKTPLKARINPRN

SEQ ID NO: 32094 - protein, 495 aa, Eschscholzia californica
MEEMKILMMNNPWILTATATTLLISIFLFFTRKSSKMVWPAGPKTLPIIGNMHLLGGTALQVVLHNLAKVHGSVMTIWIGSWRPVIVVSDIERAWEVLVNKSSDYSARDMPDITKIISADWKTISTSDSGPHWTNLRKGLQNVALSPHNLAAQFQFQEKDMTKMIQTLEEEARNNNGIVKPLDHMKKATLRLISRLVFGQDFNNDKYVDDMHLAIEELIRVSGYARLAEAFYYAKYLPSHKKAVREVEEAQRRVQNLVSPFLSLNPPTNTYLHFLRSQKYDDEVIIFAIFEAYLLGVDSTSLTTAWALAFLIREPNVQEKLYQELESFASKNDRRILKVEDINKLQYLQAVIKETMRMKPIAPLAIPHKACRDTSLMGKKIDKGTRVMVNIFALHHNKNVFNDPFKFMPERFMKVDSQDANGKAMEQSLLPFSAGMRICAGMELGKLQFSFALANLAYAFKWSCVADGVLPDMSDQLGFVLLMKTPLEARINRRN

SEQ ID NO: 32095 - protein, 371 aa, Fusarium oxysporum f. sp. radicis-lycopersici
MVRNIAIAALLPAAFASTLPKRDPCSVTDYSGLATAVSSCTNIVLNGFQVPTGKALDLSKLKDGATVTFKGKTTFATTADNDFDPIVISGNGITITGASGHVIDGNGPAYWDGEGSNNKDNPKPDHFIVVKKTTGNSKITNLNIQNWPVHCFDITGSSQLTISGLILDNRLGDKPNAKSGSLPAAHNSDGFDISSSDHVTLDNIHVYNQDDCVAVTSGTNIIVSNMYCSGGHGLSIGSVGGKSNNVVNGVQFLDSQIVNSENGCRIKSNSGTTGTIANVTYQNISLTNISKYGVDVQQDYLNGGPTGKPTNGVKISGIKFIKVTGTVASSAQDWYILCGDGSCSGFTFSGNAITGGGKTSSCNYPTNTCPS

SEQ ID NO: 32096 - protein, 360 aa, Fusarium oxysporum f. sp. radicis-lycopersici
MFSSTVLLSGLVASVLAAPALEPRAGSCTFTDAATAIKNKAGCSTITLNNIAVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 32097 - protein, 360 aa, Fusarium oxysporum f. sp. radicis-lycopersici
MFSSTVLLSGLVASVLAAPALEPRAGSCTFTDAATAIKNKAGCSTITLNNIVVPAKTTLDLTKLNDGTHVIFQGKTTFGYAEWEGPLISFTGNNLLIEGAAGHSIDCEGKRWWDGKGSNGGKKKPKFFSAHSLKNSNIKNLNVLNTPVQAFSINSVTNLGVYGVHMDNSLGDSLGGHNTDAFDVGSSNGVYISGAVVKNQDDCLAINSGTNITFTGGNCSGGHGLSIGSVGGRSDNTVKTVRILNSSISNSDNGVRIKTVSGATGSVSDVKYDTITLSNIAKYGIVIEQDYENGSPTGTPTAGVPITDVTINKVTGTVKSSGTDVYILCANCKNWTWTNNKVTGGKTSTKCKGIPSGASC

SEQ ID NO: 32098 - protein, 455 aa, Fusarium oxysporum f. sp. radicis-lycopersici
MLFNNVLSAVAVSVLVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGKDIHIYGDLTKGESLLDGHGQAYWEEMAVNKTLLRPILLTIEDAHGLTMSNLRMRNPPNWFNIIINSTDVLISDLELEAKSLNGVKIANSDGWDTYRSDRIVIQNSVIDNTDDCVSFKPNSTNVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTNARDTTNG

SEQ ID NO: 32099 - protein, 455 aa, Fusarium oxysporum f. sp. radicis-lycopersici
MLFNNVISAVAVSALVSSVVGTSSRNSALPKRPHVEAAPYGTGKAFPASPARSRKDFCYVNPGKGKNVDDAPSILKAFKKCNKGGTIVLDQKYSIASPLDLTWLAHVDVIITGEVNFKSDPYYWADHSFKYDFQNMSSFWKIGGRDIHIYGDLTKGESLLDGHGQAYWEEMAVNKTLLRPILLTIEDAHGLTMSNLRMRNPPNWFNIIINSTDVLISDLDLEAKSLNGVKIANSDGWDTYRSDRIVIQNSVIDNTDDCVSFKPNSTIVVVQNLVCNGSHGISVGSLGQYKGETDIVENLYIYNISMSNASDGARIKVWPGVETAFQSLLNGGGGLGRVRNVTYDTFYHENNDNAITITQCYGQKNQTLCNEFPANLTIEDVTMKNFWGTVSTKYDPRAGSLVCSAPDRCSNIVAEDIKVQVPSKKPPVYDCQNIDTSTLDITCRDPTSARDTTNG

SEQ ID NO: 32100 - protein, 464 aa, Fusarium oxysporum f. sp. radicis-lycopersici
MKVSSFFSTLSLFAGVLAEAIDLPAGVPRSIEEFRAKHPYELPVKRSHRKVYTIRHSKNDNDDVSSEFYKGLKKANKGGTLYLPKGQTFVIGKPLDLTFLNDIHVHLEGEIKFTNDTEYWQKNVYKHPFQNSIMFWKWGGKNIKLYGKGVLNGNGQRWWNEFAGREILDTTNAYLRPILFYAQNATNLDIQGVHFKDSPCWTNFVVTSKDISFKDVICTARSTNATALPKNTDFFDSLNVENLNVERAWVDIGDDCFSPKSNATNVHVDTMYCNGTHGQSFGSLGQYKGEMSFVKDVVIENVWMLNGQHGARLKTWAGPDIGYGFIDNVTFRNLWGGNNEYTAFIDSCYFNINATTCAQYPSRMNITNILFENFTGYSSGKYGNAVAKLTCSTSKDAVCENIKFKDFNIKTPCGGDPVFLCDGVKDIGVDCVSATSTAGKAALANKCVAPQASASPFKVRKFNG

SEQ ID NO: 32101 - protein, 464 aa, Fusarium oxysporum f. sp. radicis-lycopersici
MKVSSFFSTLSLFAGVLAEAIDLPAGVPRSIEEFRAKHPFELPVKRSHRKVYTIRHSKNDNDDVSSEFYKGLKKANKGGTLYLPKGQTFVIGKPLDLTFLNDIHVHLEGEIKFTNDTEYWQKNAYKHPFQNSIMFWKWGGKNIKLYGKGVLNGNGQRWWNEFAGKEILDTTNAYLRPILFYAQNATNLDIQGVHFKDSPRWTNFVVTSKDISFKDVICTARSTNATALPKNTDFFDSLNVENLNVERAWVDIGDDCFSPKSNATNVHVDTMYCNGTHGQSIGSLGQYKGEMSFVKDVVIENVWMLNGQHGARLKTWAGPDIGYGFIDNVTFRNFWGGNNEYTAFIDSCYFNINATTCAQYPSRMNITNILFENFTGYSSGKYGNAVAKLTCSTSKDAVCENIKFKDFNIKTPCGGDPVFLCDGVKDIGVDCVSATSAAGKAALANKCVAPQASASPFKVRKFNG

SEQ ID NO: 32102 - protein, 503 aa, Chrysanthemum lavandulifolium
MTTIPSRQLFIDGEWREPVKKNRIPVINPSTEQIVGDIPAATAEDVDVAVKAARKALKRNGGKDWASATGAHRAKYLRAIAAKITGKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIAFTGSSATGSKIMTAAAPNVKPVTLELGGKSPIVVFDDVDIDKAVEWTLFGCFWTNGQICSATSRLILHESIAKEFLDKLVKWAKNIKISDPLEEGCRLGPVVSSGQYERVLKFVETARSEGATILSGGQRPQHLKKGFFIEPAIITDITTSMQIWRDEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 32103 - protein, 506 aa, Chrysanthemum lavandulifolium
MTTTIPIPSRQLFIDGEWREPVKKNRISVINPSTEQIVGDIPAATAEDVDVAVKAARKALKRNGGKDWASATGAHRAKYLRAIAAKITEKKELFSKLEAIDCGKPYDEAAWDIDDVAGCFEYNADLAEALDKKQNAPIELPMDTFKCHVIKEPIGVVGLITPWNYPLLMATWKVAPALAAGCAAILKPSELASLTCLELGEVCKEVGLPAGVLNILTGLGPDAGAPLAAHPDVDKIALTGSSATGSKIMTAAAQNVKPVTLELGGKSPIVVFDDVDIDKAVEWTLFGCFWTNGQICSATSRLILHESIAKEFLDKLVKWAKNIKISDPLEEGCRLGPVVSSGQYEKVLKFVETARSEGATILSGGQRPQHLKKGFFIEPAIITDITTSMQVWREEVFGPVLCVKTFSSEEEAIELANDTHYGLGSAVISNDLDRCDRVTRAFDAGIVWVNCSQPCFCQAPWGGKKRSGFGRELGEWGLDNYLSVKQVTRYISNDAWGWYTPPSPKL

SEQ ID NO: 32104 - protein, 405 aa, Euglena gracilis
MLALYELPGGYALFKVIEGGGFKLVGQHHFKDSEHAVEAAKALMNSELHESLKKFLKKSKIQDTLAVQDAKLGGLIKKKLDIPCIFDGEVEEIMRNIREQITTLVEGLTDQNMLQMSLGLAHTLNRHLLKFSADKIDVMVIQAIGLLDDLDKELNTYAMRVKEWYGWHFPEMAKIVVDNLQYARVILKMGTRENAATTDLVDVVDEDTAAQVRDAAIHSMGVGLTPEDITNIKMLCEEVVSTSEYRVQLFEYLRNRMNAIAPNLTTMVGELVGARLISHAGSLMNLAKMPSSTVQILGAEKALFRALKAKQATPKYGLIYHATLVGQAKANHKGKIARIAACRTALATRVDALAENVTGPTIGVEGRESVEFKLRKLEGGQIFTKAQKSHQYVEAETSTQPSTAT

SEQ ID NO: 32105 - protein, 475 aa, Ephemerum spinulosum
MSPQTETKASVGFKAGVKDYRLNYYTPDYQTLDTDILAAFRMTPQPGVPPEEAGAAVAAESSTGTWTTVWTDGLTSLDRYKGRCYDIEAVAGEENQYIAYVAYPLDLFEEGSVTNLFTSIVGNVFGFKALRALRLEDLRIPPSYTKTFQGPPHGIQVERDKLNKYGRPLLGCTIKPKLGLSAKNYGRAVYECLRGGLDFTKDDENVNSQPFMRWRDRFLFVAEAIYKSQAETNEIKGHYLNATAGTCEEMFKRAQFARELGVPIIMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVAVEACVQARNEGRDLAREGNEIIREAAKWSPELAAACEVWKEIKFEFETIDTV

SEQ ID NO: 32106 - protein, 475 aa, Bryoxiphium japonicum
MSPQTETKAGVGFKAGVKDYRLTYYTPDYQTKETDILAAFRMTPQPGVPPEEAGAAVAAESSTGTWTTVWTDGLTSLDRYKGRCYDIEAVLGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMLKRAQFARELGVPIVMHDYLTGGFTANTSLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFETIDTV

SEQ ID NO: 32107 - protein, 446 aa, Thermoproteus tenax
MFTKIVATLGPSTDRLPDITALLSKVHGVRINMSHASPSEVEARVNAVRKYEETSGRYIAIIADLRGPSVRTGLMRPLQITAGARVSFKLAEKGDGFVPVPRREFFEVIEEGDEVLMLDGKLVLRIISAAQTSAEAESLSSGVISSNKAIVVKGKEYHIEQPVEEDIRALQTLSRFRDDVDYVALSLVRDGADVRKMRSVVEEAGLTSGIMAKIETKSAVDKIEEIINAADYIVIARGDLALHYGLEYIPKVQRLLVERSLSAGRPVAVATQLLDSMQTNTTPTRAEVNDVYTTASLGVDSLWLTNETASGEHPLEAVDWLRRIVSQVEFGRLKAASPADARDRFAKAVVDMAEDMGGEIAVYSMTGTLAKRIAKFRPMTTVYVGVNERRLARMLELREDVGAHMGPRACGRAGAYLRGGPREAPLQILRQSLDSHVWAQRRHTYY

SEQ ID NO: 32108 - protein, 425 aa, Blastocladiella emersonii
MTLIDKLMEKTKKVVGSSDKDAPAPASPSSPSTAAGAGSASSTASSTTTAAASGNLSIPSPLVAGSTTSSSISHAQKMATAAHTNSDYSPSPAATPSAPLDAVAERRRRKTTLADLELRQTLGTGSFGRVHLVRLRSTGKYYAMKVLKKAEVVKHKQVEHTLNEKGILEQIDHPFLVALHSSFQDSANLYMVMEYVTGGELFTYLRRSQRFSNNVAKFYAAEVVLAFEYLHSKDIIYRDLKPENLLLDAQGHVKITDFGFAKHVPDITWTLCGTPDYLAPEIIQSRGYGRAVDWYALGVLIFEMLAGYPPFYDEDHVRMYEKILQGKVKWPSHFDPAAKDLLKRLLTTDLTKRYGNLKGGSKDIKMHKWFAGLDWTKLFNKQIPPPYTPPNRGDGDTSNFDAYPEETEPYGKVQPDPYAQLFKDF

SEQ ID NO: 32109 - protein, 344 aa, Saccharomyces cerevisiae
MSAGIGESRTELLTWLNGLLNLNYKKIEECGTGAAYCQIMDSIYGDLPMNRVKFNATAEYEFQTNYKILQSCFSRHGIEKTVYVDKLIRCKFQDNLEFLQWLKKHWIRHKDESVYDPDARRKYRPIITNNSATKPRTVSNPTTAKRSSSTGTGSAMSGGLATRHSSLGINGSRKTSVTQGQLVAIQAELTKSQETIGSLNEEIEQYKGTVSTLEIEREFYFNKLRDIEILVHTTQDLINEGVYKFNDETITGHGNGNGGALLRFVKKVESILYATAEGFEMNDGEDELNDKNLGEHGTVPNQGGYANSNGEVNGNEGSNHDVIMQNDEGEVGVSNNLIIDEETF

SEQ ID NO: 32110 - protein, 464 aa, Saccharomyces cerevisiae
MGQILSNPVIDKESHSGADSLTAFGLCAMQGWRMSMEDSHILEPNVLTKSDKDHIAFYGIFDGHGGAKVAEYCGNKIVEILQEQKSFHEGNLPRALIDTFINTDVKLLQDPVMKEDHSGCTATSILVSKSQNLLVCGNAGDSRTVLATDGNAKALSYDHKPTLASEKSRIVAADGFVEMDRVNGNLALSRAIGDFEFKSNPKLGPEEQIVTCVPDILEHSLDYDRDEFVILACDGIWDCLTSQDCVDLVHLGLREGKTLNEISSRIIDVCCAPTTEGTGIGCDNMSIVVVALLKEGEDVAQWSDRMKSKAHRTSVRSFADKRRRVFSYYDFSKCNDEQVFAITTKKPQDKFTRDHEAAVASVTAADNDDPMDIDDTDADTDAENLDPSSQSKSKTSGPIDLASLEALLGATGGVKTDSNGNKVTYTLPQSALAQLLQTMGHDPASSHPENDSNTDHKAGRSHLQ

SEQ ID NO: 32111 - protein, 191 aa, Saccharomyces cerevisiae
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCAIL

SEQ ID NO: 32112 - protein, 424 aa, Saccharomyces cerevisiae
MSEATLSSKQTIEWENKYSAHNYHPLPVVFHKAKGAHVWDPEGKLYLDFLSAYSAVNQGHCHPHIIKALTEQAQTLTLSSRAFHNDVYAQFAKFVTEFFGFETVLPMNTGAEAVETALKLARRWGYMKKNIPQDKAIILGAEGNFHGRTFGAISLSTDYEDSKLHFGPFVPNVASGHSVHKIRYGHAEDFVPILESPEGKNVAAIILEPIQGEAGIVVPPADYFPKVSALCRKHNVLLIVDEIQTGIGRTGELLCYDHYKAEAKPDIVLLGKALSGGVLPVSCVLSSHDIMSCFTPGSHGSTFGGNPLASRVAIAALEVIRDEKLCQRAAQLGSSFIAQLKALQAKSNGIISEVRGMGLLTAIVIDPSKANGKTAWDLCLLMKDHGLLAKPTHDHIIRLAPPLVISEEDLQTGVETIAKCIDLL

SEQ ID NO: 32113 - protein, 432 aa, Saccharomyces cerevisiae
MEFYLSSDCASLARYVSKVVYLEDNDIAHIYDGELHIHCSKIGSEDFSFRTVQKLELELSKIKKGPYDNFMQKEIYEQCETTKNVMRGRVDAFTNRVVLGGLENWLTELRRAKRIIMIASKASFHSCLAARPIFEELMEVPVNVELALDFVDRNCCIFRNDVCIFVSRSGETTDTINALNYCIKKEAVTIGVVNCSGSSISRFTHCGVHTNTGPEKGIATTKSYTSQYIALVMIALWMSEDLVSKIERRKEIIQALTIVPSQIKEVLELEPLIIELCDKKLKQHDTFLLLGRGYQFASALEGASKMKEISYVHSESILTNELGHRVLAVASDNPPIIAFATKDAFSPKIASCIDQIIERKGNPIIICNKGHKIWEQDKQKGNVVTLEVPQTVDCLQGILNVIPLQLISYWLAIKKDIGVDLPRDSAMSAPDI

SEQ ID NO: 32114 - protein, 506 aa, Saccharomyces cerevisiae [sequence omitted]

SEQ ID NO: 32115 - protein, 1223 aa, Saccharomyces cerevisiae
MKFGKTFANHRIPEWSSQYVGYKSLKKMIKEITRLQEDIYRAHNKNSYDEGRPPTKMRDSSNSAQNYLDSPKIQKLLASFFFAVDRDIEKVDTFYNSQYAEYKKRFERLLSSNQFNEIKSTLVVDANKEDAVAQTLLTKDTREMNMLLKGTSQASRLSYHKDDLIEIQSILAELRKQFRNLKWYAELNKRAFGKILKKLDKKVGTNQQMSTMKTRILPLQFANDSLITKDLSLLKTIWEQVTFRINSYERVMRSTSPNANANDNTEFFKIICVFIEEDDSKGLIRELTNLYSELSLIPTRIMISVLNKAALSKSLACIDAILKVIPSLNDSEDINRRNFFHHHIIAIGKLIRKQEILSRKKKSQPSKYTNSEGEIVTDLRTLHTTLSAPAESDSITEEEKSSACTLSYILEELPIHLRPCLFQHDNYKRTPLHYSCQYGLSEVTKLIIKLMKEWNIWNEIPIDDVSAFGDAESLTPLHLCVLGAHPKTTEVLLQSLDPNVKLKSSSLLHLATEWNNYPLLHVLLSSKRFDINYQDNELHETPLYLACRLNFFEAAVCLLYNGADLEIREKLFGWTAIFVAAAEGFTDIVKLLIANNANFDIEDEGGWTPMEHAVLRGHLHIADMVQIRDELVTHPHSQLNSGSEEKEPLNEISAGELNERNENGNGGNKGSLGKLAGPIKSYGHRFLDNNESLILITLGSNDTRNKSPSISLSSEALAKVIGLETDCALSLVISCNDSIDKSSVILDLPLDDNVDAVDFKVPFKVDYSHTLYFDIVPTYGTRSLETHNRIDCQKNNNNYVMARGVSMLNKSYSSVGVNRSILNGSVTVPIIANHTLEILGTLKFEYIIITPFEHPQLPLERTETYWKSLVSTRVIGHRGLGKNNPNKSLQIGENTVESFIMAASLGASYVEFDVQLTKDNVPVVYHDFLVAETGVDIPMHELTLEQFLDLNNADKEHIQRGAGHSPHHVNGADTALQKYRGRSVDDSDVSTLRRAWDLHDNDPNGKSNNAHWSDNRMRLTKTFKKNNFKGNARGHSIASSFVTLKELFKKIPANVGFNIECKFPMLDEAEEEELGQIMMEMNHWVDTVLKVVFDNANGRDIIFSSFHPDICIMLSLKQPVIPILFLTEGGSEQMADLRASSLQNGIRFAKKWNLLGIVSAAAPILKAPRLVQVVKSNGLVCVTYGVDNNDPENASIQIEAGVDAVIVDSVLAIRRGLTKKNEK

SEQ ID NO: 32116 - protein, 483 aa, Saccharomyces cerevisiae
MLSATKQTFRSLQIRTMSTNTKHYDYLVIGGGSGGVASARRAASYGAKTLLVEAKALGGTCVNVGCVPKKVMWYASDLATRVSHANEYGLYQNLPLDKEHLTFNWPEFKQKRDAYVHRLNGIYQKNLEKEKVDVVFGWARFNKDGNVEVQKRDNTTEVYSANHILVATGGKAIFPENIPGFELGTDSDGFFRLEEQPKKVVVVGAGYIGIELAGVFHGLGSETHLVIRGETVLRKFDECIQNTITDHYVKEGINVHKLSKIVKVEKNVETDKLKIHMNDSKSIDDVDELIWTIGRKSHLGMGSENVGIKLNSHDQIIADEYQNTNVPNIYSLGDVVGKVELTPVAIAAGRKLSNRLFGPEKFRNDKLDYENVPSVIFSHPEAGSIGISEKEAIEKYGKENIKVYNSKFTAMYYAMLSEKSPTRYKIVCAGPNEKVVGLHIVGDSSAEILQGFGVAIKMGATKADFDNCVAIHPTSAEELVTMR

SEQ ID NO: 32117 - protein, 500 aa, Saccharomyces cerevisiae
MTKLHFDTAEPVKITLPNGLTYEQPTGLFINNKFMKAQDGKTYPVEDPSTENTVCEVSSATTEDVEYAIECADRAFHDTEWATQDPRERGRLLSKLADELESQIDLVSSIEALDNGKTLALARGDVTIAINCLRDAAAYADKVNGRTINTGDGYMNFTTLEPIGVCGQIIPWNFPIMMLAWKIAPALAMGNVCILKPAAVTPLNALYFASLCKKVGIPAGVVNIVPGPGRTVGAALTNDPRIRKLAFTGSTEVGKSVAVDSSESNLKKITLELGGKSAHLVFDDANIKKTLPNLVNGIFKNAGQICSSGSRIYVQEGIYDELLAAFKAYLETEIKVGNPFDKANFQGAITNRQQFDTIMNYIDIGKKEGAKILTGGEKVGDKGYFIRPTVFYDVNEDMRIVKEEIFGPVVTVAKFKTLEEGVEMANSSEFGLGSGIETESLSTGLKVAKMLKAGTVWINTYNDFDSRVPFGGVKQSGYGREMGEEVYHAYTEVKAVRIKL

SEQ ID NO: 32118 - protein, 305 aa, Saccharomyces cerevisiae
MSSSSQFKQLEKLGNGTYATVYKGLNKTTGVYVALKEVKLDSEEGTPSTAIREISLMKELKHENIVRLYDVIHTENKLTLVFEFMDNDLKKYMDSRTVGNTPRGLELNLVKYFQWQLLQGLAFCHENKILHRDLKPQNLLINKRGQLKLGDFGLARAFGIPVNTFSSEVVTLWYRAPDVLMGSRTYSTSIDIWSCGCILAEMITGKPLFPGTNDEEQLKLIFDIMGTPNESLWPSVTKLPKYNPNIQQRPPRDLRQVLQPHTKEPLDGNLMDFLHGLLQLNPDMRLSAKQALHHPWFAEYYHHAS

SEQ ID NO: 32119 - protein, 499 aa, Saccharomyces cerevisiae
MGGEDEILSTMEDFAAVYDVLVIGCGPGGFTAAMQASQAGLLTACVDQRASLGGAYLVDGAVPSKTLLYESYLYRLLQQQELIEQRGTRLFPAKFDMQAAQSALKHNIEELGNVYKRELSKNNVTVYKGTAAFKDPHHVEIAQRGMKPFIVEAKYIVVATGSAVIQCPGVAIDNDKIISSDKALSLDYIPSRFTIMGGGTIGLEIACIFNNLGSRVTIVESQSEICQNMDNELASATKTLLQCQGIAFLLDTRVQLAEADAAGQLNITLLNKVSKKTYVHHCDVLMVSIGRRPLLKGLDISSIGLDERDFVENVDVQTQSLLKYPHIKPIGDVTLGPMLALKAEEQAIRAIQSIGCTGSDGTSNCGFPPNVLYCQPQIGWVGYTEEGLAKARIPYQKGRVLFSQNVRYNTLLPREENTTVSPFIKVLIDSRDMKILGVHMINDDANELLSQASMAVSLGLTAHDVCKVPFPHPSLSESFKQAVQLAMANGTSPGVHVRE

SEQ ID NO: 32120 - protein, 475 aa, Arthropteris backleri
MSPQTETKAGVGFKAGVKDYRLTYYTPEYQTKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDLRIPPAYSKTFIGPPHGIQVERDKLNKYGRPLLGCTIKPKLGLSAKNYGRAVYECLRGGLDFTKDDENVNSQPFMRWRDRFLFVAEALFKAQAETGEIKGHYLNATAGTCEEMMKRAIFARELGAPIVMHDYLTGGFTANTSLAYYCRDNGLLLHIHRAMHAVIDRQRNHGMHFRVLAKALRMSGGDHVHAGTVVGKLEGERDVTLGFVDLLRDDYIEKDRSRGVYFTQDWVSMPGVIPVASGGIHVWHMPALTEIFGDDSVLQFGGGTLGHPWGNAPGAVANRVALEACVQARNEGRDLAREGNEIIREASKWSPELAAACEIWKAIKFEFDTIDTL

SEQ ID NO: 32121 - protein, 475 aa, Davallia epiphylla
MSPQTETKAGVGFKAGVKDYRLTYYTPEYKTKDTDILAAFRMTPQPGVPAEEAGAAVAAESSTGTWTTVWTDGLTSLDRYKGRCYDIEPVAGEENQYIAYVAYPLDLFEEGSVTNLFTSIVGNVFGFKALRALRLEDIRVPPAYSKTFIGPPHGIQVERDKLNKYGRPLLGCTIKPKLGLSAKNYGRAVYECLRGGLDFTKDDENVNSQPFMRWRDRFLFVAEALFKSQAETGEIKGHYLNATAGTCEEMLKRAVFARELGAPIVMHDYLTGGFTANTSLAFYCRDNGLLLHIHRAMHAVIDRQRNHGMHFRVLAKALRMSGGDHVHAGTVVGKLEGEREVTLGFVDLLRDDYIEKDRSRGVYFTQDWVSMPGVLPVASGGIHVWHMPALTEIFGDDSVLQFGGGTLGHPWGNAPGAVANRVALEACVQARNEGRDLAREGNEIIREASKWSPELAAACEIWKAIKFEFDTIDTL

SEQ ID NO: 32122 - protein, 269 aa, Davallia epiphylla
TSVTNWFEDKRKFGGLIGAFPEEATRGSISNEKEREKRITVNTNRGLWARCDNCGNMLYVKYLKQNKSVCEECGYHLPMNSMERIELLVDRNTWIPMDENMTTKDVLDFSDEDSHQNRVAISQEKTGLTDAVQTGIGYLNGTLIALGAMDFHFMGGSMGSVVGEKITRLIEYATAKSLPLVLICASGGARMQEGTLSLMQMAKISSVLQIHQVRKKLLHISILTYPTTGGVTASFGMLGDIIIAESKAYTAFAGKRVIEQTSRQKIPEG

SEQ ID NO: 32123 - protein, 269 aa, Davallia solida
TSVTNWFEDKRKFGGLIGAFPEEATRGSISNEREREKRISVNTNRGLRARCDNCGNMLYVKYLKQNKSVCEERGYHLPMNSMERIELLVDRNTWIPMDENMTTKDVLDFSDEDSHQNRVAISQEKTGLTDAVQTGIGYLNGTLIALGAMDFHFMGGSMGSVVGEKITRLIEYATAKSLPLVLICASGGARMQEGTLSLMQMAKISSVLQIHQVRKKLLHISILTYPTTGGVTASFGMLGDIIIAESKAYIAFAGKRVIEQTSRQKIPEG

SEQ ID NO: 32124 - protein, 305 aa, Saccharomyces cerevisiae
MSSNDSNDTDKQHTRLDPTGVDDAYIPPEQPETKHHRFKISRDTLRDHFIAAVGEFCGTFMFLWCAYVICNVANHDVALVAAPDGSHPGQLIMIAIGFGFSVMFSIWCFAGVSGGALNPAMSLSLCLARAVSPTRCVVMWVSQIVAGMAAGGAASAMTPGEVLFANSLGLGCSRTRGLFLEMFGTAILCLTVLMTAVEKRETNFMAALPIGISLFIAHVALTAYTGTGVNPARSLGAAVAARYFPHYHWIYWIGTLLGSILAWSVWQLLQILDYTTYVTAEKAASTKEKAQKKGETSSSSAVAEV

SEQ ID NO: 32125 - protein, 214 aa, Yersinia enterocolitica
MRIILLGAPGAGKGTQAQFIMEKYGIPQMCTGDMLRAAVKAGSELGLKAKEIMDAGKLVTHELVIALVKERITQDDCRDGFLLHGFPRTIPQADAMKEAGIKVDYVLEFDVPDELIVDRIVGRRVHAASGRVYHIKFNPPKVEDKDDVTGEELTIRKDDQEATVRKRLVEYHQQTAPLVSYYRKEADAGNTQYFKLDGTRKVAEVSAELATILG

SEQ ID NO: 32126 - protein, 371 aa, Emericella nidulans
MFRQSVRRFATAALRSAAESPYNVRVSQAQGFVNGLTEKAIGNTPLIRLKRLSEETGSNILAKAEFQNPGGSVKDRAALYVVKDAEERGLLKPGGTVVEGTAGNTGIGLAHVCRSKGYKLVIYMPNTQSQGKIDLLRLLGAEVYPVPAVAFDNPENYNHKARRHAESLDNAVWTNQFDNTANRRAHIETTGPEIWAQTGGKLDAFTCSTGTGGTLAGITYYLKQASGGRVKSFLADPPGSVLHSYIQSGGKLVERSGSSITEGIGQGRITDNLQPDVGTLDGSLNISDEKTIEMIYRCLDEEGLYLGASSALNVVAAKEVAEKLGKGSTVVTILADGAYRYADRLFSKSWLESKGLRNAIPKHLEKYIVLP

SEQ ID NO: 32127 - protein, 437 aa, Emericella nidulans
MSDPSPKRFETLQLHAGQEPDPATNSRAVPIYATTSYTFNDSAHGARLFGLKEFGNIYSRIMNPTVDVFEKRIAALEGGVAAVAASSGQAAQFMAISALAHAGDNIVSTSNLYGGTYNQFKVLFPRLGITTKFVQGDKAEDIAAAIDDRTKAVYVETIGNPRYNVPDFEAIAKVAHEKGIPLVVDNTFGAGGYFVRPIEHGADIVVHSATKWIGGHGTTIGGVVVDSGKFEWGKNAARFPQFTQPSEGYHGLNFWETFGPIAFAIRVRVEILRDLGSALNPFAAQQLILGLETLSLRAERHASNALALANWLKKNDHVSWVSYVGLEEHPSHGVAKKYLKRGFGGVLSFGVKGEAAVGSQVVDNFKLISNLANVGDSKTLAIHPWSTTHEQLTDQERIDSGVTEDAIRISVGTEHIDDIIADFEQSFAATFKVVRGA

SEQ ID NO: 32128 - protein, 432 aa, Burkholderia cepacia
  misc_feature (271)..(271): Xaa can be any naturally occurring amino acid
LNDDATFWRNARHHLVRYGGTFEPMIIERAKGSFVYDADGRAILDFTSGQMSAVLGHCHPEIVSVIGEYAGKLDHLFSEMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKXTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 32129 - protein, 481 aa, Arabidopsis thaliana
MRKLTAVNSLLKRNNYLLPRHGSSQTAAQRTSSVRETETETKLPKMPPFNYSPPPYDGPSTAEIIAKRREFLSPALFHFYNTPLNIVEAKMQYVFDENGRRYLDAFGGIATVSCGHCHPEVVNSVVKQLKLINHSTILYLNHTISDFAEALVSTLPGDLKVVFFTNSGTEANELAMMMARLYTGCNDIVSLRNSYHGNAAATMGATAQSNWKFNVVQSGVHHAINPDPYRGIFGSDGEKYASDVHDLIQFGTSGQVAGFIGESIQGVGGIVELAPGYLPAAYDIVRKAGGVCIADEVQSGFARTGTHFWGFQSHGVIPDIVTMAKGIGNGIPLGAVVTTPEIAGVLSRRSYFNTFGGNPMCTAAGHAVLRVLHEEKLQENANLVGSHLKRRLTLLKNKYELIGDVRGRGLMLGVEFVKDRDLKTPAKAETLHLMDQMKEMGVLVGKGGFYGNVFRITPPLCFTLSDADFLVDVMDHAMSKM

SEQ ID NO: 32130 - protein, 432 aa, Burkholderia cepacia
SLNDDATFWRNARHHLVRYGGTFEPMIIERAKGSFVYDADGRAILDFTSGQMSAVLGHCHPEIVSVIGEYAGKLDHLFSGMLSRPVVDLATRLANITPPGLDRALLLSTGAESNEAAIRMAKLVTGKYEIVGFAQSWHGMTGAAASATYSAGRKGVGPAAVGSFAIPAPFTYRPRFERNGAYDYLAELDYAFDLIDRQSSGNLAAFIAEPILSSGGIIELPDGYMAALKRKCEARGMLLILDEAQTGVGRTGTMFACQRDGVTPDILTLSKTLGAGLPLAAIVTSAAIEERAHELGYLFYTTHVSDPLPAAVGLRVLDVVQRDGLVARANVMGDRLRRGLLDLMERFDCIGDVRGRGLLLGVEIVKDRRTKEPADGLGAKITRECMNLGLSMNIVQLPGMGGVFRIAPPLTVSEDEIDLGLSLLGQAIERAL

SEQ ID NO: 32131 - protein, 168 aa, Avena agadiriana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREYGSTPGYYDGRYWTMWKLPMFGCTDASQVIKEVEEVKKEYPDAYVRIIGFDNIRQVQCVSFIAFKPPGCEESG

SEQ ID NO: 32132 - protein, 168 aa, Avena strigosa
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKKYPDAYVRIIGFVNIRQVQCVSFIAFKPPGCEESG

SEQ ID NO: 32133 - protein, 168 aa, Avena clauda
VMASSATTVAPFQGLKSTAGLPVSRRSASSLGNVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32134 - protein, 168 aa, Avena sterilis subsp. ludoviciana
VMASSATSVAPFQGLKSTAGLPVSRRSNAGLGSVSNGGRIRCMQVWPIEGIKKFETLSYLPPLTEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32135 - protein, 168 aa, Avena maroccana
VMASSATSVAPFQELKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32136 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIREVEEVKKEYPDAYVRIIGFDNIRQVQCVSFIAFKPPGCEESG

SEQ ID NO: 32137 - protein, 168 aa, Avena clauda
VMASSATSVAPFQGLKSTAGLAVSRRSNAGLGSVSNGGRIRCMQVWPIEGIKKFETLSYLPPLSEEALLKQIDFLIRSKWVPCLEFSKVGFIFRVHGSTPGYYDGRYWTMWKLPMFGCTDASQVIKEVEEVKKEYPDAYVRIIGFDNIRQVQCVSFIAFKPPGCEESG

SEQ ID NO: 32138 - protein, 323 aa, Pelargonium x hortorum
MENFPVIDMEMLNGEERSAAMNMIKDACENWGFFEIKNHGISHELMDKVERLTKEHYAKFMEQRFKEMVASKGLDATQSEIDDLDWESTFFLRHLPTSNISEIPDLEHDYRLAMKEFAERLEKLAEELLDLLCENLGLEKGYLKKAFYGSKGPTFGTKVSNYPPCPKPELIKGLRAHTDAGGLILLFQDDKVSGLQLLKDGRWIDVPPMRHSIVINLGDQLEVITNGKYKSVMHRVIAQTDGNRMSLASFYNPGSDAVIYPAPALIEEENQNPIYPKFVFEDYMKLYAGLKFQAKEPRFEAMKAMPLPMAMDTTPLQGPVATA

SEQ ID NO: 32139 - protein, 223 aa, Oryza sativa (indica cultivar-group)
MSYAYLFKYIIIGDTGVGKSCLLLQFTDKRFQPVHDLTIGVEFGARMITIDNKPIKLQIWDTAGQESFRSITRSYYRGAAGALLVYDITRRETFNHLASWLEDARQHANANMTVMLIGNKCDLSHRRAVSYEEGEQFAKEHGLVFMEASAKTAQNVEEAFIKTAGTIYKKIQGGVFDVSNESYGSKLAMRYQMLQVVELAHPLKVVAAAAKGSSSIQLVMYPA

SEQ ID NO: 32140 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32141 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAQILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32142 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32143 - protein, 445 aa, Escherichia coli
AVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLPANLIQAQRDYFGAHTYKRI

SEQ ID NO: 32144 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32145 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQCDYFGAHTYKRI

SEQ ID NO: 32146 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKEIADDYQQALRDVVAYAVQNGIPVPTFAAAVAYYDSYRAAVLPANLIQAQRDYFGAHTYKRI

SEQ ID NO: 32147 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRDYFGAHTYKRI

SEQ ID NO: 32148 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAHAAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32149 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32150 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGLNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32151 - protein, 445 aa, Escherichia coli
AVMGRNLARNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILSKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32152 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLSLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32153 - protein, 445 aa, Escherichia coli
AVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32154 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 32155 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 32156 - protein, 445 aa, Escherichia fergusonii
AVMGRNLALNIESRGYTVSIFNRSREKTEEVITENPGKKLVPYYTVKEFVESLETPRRILLMVKAGAGTDATIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQAAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVLNGIPVPTFAAAVAYYDSYRAAVLPANLIQAQRDYFGAHTYKRI

SEQ ID NO: 32157 - protein, 445 aa, Klebsiella pneumoniae
AVMGRNLALNIESRGYTVSVFNRSREKTEEVIAENPGKKLVPYYTVQEFVKSLETPRRILLMVKAGAGTDSAIDSLKPYLDKGDIIIDGGNTFFQDTIRRNRELSAEGFNYIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEDGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAEFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 32158 - protein, 496 aa, Apium graveolens
MAGSGVYADIIEGDVFKYYSDGEWKKSSSGKSVAIINPTTRMTQFKVQACTQEEVNKAMETAKKVQKQWAKTPLWKRAELLHKAAAILKEHKAAIADCLVKEIAKPAKDSVTEVVRSGDLVSYCAEEGVRLLGEGKFLVSDSFPGNERTKYCLTSKIPLGVILAIPPFNYPVNLAVSKIGPALIAGNALVLKPPTQGAVACLHMVHCFHLAGFPKGLISCITGKGSEIGDFLTMHPGVNCISFTGGDTGIAISKKAGMVPLQMELGGKDACIVLEDADLDLVASNVIKGGFSYSGQRCTAIKVILVMQSVADTLVEKVNAKVAKLTVGPPEDNSDITPVVSESSANFIEGLVKDAKEKGATFCQEYKREGNLIWPLLLDNVKPDMRIAWEEPFGPILPVIRINSAEEGIHHCNASNFGLQGCVFTRDINKAMLISDAMESGTIQINSAPARGPDHFPFQGLKDSGIGSQGITNSINMMTKIKTTVINLPSPSYTMG

SEQ ID NO: 32159 - protein, 438 aa, Spiroplasma citri
AFTQMRARGSAVTDIVVLVVAADDGVMLQTKEAIDHAKAAGVPIIVFVNKMDKVGINLDNILMQLSQEELTPEEWGGTTPYVKGSAKQKQGIDELLDTILLMADLMELKANPNRFALGTVLESHLNRGLGPVATLLVQSGTLNIKDALVVGYTFGYVRDLSDESGKKIKSAGPSTPVMIHGLNEVPNAGDRFMVFRDEKLAREIALKRKTIDTMNKRYKNQNFSLESLSAQIKDGQLKQINIILKADTQGTVEAVKASLLKINIAGLKINVLRATVGGISESDVTLGLASQAFIVGFNVRPTAHVRKKAEDEGVAIRLHTIIYKLTEEIVAAAEGMLDPEMVEEVLGQAEVRQIFRHSDIGTIAGCYVTDGIIPRKSRVRVLRDGVIVYSGELASLKHIKDDIKEAKTGAECGLTIKNYNDLKEQDVIEVYTEKAVTK

SEQ ID NO: 32160 - protein, 454 aa, Streptomyces coelicolor A3(2)
MPRPLRVAIVGSGPAGIYAADALLKSEVAADPGVSIDIFERMPAPFGLIRYGVAPDHPRIKGIITALHQVLDKPQIRLFGNVNYPTDVSLDDLRAFYDGVIFATGATADRDLSLPGIDLDGSYGAADFVAWYDGHPDFPRTWPLEAEKVAVLGVGNVALDIARVLAKTADELLPTEIPPNVYEGLKANKALEVHVFGRRGPAQAKFSPMELRELDHSPNIEVIVDPEDIDYDEGSIATRRGNKQADMVAKTLENWAIRDVGDRPHKLFLHFFESPAEILGEDGRVTGLRTERTELDGTGNVKGTGEFKDWDVQAVYRAVGYLSDQLPKLPWDLETGTVPDAGGRVVQESGEHLQSTYVTGWIRRGPIGLIGHTKGDANETVSNLLDDYANGRLQTPSSPAPEAVDAFLAERNVRFTTWDGWYRLDAAEKAQGEPHGRERVKYVEREDMLRESGA

SEQ ID NO: 32161 - protein, 364 aa, Lycopersicon esculentum
MAIENNDQSFFLDVLYCEEEEEKWGDLLEDEEGVIINPLLLSSEGTTKTNSLLLLPLLLLEQDLFWEDEELLSLFVKEKETRCCFESFGSDPFLCSARVDVVEWILKVNAHYDFSALTAILAINYLDRFLSSLQFQKDKPWMTQLAAVTCLSLAAKVEETQVPLLLDFQVEDAKYVFEAKTIQRMELLVLSSLKWRMNPVTPLSFLDHIIRRLGLKNNVHWEFLRRCESLLLSVMIDCRFVRYMPSVLATAIMLHVIHQIEPCNAIDYQNQLLGVLKISKENVNNCYELISEVSSKPITSHKRKYDENPSSPSGVIDPIYTSESSNDSWDLDLPSFKKSKVQEQQMKMSSSLSRVFVEAVGSPH

SEQ ID NO: 32162 - protein, 297 aa, Arabidopsis thaliana
VRDWYLESFRDMRAFPEIKDSGDEKDFTQMIKAVKVRHNNVVPMMALGVNQLKKGMNSGNLDEIHQFLDRFYLSRIGIRMLIGQHVELHNPNPPLHTVGYIHTKMSPMEVARNASEDARSICFREYGSAPEINIYGDPSFTFPYVPTHLHLMMYELVKNSLRAVQERFVDSDRVAPPIRIIVADGIEDVTIKPFRSLLHRFDPIIVVSDEGGGIARSGLPRIFTYLYSTARNPLEEDVDLGIADVPVTMAGYGYGLPISRLYARYFGGDLQIISMEGYGTDAYLHLSRLGDSQEPLP

SEQ ID NO: 32163 - protein, 194 aa, Chlamydomonas sp. HS-5
MDESNATCGKRLDSIGVENTEENRRAYRDLLLSTPGLGQYISGAILFEETLYQSTKDGKTFVQVMNDQGIVPGIKVDKGLVPLVNSNGESWCMGLDGLDKRCAEYYKAGARFAKWRSVISIPAGPSIIAQRDCPTAWPATPPLPSPLAWCPSSSPRCCWTVTRTLTRLWRLPRTSGLRLSSTWPTTRSCSRVSC

SEQ ID NO: 32164 - protein, 343 aa, Antirrhinum majus
MYQQNSPSLCFDALYCEEEQNWDNGEIINDCFIEEQEPFSDLLKHDLLCGVDDDDDDKEELSSLLCKEQEYELYRVLEDNPSLAKARDEAVEWMFKVIGYYSFSALTAVLAVNYLDRFLCTFQFQQDKPWMYQLAAVACLSLAAKVEETQVPLLLDLQVEESKYVFESKTIQRMELLVLSTLKWKMNPVTPISFLEYIARRLALKSHLCKEFLNRCECLLLSLITDCRFMCHLPSALATATMLYVISSLEPCIGVEYQDQLINILGINKDKVEECCKLIQEVATSVHFQSGNKRKFGSLPYSPKGVVDISFSCDDSWPLDSTASVSSSPEHLSKKIKTQNPDH

SEQ ID NO: 32165 - protein, 361 aa, Antirrhinum majus
MLFSHSQQTHLQNPIFDALLCNEEHFDEDLDLGSGLKDPGFINQIHHNQKKEEPFTTFLFEHDLLWEDDELVNLLSKEKEQEQQAHLGYDDVMDSDGFLKRVRNEGIKWMLKVIGHYGFNAMTAVLAVNYYDRFITNVGFQKDKPWMSQLAAVACLSVKVEETQVPLLLDFQVEESKYVFEAKTIQRMELLVLTTLKWKMNPVTPISFFDHIVRRFELMNNVQCEFMKRCESVILSIITDYRFVRYLPSVVAAATMIYVIKELYPCDALEYQNEFVTVLRTSKEKTDDCHMLITEVINNQSYILCHKRKYGSIPSSPNGVIDAYFSSDGSNDSWSAVSSVSSSPEPVFKRIRAIGGANPPH

SEQ ID NO: 32166 - protein, 322 aa, Bacillus circulans
MKNIGITVYGCNQDEADAFRALSPQFGIMPSIINADVSEANAISAPLNQCISVGHKSEISASILVALKRGGVKYISTRSIGCNHIDTIAAKRIGITVGNVAYSPDSVADFTMMLMLMAVRNTKSIVRSVEKHDFRLDSVRGKVLSEMTVGVVGTGQIGKAVIERLRGFGCKVLAYSHSKSIEVYYVPFDELLQNSDIVTLHVPLHTDTHYIIGHEQIQRMKKGAFIINTSRGPLVDTYALVKALENGKLGGAALDVLEGEEEFFYSDCTQRPIDNQFLLKLQKMPNVIITPHTAYYTEQALRDTVEKTITNCLDFERRLEHE

SEQ ID NO: 32167 - protein, 394 aa, Claviceps fusiformis
MKFLAAASLLVASTLAVPTSSGGSCRPRPPPGGGNGGNGGNGGNGGNGYQPCPAGLYSNPQCCATDVLGVADLDCKNPSSAPMSGDNFKSICNAVGQQAKCCVLPVAGQAVLCQDSINGGGNGGNNGGNGGNNGGNGGNNGGNTDYPGGNGGNNGGNNGGNNGGNNGGNNGGNNGGNNGGNNGGNNGGNNGGNGGNGGNGYQACPAGLLYSNPQCCSTGVLGVADLDCKNPSSAPTSGDDFQKICANGGQQAQCCSIPVAGQAVLCQPAIGGGNPGGNGGNNGGNGGNGGNNGGNNGGNGDYPGGNGGNNGGSNGGGNGGNGGNGGSFKCPSGLYSVPQCCATDVLGVADLDCGNPSRQPTDSSDFASVCAAKGQRARCCVLPLLGQAVLCTGA

SEQ ID NO: 32168 - protein, 235 aa, Lactococcus lactis
  misc_feature (1)..(1): Xaa can be any naturally occurring amino acid
  misc_feature (8)..(8): Xaa can be any naturally occurring amino acid
  misc_feature (39)..(39): Xaa can be any naturally occurring amino acid
XLSRLLYXADEPNGLQSTFSGSAWEFDEESGQYFLHLFXKRQPDLNWENPQVHKEVYDMMNFWIDKGIGGFRMDVIDLIGKEIDQEITGNGPKLHEYLHEMNQATFGQKNLLTVGETWGATPEIAELYSDPERQELSMVFQFEHITNAYLDEGEKWDKKEFSVSKLKEILAKWQALEKGWNSTYINLYYYANPSQPLALLFVILLFWGMNKMFNKRSFAAFLMVAFGAAGLPLSH

SEQ ID NO: 32169 - protein, 259 aa, Streptomyces coelicolor A3(2)
MPAPAPSPVLLGVSLKMYFGHHQTLNWSRRIAALAERHPAVTSGAARLFVLPTFPALVPATGILAPYGVALGAQDIATEDSGPYTGEVGGPVLKEIGCRYAEVGHAERRRLYGEGDTVVAAKTAAALRNGLTPVLCVGERDAADPADAASRTVAEAERLLGGLSGAVVLAYEPQWAIGAPEPASADHIATVCTALRGWLDSHPRHAGSTVIYGGSAGPGLLTRLAGTAEGLFLGRFAHDPANVGAILDEIRSPAPAAVA

SEQ ID NO: 32170 - protein, 3971 aa, Bacillus subtilis
MYTSQFQTLVDVIRNRSNISDRGIRFIESDKIETFVSYRQLFDEAQGFLGYLQHIGIQPKQEIVFQIQENKSFVVAFWACLLGGMIPVPVSIGEDNDHKLKVWRIWNILNNPFLLASETVLDKMKKFAADHDLQDFHHQLIEKSDIIQDRIYDHPASQYEPEADELAFIQFSSGSTGDPKGVMLTHHNLIHNTCAIRNALAIDLKDTLLSWMPLTHDMGLIACHLVPALAGINQNLMPTELFIRRPILWMKKAHEHKASILSSPNFGYNYFLKFLKDNKSYDWDLSHIRVIANGAEPILPELCDEFLTRCAAFNMKRSAILNVYGLAEASVGATFSNIGERFVPVYLHRDHLNLGERAVEVSKEDQNCASFVEVGKPIDYCQIRICNEANEGLEDGFIGHIQIKGENVTQGYYNNPESTNRALTPDGWVKTGDLGFIRKGNLVVTGREKDIIFVNGKNVYPHDIERVAIELEDIDLGRVAACGVYDQETRSREIVLFAVYKKSADRFAPLVKDIKKHLYQRGGWSIKEILPIRKLPKTTSGKVKRYELAEQYESGKFALESTKIKEFLEGHSTEPVQTPIHEIETALLSIFSEVMDGKKIHLNDHYFDMGATSLQLSQIAERIEQKFGCELTVADLFTYPSIADLAAFLVENHSEIKQTDTAKPSRSSSKDIAIIGMSLNVPGASNKSDFWHLLENGEHGIREYPAPRVKDAIDYLRSIKSERNEKQFVRGGYLDEIDRFDYSFFGLAPKTAKFMDPNQRLFLQSAWHAIEDAGYAGDTISGSQLGVYVGYSKVGYDYERLLSANYPEELHHYIVGNLPSVLASRIAYFLNLKGPAVTVDTACSSSLVAVHMACKALLTGDCEMALAGGIRTSLLPMRIGLDMESSDGLTKTFSKDSDGTGSGEGVAAVLLKPLQAAIRDGDHIYGVIKGSAINQDGTTVGITAPSPAAQTEVIEMAWKDAGIAPETLSFIEAHGTGTKLGDPVEFNGLCKAFEKVTEKKQFCAIGSVKANIGHLFEAAGIVGLIKSALMLNHKKIPPLAHFNKPNPLIPFHSSPFYVNQEVMDFTPEDRPLRGGISSFGFSGTNAHVVLEEYTPESEYAPEDGNDPHLFVLSAHTEASLYELTHQYRQYISDDSQSSLRSICYTASTGRAHLDYCLAMIVSSNQELIDKLTSLIQGERNLPQVHFGYKNIKEMQPAEKDNLSKQISDLMQHRPCTKDERITWLNRIAELYVQRAVIDWRAVYSNEVVQKTPLPLYPFERNRCWVEAVYESAKERKEKGEVALDINHTKTHIESFLKTVISNASGIRADEIDSNAHFIGFGLDSIMLTQVKKAIADEFNVDIPMERFFDTMNNIESVVDYLAENVPSAASTPPQESVTAQEELVISGAQPELEHQEHMLDKIIASQNQLIQQTLQAQLDSFNLLRNNSHFVSKESEISQDKTSLSPKSVTAKKNSAQEAKPYIPFQRQTLNEQVNYTPQQRQYLESFIEKYVDKTKGSKQYTDETRFAHANNRNLSSFRSYWKEMVYPIIAERSDGSRMWDIDGNEYIDITMGFGVNLFGHHPSFITQTVVDSTHSALPPLGPMSNVAGEVADRIRACTGVERVAFYNSGTEAVMVALRLARAATGRTKVVVFAGSYHGTFDGVLGVANTKGGAEPANPLAPGIPQSFMNDLIILHYNHPDSLDVIRNLGNELAAVLVEPVQSRRPDLQPESFLKELRAITQQSGTALIMDEIITGFRIGLGGAQEWFDIQADLVTYGKIIGGGQPLGIVAGKAEFMNTIDGGTWQYGDDSYPTDEAKRTFVAGTFNTHPLTMRMSLAVLRYLQAEGETLYERLNQKTTYLVDQLNSYFEQSQVPIRMVQFGSLFRFVSSVDNDLFFYHLNYKGVYVWEGRNCFLSTAHTSDDIAYIIQAVQETVKDLRRGGFIPEGPDSPNDGGHKEPETYELSPEQKQLAVVSQYGNDASAALNQSIMLKVKGAVQHTLLKQAVRNIVKRHDALRTVIHVDDEVQQVQARINVEIPIIDFTGYPNEQRESEVQKWLTEDAKRPFHFHEQKPLFRVHVLTSKQDEHLIVLTFHHIIADGWSIAVFVQELESTYAAIVQGSPLPSHEVVSFRQYLDWQQAQIENGHYEEGIRYWRQYLSEPIPQAILTSMSSSRYPHGYEGDRYTVTLDRPLSKAIKSLSIRMKNSVFATILGAFHLFLQQLTKQAGLVIGIPTAGQLHMKQPMLVGNCVNMVPVKNTASSESTLADYLGHMKENMDQVMRHQDVPMTLVASQLPHDQMPDMRIIFNLDRPFRKLHFGQMEAELIAYPIKCISYDLFLNVTEFDQEYVLDFDFNTSVISSEIMNKWGTGFVNLLKKMVEGDSASLDSLKMFSKEDQHDLLELYADHQLRISSTLDHKGVRAVYEEPENETELQIAQIWAELLGLEKVGRSDHFLSLGGNSLKATLMLSKIQQTFNQKVSIGQFFSHQTVKELANFIRGEKNVKYPPMKPVEQKAFYRTSPAQQRVYFLHQMEPNQVSQNMFGQISIIGKYDEKALIASLQQVMQRHEAFRTSFHIIDGEIVQQIAGELDFNVRVHSMDREEFEAYADGYVKPFRLEQAPLVRAELIKVDNEQAELLIDMHHIISDGYSMSILTNELFALYHGNPLPEIPFEYKDFAEWQNQLLIGEVMEQQEEYWLEQFKQEVPILQLPADGSRAMEWSSEGQRVTCSLQSSLIRSLQEMAQQKGTTLYMVLLAAYNVLLHKYTGQEDIVVGTPVSGRNQPNIESMIGIFIQTMGIRTKPQANKRFTDYLDEVKRQTLDAFENQDYPFDWLVEKVNVQRETTGKSLFNTMFVYQNIEFQEIHQDGCTFRVKERNPGVSLYDLMLTIEDAEKQLDIHFDFNPNQFEQETIEQIIRHYTSLLDSLVKEPEKSLSSVPMLSDIERHQLLMGCNDTETPFPHNDTVCQWFETQAEQRPDDEAVIFGNERCTYGQLNERVNQLARTLRTKGVQADQFVAIICPHRIELIVGILAVLKAGGAYVPIDPEYPEDRIQYMLKDSEAKIVLAQLDLHKHLTFDADVVLLDEESSYHEDRSNLEPTCGANDLAYMIYTSGSTGNPKGVLIEHRGLANYIEWAKEVYVNDEKTNFPLYSSISFDLTVTSIFTPLVTGNTIIVFDGEDKSAVLSTIMQDPRIDIIKLTPAHLHVLKEMKIADGTTIRKMIVGGENLSTRLAQSVSEQFKGQLDIFNEYGPTEAVVGCMIYRYDTKRDRREFVPIGSPAANTSIYVLDASMNLVPVGVPGEMYIGGAGVARGYWNRPDLTAEKFVHNPFAPGTIMYKTGDLAKRLRDGNLIYLGRIDEQVKIRGHRIELGEVEAAMHKVEAVQKAVVLAREEEDGLQQLCAYYVSNKPITIAEIREQLSLELPDYMVPSHYIQLEQLPLTSNGKINRKALPAPEVSLEQIAEYVPPGNEVESKLAVLWQEMLGIHRVGIKHNFFDLGGNSIRATALAARIHKELDVNLSVKDIFKFPTIEQLANMALRMEKIRYVSIPSAQKISYYPVSSAQKRMYLLSHTEGGELTYNMTGAMSVEGAIDLERLTAAFQKLIERHEVLRTSFELYEGEPAQRIHPSIEFTIEQIQAREEEVEDHVLDFIKSFDLAKPPLMRVGLIELTPEKHVLLVDMHHIISDGVSMNILMKDLNQFYKGIEPDPLPIQYKDYAVWQQTEAQRQNIKKQEAYWLNRFHDEIPVLDMPTDYERPAIRDYEGESFEFLIPIELKQRLSQMEEATGTTLYMILMAAYTILLSKYSGQEDIVVGTPVSGRSHMDVESVVGMFVNTLVIRNHPAGRKIFEDYLNEVKENMLNAYQNQDYPLEELIQHVHLLKDSSRNPLFDTMFVLQNLDQVELNLDSLRFTPYKLHHTVAKFDLTLSIQTDQDKHHGLFEYSKKLFKKSRIEALSKDYLHILSVISQQPSIQIEHIELSGSTAEDDNLIHSIELNF

SEQ ID NO: 32171 - protein, 375 aa, Neisseria meningitidis
MLECTINYCSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGNVYQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 32172 - protein, 423 aa, Thermus sp. Z-1
MTENAEKFLWGVATSAYQIEGATQEDGRGPSIWDAFAQRPGAIRDGSTGEPACDHYRRYEEDIALMQSLGVGAYRFSVAWPRILPEGRGRINPKGLAFYDRLVDRLLASGITPFLTLYHWDLPLAQEERGGWRSRETAFAFAEYAEAVARALADRLPFFATLNEPWCSAFLGHWTGEHAPGLRNLEAALRAAHHLLLGHGLAVEALRAAGAKRVGIVLNFAPRYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEGRLRAREEGVDLRGYFVWSLMDNFEWAFGYTRRFGLYYVDFPSQRRIPKRSALWYQ

SEQ ID NO: 32173 - protein, 357 aa, Oryza sativa (japonica cultivar-group)
MSDMAAECGSGNCDAWAARDPSGILSPYKFNRREVQSEDVSLRITHCGVCYADVIWTRNMFNDSIYPLVPGHEIAGVVTEVGADVKGFKVGDHVGVGVYVNSCQDCENCNSSLENHCSKCVVTYNSVDSDGTVTKGGYSSHILVHQRYCFKIPADYPLSKAAPLLCAGITVYTPMIRHNMNQPGKSLGVIGLGGLGHMAVKFGKAFGLKVTVFSTSESKREEAINLLGADNFVISSDENQMESLKSSLHFIIDTASGDHQFDPYLSLLKVGGVMVLLSFPSEIKVHPENLNLAARSLAGSVTGGTKDIQEMINFCAANNVYPDIEMIKIDYVNEALQRLINRDVRFRFVIDIENSFK

SEQ ID NO: 32174 - protein, 296 aa, Oryza sativa (japonica cultivar-group)
MAPTAAAGLAARDASGHLSPLTISRRSTGDDDVVIKILYCGICHSDLHSIKNEWKNATYPLVPGHEIAGVVTEAGKNVTKFKGGDKVGVGCMVNSCHSCDSCNQGLENHCPGVIFTYNSVDKDGTVTYGGYSSMVVVHERFVVRFPEAMPLDKGAPLLCAGITVYSPMKYHGLNVPSKHVGVLGLGGLGHVAVKFAKAFGMTVTVISSSPGKRQEALERLGADAFVVSKNADEMNAATGTMDGIINTVSANIPIAPLLGLLKPNGKMILVGLPEKPMEIPPFALVACNCIGGMADT

SEQ ID NO: 32175 - protein, 359 aa, Oryza sativa (japonica cultivar-group)
MEHDGTAALGWAARDASGHLSPFSFTRRVQEEDDVTIKVLYCGICHTDLHTIKNEWGNAMYPVVPGHEIVGVVAGVGAGVTRFKAGDTVGVGYFVDSCRACDSCGKGDENYCPTMVITSNGTDYGGATTQGGFSDVMVVRQDYVLRVPASLPPDGAAPLLCAGVTVYSPMVEYGLNAPGKHLGVVGLGGLGHLGVKFGKAFGMKVTVISSSPAKREEALERLGADAFLSSRDGEGMAAAAATMDGIIDTVSAGHPLVPLLSLLKPKGQMVVVGAPAAPLQLPAIAIIDGGKRVAGSGGGSVAECQAMLDFAGEHGIAADVEVVAMGDVNAALGRLERNDVRYRFVIDVAGTLHAAAAPS

SEQ ID NO: 32176 - protein, 360 aa, Oryza sativa (japonica cultivar-group)
MEEHGKAAVGWAARDDSGVLSPYNFSRRSKDDDVTIKVLYCGICHTDLHVVKNDWGNAMYPVVPGHEIVGVVTGVGAGVTKFKAGDTVGVGFFVGSCRTCDSCGKGYENYCPTMVITSNGKDYGGAATQGGFSDAIVVNEHYVLRVPAGLPLDGAAPLLCAGVTVYSPMVIHGLNAPGKHVGVVGLGGLGHVAVKFAKAFGMRVTVISTSPGKRREALEHLGADEFLVSRDAGQMAAAAGTMDGILNTVSAWHPVAPLFALMKPMAQMVFVGAPTRPLELPAYAIVPGGKGITGNCVGGIRDCQAMLDFAGEHGITAEVEVIKMDYVNTAMERLEKNDVRYRFVIDVAGSSLGGSGDDKI

SEQ ID NO: 32177 - protein, 363 aa, Oryza sativa (japonica cultivar-group)
MEEHGKAAVGWAARDDSGVLSPYNFSRRSKDDDVTIKVLYCGICHTDLHIVKNDWGNAMYPVVPGHEIVGVVTGVGAGVTKFKAGDTVGVGYFVASCRGCECCGNGYENYCAKMVTTCNGVDHDHGGGAATQGGFSDAIVVNEHYVLRVPAGLPLDSAAPLLCAGVTVYSPMVIHGLNAPGKHVGVVGLGGLGHVAVKFAKAFGMRVTVISTSPGKRQEALEHLGADEFLVSRDAGQMAAAAATMDGILNTVSAWHPIAPLFSLMKPMAQMVFVGGPTRPLELPAYAIVPGGKGITGNCVGGIRDCQAMLDFAGEHGITAEVEVIKMDYVNTAMERLEKNDVRYRFVIDVAGSSLAGSGDAKI

SEQ ID NO: 32178 - protein, 362 aa, Oryza sativa (japonica cultivar-group)
MEHNGTAALGWAARDTSGHLSPFSFTRRVQQEDDVTIKVLYCGICHTDLHIIKNEWGNAMYPVVPGHEIVGVVTGVGAGVTKFKAGDTVGVGYFVDSCRACDSCGKGYENYCPTMVITSNGTDYGGATTQGGFSDVMVVRQDYVVRVPASLPPDGAAPLLCAGVTVYSPMVEYGLNGPGKHLGVVGLGGLGHLGVKFGKAFGMKVTVISSSPAKRGEALGRLGADAFLSSRDGEGMAAAAATMDGIIDTVSAGHPLVPLLSLLKPKGQMVVVGAPAMPLQLPAYAIIEGGKRVAGNGVGSVAECQAMLDFAGEHGIAADVEVVAMDAVNAALGRLERNDVRYRFVVDVAGTMHAAAAAAASS

SEQ ID NO: 32179 - protein, 358 aa, Laminaria digitata
ASIPTVEYLLSKGARVALSSHLGRPKDDGDKFSLGPVAERLTELIGKECKMAPDCIGDEVAAIANGLGDGEVMLLENVRFYPAETKNDPAFAKKLAAPFDLFVNDAFGTAHRAHGSTEGVTKFLSPSVAGFLLQKELDYLEGAVKVPASPFAAIVGGSKVSSKIGVIESLLAKCDKLIIGGGMVFTFLKARGQGVGSSLVEEDKLELAKELEVKAAAAGVQIILPSDLIVADAFAADAKTQVVRADAIPDGWMGLDNGPEATKEIQAALKECKTVVWNGPMGVFEYEAFARGTFAIAETLAEITSEGCTTIVGGGDSVAAVEKAGLAPKMSHISTGGGASLELLEGKVLPGVAALNDA

SEQ ID NO: 32180 - protein, 463 aa, Schizosaccharomyces pombe
MDDIEDSLDQWKFAQCFGDKGDVEDITEADIISAVEFDHTGDYLATGDKGGRVVLFERNHSKKGCEYKFFTEFQSHEPEFDYLKSLEIEEKINKIRWCKRTNRAHFLLSTNDKTIKLWKLYEKNLKVVAENNLSDSFHSPMQGPLTTPSQLRLPRLNHHDMIIAAYPRRVYANAHAYHINSISVNSDAETYISADDLRINLWNLSISDHSFNIVDIKPENMEELTEVITSAEFHPINCNHLMYSSSKGNIKLLDLRQSALCDNPCKLFEDQEDQDSKSFFSEIISSISDVKFSQNGRYILSRDYLTLKIWDVNMEKAPVKTIPLHDVLRSKLCDLYENDCIFDKFECTFSGDDKHVLSGSYSNNFGIYPTDSSLPGDRGQIVLQADKAAFRARKSAANNVPKLNAVKNNDWRSQPQAAMGSASVGLDPDNLDYNKKILHASWHPFEDSVAIAATNNLFVFSKL

SEQ ID NO: 32181 - protein, 472 aa, Blumeria graminis f. sp. hordei
MPTFGFLKKRKKVSLGHRDLDSPASTLSQPASPITPSTSRGLGEPIDTTSSKITSPGQKLGSNITKDHRGTRTTVEDLPSMTDVSHLQQAYRNLSQGSTASKSNLLTIHNLINPPQHDGAGQSKVMPEKHMNNKTERPVQGKAAVAQVRQTKGKYSLSDFEILRTLGTGSFGRVHLVQSKHNQRFYAVKVLKKQQVVKMKQVEHTNDERSMLQEVKHPFLITLWGTFQDSKNLYMVMDFVEGGELFSLLRKSQRFPNPVAKFYAAEVTLALEYLHKKDIIYRDLKPENLLLDRHGHLKITDFGFAKKVTDITWTLCGTPDYLAPEVVSSKGYNKSVDWRWSLGILIFEMLCGYTPFWDNGSPMKIYENILKGRVKYPPYIHPDAQDLIQRLITADLTKRLGNLHGGAEGIKSHQWFAEVTWERLAKKDIDAPYVPPVKAGSGDASQFDKYPEETERYGQTGPDEHGSLFENF

SEQ ID NO: 32182 - protein, 357 aa, Magnaporthe grisea
MAEFVRAQIFGTTFEITSRYSDLQPVGMGAFGLVCSARDQLTNQNVAIKKIMKPFSTPVLAKRTYRELKLLKHLKHENVISLSDIFISPLEDIYFVTELLGTDLHRLLTSRPLEKQFIQYFLYQIMRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENTLRFVKSLPKRERQPLKNKFKNADPSAIDLLERMLVFDPKKRITATEALAHEYLTPYHDPTDEPIAEEKFDWSFNDADLPVDTWKIMMYSEILDYHNAEAGMQQMDDQFTGQ

SEQ ID NO: 32183 - protein, 328 aa, Deinococcus radiodurans R1
MTAAAPALSLRGLSKAFGAVQAVGDVSLEVQAGETLALLGPSGCGKSTVLRSVAGLERPDAGQVLVGGRDVTALPPEARHLGLVFQDYALFPHLSVLDNVAYGPRRRGSSRPDAAQQAREALALVGLSEHERRLPAQLSGGQQQRVALARALATRSPLLLLDEPLSNLDEKLRSELRHDLRGLFGQLGAGVLLVTHDQREALALAHRVAVMRAGHVVQEGAAADLFARPATAWVAEFLGWTNVFAHPQVSGQALLVPESAVQLGAGGELLRVLSRQRSETGETVTLAHPLGPLTLSLSPREAAAASGDELRLTVPSAALLQVPDDREG

SEQ ID NO: 32184 - protein, 488 aa, Deinococcus radiodurans R1
MSKITGFLEQPRVKEQYAPIDARLKHYHEFMLPLDSASARLQATRCMDCGIPFCNNGCPVNNIIPDFNNLVFEDDWKAALDVLHATNNFPEFTGRICPAPCEAACTLNISEDPVGIKSIELAIIERGWQEGWVRPTPAEVKTGKKVAVVGSGPAGLAAAQQLARAGHDVTVFEKNDRVGGLVRYGIPDFKLDKSHIDRRIEQMQAEGVTFRTGVLVGDWDENSKITNLSKERVTPAELREQFDAVVLAGGSETPRDLPAPGRELNGIHYAMEFLPQQNRVNAGDKFKGQIRADGKHVVVIGGGDTGSDCVGTSNRHGAAGVTQFEVMPQPPEQENKPLTWPYWPMKLRTSTSHEEGAVREFAIATKEFIGKGGKVTGVRTVRVEMKDGKLEEIPGSEETHKADLVLLAMGFTNPMQSVLDAFGVDKDPRGNVLAGTEEHGGYLTSVPGVFAAGDMRRGQSLVVWAIREGRQAARAVDQFLMGESVLPR

SEQ ID NO: 32185 - protein, 193 aa, Deinococcus radiodurans R1
MRLMSDTYNAEGFTQTPYLSTERQTKFTQAPELGDAIEPGKQYRAVLETSKGRIVVELYPDEAPMTVNSFAYLLRHHYYDGIKFHRVIDGFMAQTGDPTGTGMGGPGYKFEDEFAGNHHRHSGKGVLSMANAGPGTNGSQFFITFTATPHLDNRHTVFGKVVEGLDVLDRITRIQPGMGGTPDVIETAYLVEK

SEQ ID NO: 32186 - protein, 465 aa, Deinococcus radiodurans R1
MTRDRNDRYDNSRDDRFDRQGQGRGVGRPGDMNDRYGHYDYGSMPMDPASGMQQGGQRYGQSSGQGYDRDQRDYSDRGYGGGMGSMGMGRSYSEDQGRYRSMGGQDYGRQGMGQDYGRQDYGRQDYGRQSSGMGSYDDRSGMGSMSYGQRGMGGGGYGQSQSYGSYGDDSRYGQGMGNQRGGMGSGRDEYSYGQSSYGMGGQGYSQQGSQGYQGGGYQGGQSYQGGYGSQGMGQQGYGGSMGGQGMGMSGMGRDYASSTSMSMGSMGTQGGYGQSYGQSQSYGQSGMGSGQQQSYRGKGPKGYQRSDDRVKEAVSDALEDADHVDAENIEVQVQNGEVTLTGTVSDRGQKRRAEECVEHLRGVKDVHNQLRVQQSQGQQAGMSSYGSQMAQGGQSGIGSMGMGSQSGSSSSSSQSSNLGHDAMTSAGNETSSDSSSTGSGSSSATGSTGASSTGSSTSTSSSTQK

SEQ ID NO: 32187 - protein, 449 aa, Deinococcus radiodurans R1
MTSVSPTPDGILRQLQDAEVSFLRLQFTDILGHTKNVEVPRTQFAKALSGDVTFDGSAVQGFTRVEESDMLLSPDLSTFLVYPQFARDDRERGRVARLICDVTLPDGTPFEGDPRRVLRAQVERAQALGLEMYVGTEPEFFLFERGPNGAATTVTHDRAGYFDLAPIDRGERIRREIASRLVEMGFEIEASHHEVAPGQHEIDFRYAPALETADRIATFKFVVKRIALEHGLLASFLPKPIAGVSGSGMHCHLSLFKDGQNVFDDPGGEHGLSDTAHQFVAGLLDHAEGMTAITNPLVNSYKRLVPGFEAPVNIAWSTSNRSALVRIPAKRGPSTRAELRMPDPSCNPYLALAAMLAAGLDGIERQLEPPPAIQRNIFRMTVREKRHHRVKELPGDLREAVDELAKDEVIAAALGEHVMEHYVTAKRAEWREYSSAVHAWELERYLDLV

SEQ ID NO: 32188 - protein, 479 aa, Deinococcus radiodurans R1
MRGLAITPPRSLSQFRAPFLGTHYTFPMTSYTPERPLRVAVIGSGPSGIYAAEALLKQTEFPVEVDVYDRLPTPYGLVRYGVAPDHLTIKSVTKGFEKTLSDPRVRFLGNVEFGRELSAEDARAHYDAVMYTVGASSDRRLNIPGEDLQGSMSATEFVAWYNGHPDAATREMLLSAEGVAVIGVGNVALDVSRILAKTVNELRGSDIAPHALPVLERSSVKDIYILGRRGPAQAAFTTKELREFGELAGAEPVVKPAEVQLREEEEAQVTDNVKKKNIEVLRDFAVRTQEGKERRVHLRFLVSPVEILDDGEGRVAGLKVERNRLDEQGNAVGTGEYETLPVQLVLRSVGYRGVALPGVPFDDRRGVIPNEEGRVQGRPGEYTAGWIKRGPSGVVGTNRKDATDTVAHLLSDAREGKLLTPAHTTRAEVDALLAQKGADVFTFEDWQTLDAHELTQGQAQGRPRHKVARREDMLGLRKR

SEQ ID NO: 32189 - protein, 310 aa, Deinococcus radiodurans R1
MGTSSAASAAEPRAGSGITTAFLGLGAMGFPMAAHLAAQAASGGGRALVWNRTEAKAQDHAARAGSEAVSLADTAQADVLFTCLPTSAEVDEIIAALSPHLRPGTVWVDCTSGHPDAARRQRETLDALGVKFLDAPVSGGTSGAEAGTLTVMLGGPADEIDAASPHLAFAGKVVRVGETGAGFAVKAVNNMLLAVNLWAAGEGLAALGRSGVDLGAALSVINASSGRSNASENLIPQRVLTREFPVTFALGLLAKDTGIALDVVQSAKASAPTLAQVAGLIRAAAHVVGPQEDHTAALKLLEQMNAQEIR

SEQ ID NO: 32190 - protein, 414 aa, Deinococcus radiodurans R1
MNDKQLKQLSRALGVGGSGRQRVLPAADGDYYDYLDTLTDSQVEVAGRVHDFMRAEVMPIMNEYWSRDEFPRDLIGKMRELNLLRSIWNEDGTRKPDATLIEGVVILEACRVDVSTAVFFGVHGGLATASIALGSDEEQKKRWLPDMLDMKKIGAFGLTEPEGGSQVSEGMRTTCRRDGDGWVLNGEKKWIGNSTFSDFTVIWARDEETNEVRGFVVEAGTPGYDVEKIQGKIALRMVENGHITLKDCRVADANRLQAVQGWETVSQVLKLTRAGVAWQGVGCAMGAYELALAYTQTRKQFGKRIGEFQLIQSHLTHMLADVTAMLGMVMRLSHIADEGRMDDAHAALAKVHTAARCREVVARAREVFGGNGILLEHGVAKHFCDTEAIYSYEGTNEINTLVVGRAITGLSAFV

SEQ ID NO: 32191 - protein, 455 aa, Deinococcus radiodurans R1
MPSPRFASLRNMTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 32192 - protein, 303 aa, Deinococcus radiodurans R1
MTSLPLIVSAGEALTDLVTAGGNTWHAHPGGAGWNVARACARLGVPSAFAGAVGQDNFGDDLHRESLEAGLDPRFLQRVPAPTLMAVVYSTRPPQYRFLGENSADLHFDPTRLPGGWLGAARWLHVGGISLARWPLADTLLGVIEAARAAGVRISFDPNARIAHRHPDYPAVFAAVTKRADLLKFSDEDLAFFFPGASEAQALQELRGLNPRCPIVVTRGAAGASLYHSAGRVDLPTVPVEVADTVGAGDSLCAGLLVSATERPDALWTEHLRFGLGAASVTCAHAGAYAPTREEVAALSSGK

SEQ ID NO: 32193 - protein, 218 aa, Deinococcus radiodurans R1
MTDLSELNFDPSGLIPVVTQDARSGAVLMQAYADRAAVERTLDTREATYYSRSRGEQWVKGQTSGHTQRVVSVHVDCDGDSLLYRVEQTGPACHTGEYSCFYRPLLEDDAPDTGLDGTLERVYATITERLATLPEGSYVARLHAGGLDRVLKKISEEAGEVLLAAKNADRAELATETADLLFHTLFALAEVGVSPADVAAVLQGREGKSGLKGPKEVG

SEQ ID NO: 32194 - protein, 317 aa, Deinococcus radiodurans R1
MIESFIGHTPLVQLRRVVTPDMADVFIKLEGQNPGGSIKDRTALGLVQDAERRGVLKPGGTIVEPTSGNTGIGLAQVAAAKGYKLILCMPAQMSEERKRTLRAYGAELILTDPERRMLAAIEEAEKIAAETGAVMMNQFANPANPATHEASTGPELWEQMEGRVDAFVYGTGTGGTITGTGRYLKRQDPNIQVIACEPARSNVLSGGERGNHGFQGMGPGFIPDNLDRSLLDDVIQVWEEDAYPLARRLAQEEGIFIGMSSGAMVWTALEVARRLGPGKRVVTIACDTGARYLTTALFSGEGDTPAGYLPYSRERVE

SEQ ID NO: 32195 - protein, 465 aa, Deinococcus radiodurans R1
MGLGLSKSQPECPQASPSKSSAKLDAPTAAAPTLGSMTGNEQNPSKWLAAEKKYDSGVYNKHDVVMVRGQGATVWDENGRSYIDCVVGYGVATLGHSHPDVVKAVQEQAGKLMVMPQTVPNDKRAEFLQELVGVLPQGLDRVFLCNSGTEAMEAAKKFAITATGRSRFVSMKRGFSGRSLGALSFTWEPKYREPFGDAVDNKSVDFVTYGNLDELRAAVTEQTAAVIMEPVQGEGGVRPASAEFIQEARRITREKGALLILDEIQTGFCRTGKMFACEHFGVIPDGMTLAKAIAGGTPTAAFAMMSEVADRMPAGGHGTTFGGNPLSMAAGVASLRAMKREGLAEQAREKGAYMMDKLRAIQSPKIREVRGLGLMIGVELKEKSAPYIHAMEHDEGVLCLAATPLVVRFLPPAVISKEQIDQVVAAFERVLNNVNPREERQAELRAQQSEMGQQQVSQGESVQTE

SEQ ID NO: 32196 - protein, 160 aa, Deinococcus radiodurans R1
MTDFIPTTDLSDAQPQAQVAAPVLRDFGGRTRFQGAAVTLRISENNPLVRQTLQTPGAGRVLVVDGGGSLNCALLGGNLGVFGVENGWEGVIIHGCVRDTAELRELDLGIRALAAHPRRSGKLEEGERDVPVTFAGVTIRPGDHVVADEDGWLVLGAESP

SEQ ID NO: 32197 - protein, 392 aa, Deinococcus radiodurans R1
MDNSARFRTRAVHAGHGLDPATGAHAMPIYATSTFGYGDAARGQRLFAGEEQGHFYSRLSNPTVRAFEEKLASLEGTEDALAFASGMGAASAILLTLLRSGDEVAFLAPLYGGTEGLLQDMLPKFGIRVWEAKDPADLRGRLTDRTRLVWLETPSNPTLRLTDLREVADLAHGAGARLVVDNTFSTPYLTRPAEFGADLVMHSATKYLGGHGDVIGGVVAGDAATLLDLRLHGLRHVGASLGPFEAYLLLRGMKTLPLRMEAHCAGAHLIAERLAARGDLKVYYPGLPEHPGHDLARRQMSGRFGGIVSLDLGDFAAAQQFLDALQLFTQAVSLGDVESLSSHPASTTHQLLGEEVLNAHGIVPGLVRLSVGIEDPEDLWADIEQALRQARR

SEQ ID NO: 32198 - protein, 270 aa, Deinococcus radiodurans R1
MTATPETATNRGVQRLHAAFARAEAEGRAAFIPFMTGGYPDAARFGEVAGDLLARADIMEVGIPYSDPLGDGPTIQRASEQALAGGTSTRRTLELVRELRQKDDTPIVIMTYINPIYAVGPAEFMRLAQEAGVDGLILPDLPPDQDLEIADLAAQHGLAVTFLIAPTSTPERVKLVAEACTGFLYAVSVTGVTGAREGAALGEVPRMLDLARQYAQRPVVVGFGVKDAATAQQVAQVADGVVVGSAFINAVAAGRDVGALADELAAGCRR

SEQ ID NO: 32199 - protein, 490 aa, Deinococcus radiodurans R1
MLEAVPAALSRSLTTAVTSLFGGLMTTAQPDAQPGAQPIADLGLKPGQLHLNPGVDDLYAHAIRLGEGVQAATGPLTVRTNKTGRSPKDRFIVEDDQTRETVWWEGFNQPISAEVFDRLLDKMVKYAEGRELFVQQVFAGTDAEHRIPVRMITEMAYHSLFIRNMFVRPTAEELQNFQAEWTVLNIPSFKADPAVDGTRTDTFILVNFSKKMIIAGGTQYAGENKKGIFGVLNYLLPAKGIMPMHCSANVGEDGDVALFFGLSGTGKTTLSADPGRKLIGDDEHGWTDTGVFNFEGGCYAKVINLSAEAEPAIYQTTRNYGTVLENVVLDESGTPDLDDGSLTENTRSAYPIEQIANIQPGSVGGIPKNVVFLTADAFGVLPPLSRLTPEQMMYQFISGFTAKIPGTEEGVTDPTPTFSTCFGAPFMPRHPGEYARLLAQKVEESGAKVWLVNTGWTGGKYGEGHRMSLNLTRLKSRDSHFADHCPPKQV

SEQ ID NO: 32200 - protein, 449 aa, Deinococcus radiodurans R1
MRIVIVGGVAAGMSAASRAKRFDPDAEVVVFERGDFISYGACGLPYVLGGAVGEWDDLIARTPAQMRGRGIGVQLGHEVTGVDAEARTVTVLDRAAGRVATEPYDRLLVATGVSAVRPDWAQTDLAGVHVLREIPDGQAIADSLKGAGRVCIVGGGYIGLELAENMCRQGLSVVLLERNPDVGGRVLDPEYRPRLLDELGRHGVDVRCGTTVEGLIGKAGRVTGVQTDGGLVRADVVVVAVGVKPNVDLLRAAGARLGKTGAAAVDVRQQTNVDGVYAAGDNCESLHRVTRRRVHIPLGLTANRMGRIAGINMAGGDAKFPGVVGTSIFKVFGLGVARTGLTQGEAAALGLNAVSVDVTSTDHAGYYADARPIHVRLTGERGTGRLLGGQLVAENPLSVKRVDVIAAHLHSRGKVEDLFQMDLAYAPPFSGVWDVLLVAADRLNRALRA

SEQ ID NO: 32201 - protein, 388 aa, Deinococcus radiodurans R1
MREAVWRAFLSEQDPARCANCGRKSSAAKRRRWQRWARPSVPRRRRPAPCSLAARYLPPMSETMKAIVVERIGTPDVMELREVPRPAPRAGQVLLRVEAVGVNFADALSVGGQYLTATKVPYVPGMELAGTVVELGEGVTNVQVGQRVAALGGTGGLAEYAAVPAAGVVPVPESFTPAQAAAFPVSFMTAYHALKTLGRGEAGEWVLVQAAAGALGTASVQLAKALGMNVIALASTEEKLQLARNLGADVTILQDDPDRVQKVRDAAGGKGVPLLLEVVGGSRFDESLKMVAPLGRIIFIGNASREEVSMNPAALMKRNVSVIGLWLTSLMLDAEVSAAASQGLAPLIASGKVVPQVGPSYGLADSSRAFQDILDRKTTGKVVIEPQR

SEQ ID NO: 32202 - protein, 503 aa, Deinococcus radiodurans R1
MERVAVLFRRTCNSENCSKGRRPLRERPLAGLFFCSLPAPLSIPCLSLPGSNPGDFVPKVKTNYICNSCGYQSAKPLGRCPNCQAWNSFEEEVPTASTSGKSGRGGLGGYGGVKGGKLTPLSTVGRREEPRTPSGIPELDRVLGGGLVAGGVTLIGGEPGIGKSTLLLQVADKVASRGGTVLYVAGEESLEQIRLRADRLGVAADLQMTRDTRAEHIAALLEEHKPALCIVDSIQTVTVEGEGAPGGVAQVRDGTAMLTRAAKETGTATVLVGHVTKDGTVAGPKVMEHIVDTTVFLETVGAFRLLRSVKNRFGQAGELGVFEMRGEGLIAVDNPSAAFLAERPLDVPGSVVAATVDGQRPMLLEVQALASKTPYPNARRVVVGLDPRRVDVVLAVLERRLDLTLGGLDVYVNLAGGLKVPDPGLDLAVALAVYSAVVGRALPQNVAVFGEVGLAGEVRSTQMALRRAEEAGRAGYKRLVVPPGLDGQAGVKSVEEAVKAVWR

SEQ ID NO: 32203 - protein, 498 aa, Deinococcus radiodurans R1
MSRPPAILRPAMSEPVSAVPLSAPVTPEWVADAVFYQIFPDRFARSGRVTGLHLQPWGSAPTIHGYMGGDLWGVAERLGDLAGLGVNALYFCPVFQSASNHRYHTHDYFQVDPMLGGNAALRHLLDEAHARGIRVVLDGVFNHASRGFFQFNDLLEHGEASAYRDWFHVTGWPLSAYDEDRPANYAAWWGIRALPKFNTDHPEVREFLLSVAEYWMHFGIDGWRLDVPNEIDDDAFWQEFRRRVKAINPDAYIVGEIWGDAGRWLAGDQFDAVMNYHFTRPCLGFFGARTLDHPMNERSGTGRVEPLDAAAFAVRVEEVTRMYHPAVVRAQLNLLDSHDTARFLTAVGGDASAQRLALVFQFSYVGAPCLYYGDEIGLPGGVDPDCRRAFPWDEPQTWDHDTLTLVRELTAARHRSAALRRGDFTVLHAQGEQVSFARKHDGEAAYVAFNCALDAAPVPVPATSGRYRDMLTGAVHDLNESSVLTLPARTAALLLCEG

SEQ ID NO: 32204 - protein, 293 aa, Deinococcus radiodurans R1
MTDAGGQEQREQWQQEEAAGYAVAFQGNPGSYGEIAALNALPQVRETLGYPTFHEVARAVENGEADYGVLPVENSLMGAIHQSIDLLTETELHVTGEVVVRVSHCLMALPGVEMADIRKVGSQQPALDQCTHLIREHGWQPLAKHDTAGSAKDLAERGARDEAAIASRRAAELYGLNILQTGVEDEPFNFTRFMVLSRHAPEPSDAPHKTSLIFAVRHTPGFLLETLGELRGLNLSRIESRPRRDRAWSYLMYVDIEGKASDPQVAQALAGILVKASYAKIIGSYPAAQGTVQ

SEQ ID NO: 32205 - protein, 244 aa, Deinococcus radiodurans R1
  misc_feature (106)..(106): Xaa can be any naturally occurring amino acid
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 32206 - protein, 411 aa, Deinococcus radiodurans R1
MTGLCPLHQPSPLDHPHSGGTPMQNLSQLDVKGKRVLVRVDYNVPVGDGVVQDDTRITASVPTIKKLLDGGASVVLMSHFGRPKNGPEDKYSLKPVAEAVSRALGQDVKFIPSLPGSDETLQAVQALRPGEVALLENVRFEAGEEKNDAALNDKLAKLGDAFVLDAFGSAHRAHSSVSGVAGKLPHAAGGLLQSEVDALGKLLHAPEHPYVVIIGGAKVSDKIKVIENLLPKVDRMLIGGGMMFTFIKARGGQIGNSLVEDDQLDLAKGLLEKYGDKLLLPTDAVAADKFAADAQSKVVPADQIPDGWMGLDIGPDTQRAYADALQGAKTVFWNGPMGVFEFDQFAAGTNAVAAAVGSLKDQAYTVVGGGDSVSAINKSGKADQIDHISTGGGASLELLEGKELPGVVAMA

SEQ ID NO: 32207 - protein, 176 aa, Deinococcus radiodurans R1
MSLPPGNGPVQISAEQIKARIQELAAQIRSDYAGQRPHLICVLNGAFMFHTDLVRALDMPATIDFMQASSYGTAKQSSGEVRLVKDLAFPISDRHVIMVDDIVDTGITMSYLLHYLQGRGPASLKVAALLSKPSRRKVEVPVDYLGFTIPDAFVYGYGLDRAQLDRNLPFITSQEE

SEQ ID NO: 32208 - protein, 299 aa, Deinococcus radiodurans R1
MPCGATAPAENWRRAGRLLEQFSELRVRRKSTATRSILCFAALQVRPALCFVLALLAQKLCHLFVKCSRLDPVSHSSASPAPARAVKLAPSILSCDFSRLGEELQAIAGADWAHVDVMDGAFVPNISFGLPILAAARRASNLPMDVHLMIERPERYLRDFAEAGADSITVHVEATQHIHRAVQQIKELGKKAGVTLNPGTPLEAVRPLLADVDLVLVMSVNPGFGGQKFIPASTERVRTLRGWLDEVNPQAELQVDGGVTPANARLLAEAGATCLVAGSAVYGADGGAAGVQRLRDALA

SEQ ID NO: 32209 - protein, 510 aa, Deinococcus radiodurans R1
MQFRSRGAPVCRVPARLWRMSLQSPPELPSGFIRTSDVLHERLTPARARHLDLQYGNEELLYGLDVLGLAGPFYRTSPWELEDEQGVRRINACGYAALPFGEMPPAITSFMQEFLEHNRAMTLPQQSSSPWRAALQTNLVKLLSRELPSHSDSQVFFCSSGTEAIEGAMKFAKAWRPEARHFISFGSGYHGKTYGSLSLTPNPEYQDVFRPLVPGALTSPYGDLDALKALVRRAGPDKIIAVVVEPIQGEGGVNIPPPGFLRGLGEFCRSHGIVVIADEIQTGLGRTGHWFESAAQGLDADIITLAKPLGGGLVPVGATIVRQPIYKKMLGGLSSKRHSNTFGGGALSMAVGLKSLEYLLENDLPARSRALGEQGLARLQDLQRRFPKLLQAVRGQGLLLAMQFQPVVGLALPGAIRELVYEGTAILALRELHHARVMANLSLSSKRVVRLSPALDMPQDVFTELMDRVERFAQLNPNARSLVTHTPAPTLLRLATFAASKPKKRTPSDG

SEQ ID NO: 32210 - protein, 483 aa, Deinococcus radiodurans R1
MHHLILPALLLASAASAQAAPTSTGPSFEGQIIYQVMPDRFFDGDPSNNAGVDRANLRAWHGGDLAGLTQKLPYIQKLGATAIWMTPIYRQQTAKSFDTAAYHGYWPADFRQVDPHFGSMATFDTFMKAAKGAGMKVVLDQVINHYGYEAPAVKANPGWFNGKAQCDATKNKDVDCPLAGLPDLRQSVPAVRQQLFGNGDFWRARGVDGFRYDAIKHVERPFLLDLLKKDRAAGTWTLGEWYDADAGTVAEWQKQGFDSLFLFSLQAAMRGSVMGASSLVNVREVLRRSDELARPGEVALFLDNHDVPRFSQGSFFEDEGQARTKYGLRALLTLRGVPVLYQGTEIAMRGGADPDNRRDMRFESQWTPAEKAVYNVARDAIAVRKASPPLSRGTQTLLPVPDRQADDLLLLTREQGGQRVLVAWHNGLKRQSYSLKLSTLGIKANAQDVTKTLFAGQDAKVSVKGGYLHLSLPPKDAAAFVLR

SEQ ID NO: 32211 - protein, 323 aa, Deinococcus radiodurans R1
MVRPDFFLLGEPMPVDPNLYQLLLQLSQAPEPAGLEELRAGVIANAARSPKRPVTIGEVRDLSVAGAEGSLPARLYHPAGQAPASGWPLTVFFHGGGFVVYDLDTHDALCRELCATSGAAVLSVAYRLAPEARFPAPVDDALASVVWAAAHAAELGADAGRLAVAGDSAGANLATVTALRSRDEGGPALRAQLLIYPAADFEHPERYPSRQENGRGYFLTDERMRFFGQMYLARPEDAAHPHASPLNAESLAGLPPALVLTAEFDPLRDEGALRRSSQGRWRNAEYRPGPGMIHGYANMTAFSPVAAQLIDEAGVWLGEQLRG

SEQ ID NO: 32212 - protein, 458 aa, Deinococcus radiodurans R1
MEEAGRAVAAAAQECCPAGRVLLLAGGGANGGDALVAARHLFALGRDVAVLALPAKHPLTRSNRRRLARIGVEVAPLTPASLRRELKTAALVVDGLLGTGFTPPLRAPLAELVAQVNASGVPTLAIDLPTGLDALTSEVSGDPLRAAWTVTLSGLKPALLFGPAAYLAGEVTLADLRSPPDWALEEALASRPTDAEIAALLPVRHADAHKGTAGRVWVVGGHPGTVGAAALAGVAALRAGSGLVTIHSATDVPLVMPELMMRCHADLSAALMEMPEEQRPDALCVGMGLGPDAASIARQLLGWRLPTVLDADALQPELAGAGHDACIWTPHPGEAARLLGTSTPDIARDPIAAARALQEKFGGVVVVKGGPSVIAHTGGVWVSRGGHPGMASAGMGDTLSGLLASLLGQGLSAPDAALAGVTLHARAGELAGAKHGYGLTATDVSAELGRAWLGLVGG

SEQ ID NO: 32213 - protein, 368 aa, Deinococcus radiodurans R1
MVMKIGMIGLGKMGGNMVIRLKNGGQDVVGFDRSQEAIDHLVSQGVAADALTSDMDRFIELLGEPGQRAVWVMVPAGQITQSVIDDLAGRLSAGDVIIDGGNSNFHDTQRRGEALAAKGLHFVDVGTSGGVWGITEGYGMMVGGPDEGVERIRPALEALAPAPDRGWGHMGPTGSGHYVKMVHNGIEYGMMQAYAEGFELMKAHQTFNLDMAQIAEVWRHGTVIRSWLLDLTAEALKNSADFDQLSDYVADSGEGRWTIIDSIELGVPTPVITLATQMRFRSQQDVSYQGQMLSAMRRAFGGHAVKTLEATKQESVVPAVKPGESPKAAAPENIPTAAAQPSISGRSEAQELGETGQQRTTGDQKAGE

SEQ ID NO: 32214 - protein, 265 aa, Deinococcus radiodurans R1
MTAPLSSDPAAGAVAVSARTVGEPIIVAQNVQKHFGTFHALRGVNLTVRQGEVVVIIGPSGSGKSTFIRTINALDPHDGGSITVDGLPLQGARNLDAIRREVGMVFQSFNLFPHLTVLDNITLAPTRVRGVDKAQAQARGLDLLRRVGIEEQAYKFPAQLSGGQQQRVAIARALAMEPKIMLFDEPTSALDPEMIKEVLDVMKELARTGMTMLVVTHEMGFAREVADRILFFDQGNIVEDTTPEAFYQNPQHERARQFLSKILGH

SEQ ID NO: 32215 - protein, 370 aa, Deinococcus radiodurans R1
MTSPSSTATSSPTTTTAPTPARMRALSKQQPGEGIWMIETEVPTPGPNDLLIRIRKGSICGTDVHIYKWDDWASQTVPVPMVVGHEYVGVVAGMGSEVRGFEIGDRVSGEGHVTCGHCRNCRAGRRHLCRNTQGVGVNRPGSFAEYLVLPAFNAFKLPDDIPDDVAAIFDPFGNAVHTALSFDLVGEDVLITGAGPIGCMAAAVARHVGARNVVITDVNDYRLDLARQMGVTRAVNVAREDLWTVATQELDMHEGFDVGMEMSGSGPAFAQMVSVMNNGGKVALLGIPSGEVQIDWNAVIFKMLTIKGIYGREMFETWYKMAALIQSGLDLTPVITHHYGIGDFQQGFDAMLSGQSGKVILDWETEEQSA

SEQ ID NO: 32216 - protein, 400 aa, Deinococcus radiodurans R1
MTLIESSREPGDKLAVLSCRCDKSVTVHRVHWAHQRNHNQAGRVKFAAPGGRFLGGWPFFFGLEQFSELRRRRNSTATRSILRPARWFALAPLAKKRCTLFVKCSRVQSPGPALFMVGVMNTQQGAQDLTGRRILITGATGGIGLETARELAGRGAQVVIVGRDPGRTARVAAEVGAAGTLLADLSELVQVERAAAEYRERFGELDVLVNNAGALHRERQESREGIELTWALNHLAPFLLTRELLPLLRRSSETRRVPARVVTVASAAHVVGRIRFDDPEFRRGYAAWPAYAQSKLANILFARELARREPSVLSVSLHPGMVASGFGKNGGGRFAQAYGLLDRFSLTPEQGAQTSLHAVSAPVHTGGYYANARRVTPAPQALDDGAAARLWALSEGYLQV

SEQ ID NO: 32217 - protein, 445 aa, Deinococcus radiodurans R1
MVPAPPFLGHAAEMGTIKLRPFLTRCYQAYGPVFQLTVPGQKITVLAGPEANLFAMKEGHRVLRSLEAWRDNDHEMGSDRSMISLDGAEHRAYRRVEGRAFARSFFAAGLRPALAVLAEDLAPFQPGDVLPVATWCKKTITEQLARMAVGGTVRPYLPDLLHFIQTALQVTVNRQLPPAVLRLPKYRRAKARIFQMVDDLIEDHRQNPPEKSGRAPDLIDDVLADQQVNPERWEHPDVRLAALGAFIAGMDTAANSLAFVLYRMHLHSEFLPALRAEADALFRDGPPTAEALGRSPLLHRFVMETLRVHPIAPALSRTLTEDVEFAGHRIPAGTPVIIGTTVPHGLPELFPDPEHFDPGRFAPGRAEHRQPGAYAPFGVGSHTCAGSGMAEGLIMLGAAAALRTLDLSLEPDYVLRQTAKPTPSLDNKLQLRVNAVRHNPVFLVH

SEQ ID NO: 32218 - protein, 152 aa, Deinococcus radiodurans R1
MTAASYAGQLTFSTSHLSTCDPHDLHGCFTEFLASGRARYSRRMTQDLQVEKYQEGSGQPAEKGKMVSVHYTGTLENGQKFDSSRDRGQPIEFPLGVGYVIPGWDQGIAQMRVGDKARLTIPGHLAYGEAGVPGVIPPNATLIFDVELMDVR

SEQ ID NO: 32219 - protein, 500 aa, Deinococcus radiodurans R1
MSVPAAPQTPSQSQEDRYRYKFAQEGITFDDVLLQPRHSQVLPHEVDVSAQLTRRVRLNIPFVSAAMDTVTETNMAIAMAREGGIGVVHKNMSIDAQAEMIRKVKRSESGMIVDPITLPPSATVRDADRLMGEYRISGVPVTAPDGKLLGIITNRDMRFIDDLDVPLGDVMTREHLVTVPVGTDLEQARELFKLNRIEKLLVTEGEYLRGLITIKDIEKSVKYPNAAKDDLGRLRVAAAIGVSADLMDRAGALVQAGADVLVLDSAHGHSQGILNALSRVKEQFDVDVIAGNVATRSGARDLILAGADAVKVGIGPGSICTTRVVTGVGVPQVTAIFEASAAAMEAGIPVIADGGIKQTGDVPKAIAAGASVVMMGSMLAGTDEAPGETILRDGRRYKSYRGMGSLGAMDQGSADRYFQGGSRKFVPEGIEGIIAYRGTAGEVIYQFVGGLKSSMGYCGAPDLTTLRDTAQFVRITGASLVESHPHGVTITKEAPNYGGR

SEQ ID NO: 32220 - protein, 327 aa, Deinococcus radiodurans R1
MCPSCAATFLSPILLGMTHGTPAQAPNTQTSNAQSPNAAASGTFLIGGELEVNRLGYGAMRVTGDGVWGDPADREGSLATLRALPGLGVNLIDTADSYGPAVSEELIREALHPYPGLVVATKGGLTRTGPNVWPPCGRPEYLIQQAQISRRRLGVERIDLWQLHRIDPQVPRDEQFGAIRQLLDDGVIRFVGLSEVNVEEIEAARQVFPVATVQNLYNLTNRKSEAVLDYCGREGIGFLPWYPLASGKLAAEGSVLTETAARLGAAPAQVALAWVLRRSPVMLPIPGTSKVKHLEENVAAASLTLTDEDFRALDEAGRAEWEAGQQK

SEQ ID NO: 32221 - protein, 350 aa, Deinococcus radiodurans R1
MKGKKAGVQQPRAKQARANVRYIDLHLPLGPGFYAEGMKKWMLTPLLGLGLVACAPTQTAMLTPNPPLKGPGIVAEVNGAAPATSTTTAVTTTTPGTTTAATTTEQTTMTTVTETPAAPAAATPAPATSASTPAPVPATQTTAATVTQTPAATPAPATTADGWTTLAPRSAERRTSFTAAEQVIDTSKSYRAVLHTSKGDVTVNLDAKAAPLAVNNFVFLALNHFYDGTRFHRVIEGFMAQGGDPQSADTALSDRWGTGGPGYQFANERSSLTFNRAGVLAMANAGPDTNGSQFFITFGPTEFLNGGYTIFGQVDSGMDAVNKLTRNYNNAGPIAGAQADVLNSVEIQVK

SEQ ID NO: 32222 - protein, 274 aa, Deinococcus radiodurans R1
MSTMKFTAAQEFVAELLGTLVLILFGCGVVAMVKLFGSSPAIPGEVVMGGYTNIVLGWGFAVLMGIFVAGTITGAHLNPAVTIALAATGRFPWAKVGYFILAQMIGAFLGAAIVFAVYHAKWLGVDPGLDHTAGIFSTFPAVPGFLPGFIDQVVGTALLVGLILAIGDKLNNPAGAAWGSLAVAFVVMAVGISFGGMNGYAINPARDLGPRLFALLAGFKNLGDINVWLVPVIGPIVGGLVGAFIYDFCIGRPLLRAGEAHVGVQGVDPEFNRQ

SEQ ID NO: 32223 - protein, 197 aa, Deinococcus radiodurans R1 [sequence omitted]

SEQ ID NO: 32224 - protein, 418 aa, Deinococcus radiodurans R1
MTNTPSSPNDASWSYDTAAVQSGIPRGLGETIGFPIHAAAAFQFDTLEQAQDEFQYNGGLSYARIQNPTVRALEERLTVLEGGAATVALASGQAASLTAILSVCRAGDHVVSSASLFGGSTGMLTNILPLMGITATLVEGHPEQIRAAMQDNTRLVWAEMISNPSGAVADVEALAGVAHERGALLAIDNTCGGVGYLCRPLDHGADIVSQSLTKWAGGHGSVMGGSVTVGTQHDLSRNPIYAGGENSLLEQRGADALAWRQRWFGAHQLGMTLAPHSAFLIAQGLETLGLRLQRESDSALALARWLGQHPRVGGVSYAGLPGHPSFPLVQKYLPRGAGAVLTFEVDDPSRFLSRLRVLRMAPNLGDVRTLVVHPWTTTHGRVPEAARHAAGVTPGTIRMSVGVEDVMDLQADIEQALN

SEQ ID NO: 32225 - protein, 370 aa, Deinococcus radiodurans R1
MTVSSAAAPQPASPAAPLLFTPLKLRSLELPNRVVVSPMCTYSATDGVANEFHLVHLGQYALGGAGLILAEATAVSPEGRITPEDLGLWDDRQIVPLGHITDFVHQHGGHIGVQLAHAGRKASTYAPWRGKGAVPAELGGWQVIGPDENSFHDLFPTPAMMGADELRGVVDAFSAAARRAQVAGFDAVEVHAAHGYLLHQFLSPLANTRTDDYGGSFENRTRLLLEVVRAVRHVWPAHLPLFVRLSATDWAEGGWDLEQTVQLSKLLKYEGVDVLDISSGGLTAAQQIEVGPGYQVPFAAAVSRAETEISVMAVGLIETGAQAEAILQAGDADLIALGRPFLRDPHWAQRAARELGLRPVSIDQYARAGW

SEQ ID NO: 32226 - protein, 327 aa, Deinococcus radiodurans R1
MTTLPTRQLRDLTVSALGLGCMGMSEFYGDADEAESLRTLDRALDLGVTFFDTADIYGPYHNEELLGRWLRGKRDRVVLATKFGIVRDPADPSRRGFSGRPEYVRQSIEGSLNRLGTDHVDLYYLHRVDPDTPIEDTVGAMADLVQEGKVRALGLSECSADTLRRAHAVHPISAVQSEYSLWTRDPEENGVLAACRELGVGFVPYSPLGRGFLAGQLKSPDDLAPDDFRRHNPRFQDENFQKNLDLVREIERLAAEKGCTPSQLALAWVLAQGENLVPIPGTKRVKYLEENVGALDVRLTPDELRQIDATFPVAAGDRYPDMRHVNR

SEQ ID NO: 32227 - protein, 382 aa, Deinococcus radiodurans R1
MWASQRASSVPGSVFSLMDAAKMRARGRGLNVTDLSIGSSDQHPPLSVLDELRAATHDPATYRYPLFSDTQPLRDAAAAYLARRFGVRLNADTEVLPLIGAQEGLAHLLLAVTDPGDTLLLPDPCYPPYWGAAAVAGLNVVTLPLLPERGFLPDLSRVPANVRPRVLLLNYPNNPTSAIASAEFFREAAAWCRERGTLLVHDHPYAELTFGDYRAPSALEAGMEGVVELHSLSKTHHLGGFRVGFAAGDAGAVAALARVKGAIDFHPYLGIQRAAAHALGLPDEVGRVGARIFEERRDALLSALRDLGWEVQTPQASMYAWAQVPGLRDSVAFAVRAAEETGVVVSPGQAFGERGEGFVRFALVQPPEVLRGAAAKLGEVGV

SEQ ID NO: 32228 - protein, 403 aa, Deinococcus radiodurans R1
MTVTRPLTLPCGVTIKNRLLKGAMSEALGTRDHAPRPELPALYARWARGGTGILLTGNVMVDARALGEPGNVVLEDERHLAEFHTWAVQGSRDGAALWLQLNHPGKQAPRGLNAGGTVAPSALPYPGSMARAFEMPRALTVPEIHDLTARFARSARLAQRAGFGGVQLHAAHGYLLSQFLSPRHNVREDEYGGSLENRMRFLLETFDAVRAAVGPHFPVSVKLNSSDFVRGGFSEDDSLAVVAALGARGCDLIEISGGTYEKPMMMLGQGERGGFFADFAGRARAAAGVPLCVTGGFRDAATIRQTLASGAADVVGLGRPLVADPAFSARMLRGEDVSSEVRPLKTGIGLLDGSGYLEIAWYEDAMRRLARGEQVRAGEAPLLALARSAAETGLGSVLRRRRA

SEQ ID NO: 32229 - protein, 467 aa, Deinococcus radiodurans R1
MTNNFDYDVLVIGAGPGGYHAAIRASQLGLKTACVERGAVGGVCLNIGCIPTKALLHAAETMQASKHAAEFGLTFSGQALDIARLNGWKDSIVKKLTGGVSGLFKANKVTLLTGQASFVDDHTVQVGDKTYTAANIIIATGSDPAKLPGLEVDQQQIVDSTGALVMPDPVPARMLCVGGGVIGFEFAQVYNNLGSQVKIIEFLPSVIPGADADAVKEFSKIMSRQGIEIVTQMKANRAEKKSDGVHVELENVKTGEKTTEVFDRVLVAVGRRPRTDGLNPEQAGVTVTERGFIPADKQQRTNVPHIFSIGDVAGNPMLAHKAMKEGLVAAEVIAGKPAEQDAVAIPGVVYTNPELAWVGLTEAEAQEKGYEVKTGVFPMSASGRAMTLQATEGFVKMVVEKDTDLLLGVHIVAPHASDMLAEAGLALEMAATATDISLTIHAHPTLGESILEAAEASHKQAIHIVNR

SEQ ID NO: 32230 - protein, 480 aa, Deinococcus radiodurans R1
MPLWRGGTLRSDMDTFDVLVIGGGPAGYVAAIRAAQLGFKTACVDAFERGGKPSLGGTCLNVGCIPSKALLDSSERFEMISHDTAEHGIQVAQPQIDVSKMLARKDGVVDKLTGGVAFLFRKNKVTSFHGYGKLVRQDGQEWVVDAAGTEVKAKNVIVATGSNPRALPGVPFGGHIVENSGALQIDQVPGKLGVIGAGVIGLELGSVWRRLGAQVTILEAMPGFLMAADDAIAKEALKQFQKQGLDFHFGVKIGEIKQDDSGVTVTYEENGSQVTAQFDKLIVSIGRVPNTGGLNADGVGLALDERGFVKVDQHYRTNLPGVYAIGDVIGGAMLAHKAEEEGVALAEMIAGQAGHVNYDVIPWIIYTSPEIAWAGLTEKQAKERGLNVKTGQFPFSANGRALGHGDPRGFVKVVADAQTDKLLGVHMIGGGVSELIGEIVAIMEFGGSAEDLARTIHAHPTLSEVVKEAALAVDKRAIHM

SEQ ID NO: 32231 - protein, 336 aa, Deinococcus radiodurans R1
MARRRLPSMTHGNSSQSDRPRIISPLAPRADAAEVVRGVDLKGKTAVVTGGASGLGTETARALLLAGAHVILPVRDRAKGERVAAELRQSTGGTVELVDLDLGSLASVRRGAAEIRQLAPRIHILINNAGVMATPQSRTVDGFETQFGTNHLGHFLLTRELLPALMAAAPARVVALTSSGHRRSDIVWDDLNFERRPYDPWDAYGQSKTANALFAVGLTQRYADQGLTANAVHPGGIMTGLQKFVPLEDQRRMGWQDEHGTLNPVFKTPAEGASTSVWAATSPQLYGVGGLFLEDLQHSTPLDESAPNPLFGYKPYALDHESARRLWALSEALVGE

SEQ ID NO: 32232 - protein, 410 aa, Cyanidium caldarium
MARAKFERSKPHINIGTIGHVDHGKTTLTAAISAVLASIDNTVKLKKFDEIDAAPEEKARGITINTSHVEYQTPLRHYAHVDCPGHADYVKNMITGAAQMDGAILVVSAADGPMPQTREHILLAKQVGVPSIVVFLNKADMIDDEELLELVELEVRELLSKYDFPGEEVPFVAGSALLALEACLKNPTIGKGKDKWVDKIFELMDMVDKYFPTPERDIDKTFLMAVEDVFSITGRGTVATGRIERGAIKVGETVEIVGLKSTASTTVTGLEMFQKTLDEGLAGDNVGVLLRGVQKQDIERGMVLAKPGSITPHDKFEAEVYVLNKEEGGRHTPFFPGYRPQFYVRTTDVTGNISQFTTDDGGSAEMVLPGDRIKMTVELIHPVAIEQGMRFAIREGGRTVGAGIVSKILD

SEQ ID NO: 32233 - protein, 187 aa, Cyanidium caldarium
MKSKVLQRFVLCITASLLFWNLNIATHASTLTPCENSAQFQARLNNNIKKLENKLTYYKQNSQEYTSIKQQIEKTKIRFDKYAKSSLLCGEDGLPHLITDGDWQHSGEFFIPSVLFIYIAGWIGWAGKGYLQYSKTLTKPNENEIIIDLPRALKYMFSGFAWPILALKEFKNGSLLASNDEITTSPR

SEQ ID NO: 32234 - protein, 266 aa, Cyanidium caldarium
MKNSIKNIFESERGLLLLPFVSLGTPNTQINKQAIIAMDKNGANIIELGIPYSDPVADGPVIQDAYNKAIKNGVNIRKAFKILMNLKGKIKSPIIVFIYYNQLLNYGINKFLEKLIQLEVQGIIVPDLPYDESQILKKKCTINNIALISLIALTSSFSRIKKIARNAEGFLYLISKTGVTGGTGKLMNKLKIIIKTIQKLTSKPVVVGFGINSRRQIKQLIEWNSNGIVIGSPCVQILLQSSKEVCVIKLSGLIKQIKESTSSTSN

SEQ ID NO: 32235 - protein, 173 aa, Cyanidium caldarium
MPRSQKNDNFIDKTFSIIADLIVKILPTNKESKEAFYYYKDGMAAQSEGEYAEALACYYQALKIEKDPMDKSFILYNIGLIQASNGQHARALEYYHESLKFNPNLVQALNNIAVIYHYYGNKLFEQSKLQEAKLMFDKASNYWRKAIKLAPYNYIEAQNWLKITGRITEDIML

SEQ ID NO: 32236 - protein, 197 aa, Arabidopsis thaliana
ISTDWTLEEQSLLEDLLVKYATEPSVFRYAKIAMKMKDKTVRDVALRCRWMTKKENGKRRKEDHSSRKSKDKKEKATDSSAKSSSHLNVHPNGPSYAPPMMPIDTDDGISYKAIGGVSGDLLEQNAQMFNQLSTNFSAFQLHENVNILCKARDNILAILNDLNDMPEVMKQMPPLPVKLNEELANSILPRPSHQRKS

SEQ ID NO: 32237 - protein, 387 aa, Pseudomonas sp. 'TAC II 18'
MTVLKMTDLDLQGKRVLIREDLNVPVKDGVVTSDARILASLPTIKLALEKGAAVMVCSHLGRPTEGEFSAENSLKPVADYLSKALGREVPLVSDYLNGVDVKAGDIVLFENVRFNKGEKKNADELAKQYAALCDVFVMDAFGTAHRAEGPTHGVAKFAKVAAAGPLLAAELDALGKALGAPAKPMAAIVAGSKVSTKLDVLNSLSQICDLLIVGGGIASTFLAAAGHPVGKSLYEPDLLDTARAIAAKVNVPLPTDVVVAKEFAESAEATVKLIADVAADDMILDIGPQTAEHFAQLLKTSKTILWNGPVGVFEFDQFGNGTKVLAKAIADSAAFSIAGGGDTLAAIDKYGVADQISYISTGGGAFLEFVEGKVLPAVEVLESRAKA

SEQ ID NO: 32238 - protein, 507 aa, Streptomyces coelicolor A3(2)
MTRYAAPGTEGAIVSYQSRYDHFIGGEYVPPARGQYFENPSPVNGLPFTEIARGTADDVERALDAAHEAAPGWGRTSVTERSDILLKIADRMEANLERLAVAESWENGKPVRETLAADIPLAIDHFRYFAGAVRAQEGSLGEIDDDTVAYHFHEPLGVVAQIIPWNFPILMATWKLAPALAAGNAVVLKPAEQTPASIHYWLSLVADLLPPGVLNVVNGFGVEAGKPLASSPRVAKVAFTGETTTGRLIMQYASENIKPVTLELGGKSPNIFFEDVWARDDDFRDKALEGFTMFALNQGEVCTCPSRALVQRGVYAEFMEAAVARTELIKPGHPLDTDTMIGAQASNDQLEKILSYLDIGRQEGAKVLTGGERIEHDGELKGGYYVQPTIFEGHNRMRIFQEEIFGPVVSVTSFDDFDDAVKTANDTLYGLGAGVWTRDMNTAYRAGRAIQAGRVWTNCYHAYPAHAAFGGYKQSGIGRENHKMMLEHYQQTKNILCSYSPKKLGFF

SEQ ID NO: 32239 - protein, 461 aa, Hordeum vulgare subsp. vulgare
MVHQSNGHGEAAAAAANGKSNGHAAAANGKSNGHAAAAAVEWNFARGKDGILATTGAKNSIRAIRYKISASVEESGPRPVLPLAHGDPSVFPAFRTAVEAEDAVAAALRTGQFNCYAAGVGLPAARSAVAEHLSQGVPYKLSADDVFLTAGGTQAIEVIIPVLAQTAGANILLPRPGYPNYEARAAFNKLEVRHFDLIPDKGWEIDIDSLESIADKNTTAMVIINPNNPCGSVYSYDHLAKVAEVARKLGILVIADEVYGKLVLGSAPFIPMGVFGHIAPVLSIGSLSKSWIVPGWRLGWVAVYDPTKILEKTKISTSITNYLNVSTDPATFVQEALPKILENTKADFFKRIIGLLKESSEICYREIKENKYITCPHKPEGSMFVMVKLNLHLLEEIHDDINFCCKLAKEESVILCPGSVLGMENWVRITFACVPSSLQDGLERVKSFCQRNKKKNSINGC

SEQ ID NO: 32240 - protein, 237 aa, Cicer arietinum
LLFLYVTILTIIGYSHQSDPKAGGTDCDGVGILGIAWAFGGMIFILVYCTAGISGGHINPAVTFGLFVGRKVSLLRAVFYMAAQCAGAISGTGLAKGFQKAYFDRYGGGANFVHDGYNKGTALGAEIIGTFVLVYTVFSATDPKRNARDSHVPVLAPLPIGFAVFMVHLATIPITGTGINPARSFGSAVIYNEGKIWDDQWIFWVGPIIGATVAAIYHQYILRGSAIKALGSFRSNA

SEQ ID NO: 32241 - protein, 492 aa, Cicer arietinum
LHQVIKANDDLSREHHQFFLYQMLRALKYMHSANVYHRDLKPKNILANSNCKLKVCDFGLARVAFNDAPTSIFWTDYVATRWYRAPELCGSFSSKYTPAIDIWSIGCIFAEVLLGKPLFPGKSVVHQLDLITDLLGTPLPETITGVRNDNARKYLAGMRKKLPVPFEQKFPNADPLALRLLQRLLAFDSKNRPTAEEALADPYFKGLAKVEREPSCKPISKLEFEFERRRITKDDVRELIYREILEYHPQLFKDYMNGTEGANFLYPSAIDQLRKQFAYLEENDGKSGSVLPPERKHVSLPRSTVYSGSILPSNQRTPALYEKKKMVEETSKSWGAAGENSRNQLRGVQPPPRVPAKPGRVVGPVLHYEDERITKSSNDPRIVIQNTTQAVSSRDAFQTHPPNTKTTSGIHKEQGKNEFPSLQSNLHATATTDLNNNPYRRRVINNNLNDPVTTIDAKMLQAQSHLGVVGAAAVAVATHSHRYSRGIQYGLF

SEQ ID NO: 32242 - protein, 407 aa, Streptomyces coelicolor A3(2)
MVVVGAGMAGVQTAVALREQGFTGPVTLIGAEPHQPYDRPPLSKAVLLGTAEGSAFDVDFEALGITLRLGCEALGVRPAEHVLDTSEGPVPYDVLVLATGAEPVRLPGAEGVPGVHLLRTLDDAERLRPVLARQHDVVVVGAGWIGAEFATAAREAGCAVTVVEAADRPLADALPAEVAAPMTAWYADAGAELRTRARVERVESGGPGESGRVVLDDGTRLAAGAVVVGIGARPATGWLAGSGIALGAHGEVLADDLLRTSAPDVHAVGDCASFPSARYGERLLVHHWDNALQGPRTVAADIVGTPGGETPAAYDPVPYFWSEQFGRFVQYAGHHTAADTTLWRGDPASPAWTVCWLREGRLVALLAVGRPRDLAQGRRLIQAGTPMDPDLLADPAKPLKAATAATA

SEQ ID NO: 32243 - protein, 397 aa, Schizosaccharomyces pombe
MLSQLIERSTQYVREASLEEQNRIMPLIDFGPYVNQEPGAHERIIQQLRAACESTGFFQIVNSPISPDVVKNAFRASKQFFELPFDEKLTLSKDMFSNRGYELMEDFVLEGEEDSSSPLEISGIDFEAGSYPGEAPLPPSSIGYVLPPSSLANGEGSSMFDADMTTSNAVAHGDESISNEFRESFYFGNDNLSKDRLLRPFQGPNKWPSTAGSSFRKALVKYHDQMLAFANHVMSLLAESLELSPDAFDEFCSDPTTSIRLLRYPSSPNRLGVQEHTDADALTLMSQDNVKGLEILDPVSNCFLSVSPAPGALIANLGDIMAILTNNRYKSSMHRVCNNSGSDRYTIPFFLQGNIDYVVAPLPGLGPSTAEPIAVEDLLRDHFQNSYTSHTTSLEVA

SEQ ID NO: 32244 - protein, 241 aa, Saccharum officinarum
GIRHEVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFVNPTDHNKPVQEVLAEMTNGGVDRSVECTGNINAMIQAFECVHDGWGVAVLVGVPHKDAEFKTHPMNLLNERTLKGTFFGNYKPRTDLPNVVELYMKKELEVEKFITHSVSFAEINKAFDLMAKGEGIRCIIRMEN

SEQ ID NO: 32245 - protein, 333 aa, Streptomyces coelicolor A3(2)
MTRPVVEGGPAVVCLGETMAQIVPIDGLRLHEASACAFGVAGAESNVAISLSRLGTAAFWAGFVGDDPMGLRVLGELRRHGVVTKLARTMPGRRTGVYFKDPAPEGSDIYYYRSGSAATLMDGEYAERIAAVRPRWIHLTGVTPALSENCREAVISLIELAGDTGASVSFDVNYRPSLWPARDAAAQSLMAIADRCNVVFVGLDEAQTLWKSCTAGAVRDHLPSPDVVVVKDGGREAVAFRGGRRTAVPALPVDVVEPVGAGDAFAAGWIHGALVGLDEAGCLRLGHLLAGAAMTSLSDVADLPTAPAALVARAKHGNEWPGHGSPAEASPHP

SEQ ID NO: 32246 - protein, 344 aa, Streptomyces coelicolor A3(2)
MIRLMTAMRTAGGGPLVAITECDHDSFDIERDVVTSAGGQLLVTQSRDADTMVVNCAGADAIVVQYAAITEQVMDRLPRLKVIGRYGVGVDSVDVEAATRRGILVCNVPDYGTEAVSDHAIGLALSVARGIPRLDRGVRAGSFDLPAVRPLYQVGQRVFGVVGMGLIGAATARKAAGLGYDVIAYDSAADPDAQTFRGFRSVGLHELLERAQVVSVHTPLTEQTRGLLGADAFARMRPDAIVVNTSRGGVIDTGALVDALKRGAVAGAGIDVHEIEPLPRDHPLTSFDNVVLTPHLAWYSEESYAELKRRTVENVVDACAGRTPRNVVNPEALPAAAQRSEGRR

SEQ ID NO: 32247 - protein, 492 aa, Streptomyces coelicolor A3(2)
MTHELFDSKGLLGSAPAAFVAGEYELDSSHGTLPVINPANGQLVAEVPSSSSSTVDRAVTAAVAAQREWGRRSHVARAAVLEAVRDAIAVHADELARIVSVEQGKPLSDARGETEGACAFFDFAISQKYRAVGSMMASEPGRSLGVREEPIGVVAAILPWNFPVAIFARKVAPALMAGNAVVLKPSELTPLSALALARLCRLAGVPDGLLSVVCGEGKDTGRALVTHPGVGMVTMTGSTRGGREILAQVADQIIPVSLELGGKAPFIVFEDADLDAAVEAAADARLWNTGQVCTCNEVTYVHADLHDEFVRRVVDRFASVTPLDPFAAGSRLGPLVAERERTRVQGMVDAAVAAGARVRTGGGRPDGEQYQSGAWFAPTVLTNVRPEMDIARREVFGPVLPIIPFDAEAEVVSAANSTAYGLTAYVYTRDLSRAMRMIDALEFGEVYVNQAGPEQVQGFHTGWKSSGLGGDDGPHGYEKYLRRKTVYVRHAV

SEQ ID NO: 32248 - protein, 326 aa, Streptomyces coelicolor A3(2)
MTDSRAGLGPQAAGGLLTFGETMGLVTATTIGTLEYARDFTFGIGGAESNVAIGAARLGAPVTWIGRVGSDAAGDLVGRRMRAEGIQTVAVRDTSFTGLMVRHHRAATVVHVDYHRAGSAGSRLTAHDIPVGEIRRAAILHLTGITPALSASARQATWDAVAAAKANGVRVSLDVNHRSKLWDRDTARRELRRLVAEADIVFAGIEEAQLVLDSEADAPESLADALAATGPGETVVKTGARGCTAHIDGAIHEEPALSVPVVDTVGAGDAFVAGYLAEHLRGAGPVQRLRTACAMGAYAVSVPGDCELLPTRSELETFLTTGDVLR

SEQ ID NO: 32249 - protein, 145 aa, Schizosaccharomyces pombe
TSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERS

SEQ ID NO: 32250 - protein, 115 aa, Schizosaccharomyces pombe
PRLHKLHHKWIICTPYASHAFKSADGFLQSLPYHLFPFFFPLHKLTYLALFTFVNFWSIMIHDGKYISNNPIINGAAHHNGHHIYFNYNYGQFTTLFDRLGNSFRAPDEAWFDKD

SEQ ID NO: 32251 - protein, 217 aa, Schizosaccharomyces pombe
RANASSQKEKVRREIAILKKCVHPNVVRLREVIDDPSSTKVYLVLEYMSGGEVPWTDCDSPVLSISEARQYFRDVVLGLEYLHYQGIIHRDIKPANLLLNSSNCVKISDFGVSYIANAGLNEDNDVELAKTVGTPAFFAPELCWTDLDRPRPKISEAIDVWALGVTLFCLLFGRCPFNASMEYELFDKIVNERLNIPSTPDIGEEGRDLLKRLLCKD

SEQ ID NO: 32252 - protein, 46 aa, Schizosaccharomyces pombe
VVISVKASCIDSTADAAVVFAREVKKMQEEKIKPQEQLTLEPYERD

SEQ ID NO: 32253 - protein, 271 aa, Sporobolus stapfianus
NEVEEEGEEFAAYCRRGKGRRRVEMEDRHVAKVALGGDPKAALFGVFDGHGGKNAAEFAAENMPKFVAEEMTKADGGESEIEGAVKRGYLKTDEEFLRRGESGGACCVTAVLQKGGLVVSNVGDCRAVLSRSGKAEALTSDHRASREDEKERIENLGGFVVNYRGTWRVQGSLAVSRGIGDAHLKQWIVADPDTRTLLVDQHCEFLILASDGLWDKIDNQEAVDLARPLCTSNDKASRMAACRMLVETSISRGSTDDISVVIIQLQNFSSS

SEQ ID NO: 32254 - protein, 250 aa, Sporobolus stapfianus
MPMRNIAVGNTQEVTHPGALKAALAEFISTLIFVFAGQGSGVAYSKLSGGITTPSSLISAAVAHAFALFVAVSVSANISGGHVNPAVTFGAFLGGNISLFRSILYWIAQLLGSIVACLLLRFVTGGLPTGTFGLTGISVWEALVLEIVMTFGLVYTVYATAVDPKKGSLGTIAPIAIGFIVGANILVGGAFDGASMNPAVSFGPSLVSWSWNNHWVYWVGPFIGAALAALIYDMLFISSHTHEQLPTTDY

SEQ ID NO: 32255 - protein, 298 aa, Buchnera aphidicola
QKKAYKLVSSMLKNISAKFKNEPCVSYIGPNGAGHYVKMIHNGIEYGDMQLIAESYFLLKYLLNMSNKELANTFSEWNQGELNSYLIDITKDIFLAKDNNGNYLIDCILDVAEDKGTGKWISQDALELREPLSLITESVFLRYLSSLKSQRVAASKILTGPNIERGVIKDKKIFIEEIRRALYLGKIISYAQGFSQLKKASEKYNWDLKYGEIAKIFRSGCIIRAKFLQKITEEYSYNEKIVNLLLTPYFSKIANKYETSLRKIVVESVKNGIAIPAFSTAISYYDSYRTVHSSANLI

SEQ ID NO: 32256 - protein, 297 aa, Buchnera aphidicola
QKEVYDFIAPLFEKISAKFEGQPCVSYIGTDGSGHYVKMVHNGIEYGDMQLIAESYFLMKHLFNMSNKELSDIFSKWNQGELNSYLLSITVDILVKKDNIGNCILDYILDEASNKGTGKWATKSALDLNEPLTLITASVFFRYLSSLKSQRLLASKLLFGPKYRSISNDKLDLVEQIRQALYLGKVISYSQGFSQLNSASKKYNWKFQYSEIARIFQSGCIIRAKLLKNISQEYLRNKNIVNLLLTSYFSDIANNYQNSLRRVVSIAVKLGIPVPALSSAISYFDCYRTSFLPANLI

SEQ ID NO: 32257 - protein, 297 aa, Buchnera aphidicola
SRKAYDYIAPILKKISSKFEGQPCVSYIGKDGSGHYVKMVHNGIEYGDMQLIAESYFLMKNLLKLDNQELSDIFLEWNKGELNSYLISITTNILIKKDINNSYIVDYILDEADNKGTGTWATKSALDLNEPLTLITSSVFFRYLSSLKSERMLASKMLFGPKNNHMLSNKIDLIEKIRKSLYLGKIISYAQGFSQLSSASKKYDWNLQYSEIARIFQSGCIIRAKLLKYISQGYLKNKDIVNLLLISYFKNIVNSYQDALRDVVSIAIKSGIPVPALSSAITYFDCYRSAILPANLI

SEQ ID NO: 32258 - protein, 505 aa, Streptomyces coelicolor A3(2)
MEAGKGRNRLRQRVPLPSHARAPAIPRRRTDREFRAMKRYDLVVIGGGSAGLTAARTAGRLGARTLLVERDRLGGDCLWTGCVPSKALLHVAADVQAARRATAYGLPPVTGPADLTAALAEVKRAIGAIEPHDSAEALAPYGVDVTHGAASFTGPGTLTAGEREVSFRYALIATGSSPALVPIPGLVESGPLTSDTVWELSELPHLLVVLGGGPIGCELGQAFARLGSQVTLVEAMDRLVPREEPRASQVLRERLQSEGVTVLTDYRAERVDADAVHGPGGPLPYDALLAVTGRRSHTHGLGLEAAGVELTDAGHIRTDGRLRTTNHRIYAAGDVTGRSAFTHLGGTQGGAAAVDALLGVRRPIDYRAAPRVTYTDPEIAGVGLTLDEAHAKYGDRARVHTLENDRVDRAVADGRTEGFTTLVLGPRGKIVGATVVSPRAGETVAHLAAAVRLGWTPSDYARTVHPYPTYADGPWHTALTDVYARLARGSGPIGALLKLRRGVIR

SEQ ID NO: 32259 - protein, 299 aa, Nicotiana tabacum
RGGGRGGPRGGGRGRGPGRGRGFNQESADDENAFGSNNGFSGRYRVQEDGESGKLSERRGGYGGPRGGFHGGRRGGFNNGDAAEGEGERPRRVFDRRSGTGRGNEYIKREGSGRGNWGTPADDIAQETEVPVNDGEKIVEAEKEAGQEEAEDTNKDSTAAEPEEKEPEEKEMTLEEYEKLMEEKRKALLALKPEERKVNLDKELESMQLLSNKKNDDEIFIKLGSEKEKRKEAVEKARKTQSINEFLKPAEGENYSRRGGRGRGPGRGRGGFGGGVGGNKSFSAPSIEDVGQFPSLVAK

SEQ ID NO: 32260 - protein, 356 aa, Spinacia oleracea
MATTNPFDLLDDDAEDPALIAAQQKVSAAVANEKKTPAAAAAKPAKLPSKPLPPSQAVREARNEGGRGGGGRGGRGYGRGRGPGGANRENDDTFANDNGAPMVYKEERGQTERRGGYGPPRGGYRGGRRGGFENGEAAEGERPRRTYERRSGTGRGGDVKREGSGRGNWGTPADEIAQETEEPAVVENEAVVAAEKPAGEEVADAGKENPEKEAEEVEPEEKQMTLEEYEKVLEEKRKALLALKAEERKVDVDKDFESMQLKTKKKVDDEVFIQLNSDKDKKKEAAEKEEKAKKSVSINEFLRPAEGGDQYQRRGGRGRGGRGGRGGNGGGGYGMNHATAPKIEDPNQFPTLGGKN

SEQ ID NO: 32261 - protein, 240 aa, Spinacia oleracea
GSFGGPRAPYRGGRRGGFNNEEGRDGERPRRTFERRSGTGRGSEVKREGSGRGNWGAESEEVAPVNEEGVEQTEKNVNSENLTAVEDAAVGNKEGQPEEAEEKEPEEKEMTLEEYEKLLEEKRKALLALKSEEPKVVVDKELESMQQLSKQQDDSSVFIKLGSDKDKKKEALEKEKVKKSVSINEFLKPAEGERFGGRGRGRGGRGSRGGEYGGGGGNRTYSAPAPAIGDPGEFPTLGGK

SEQ ID NO: 32262 - protein, 247 aa, Spinacia oleracea
QGDEGEGGRDRRSFGGPHTPYRGGRRGGFNNEEGRDGERPRRTFERRSGTGRGSEVKHRVLGAGNWGAESEEVAPVNEEGVEQTEKNVNSENLTAVEDAAVGNKEGQPEEAEEKEPEEKEMTLEEYEKLLEEKRKALLALKSEEPKVVVDKELESMQQLSNKKDDDSVFIKLGSDKDKKKEALEKEKVKKSVSINEFLKPAEGERFGGRGRGRGGRGSRGGEYGGGGGNRTYSALLLQLEIPGSSQL

SEQ ID NO: 32263 - protein, 270 aa, Buchnera aphidicola
MNRYQKLCKKLIPFKKGCFIPFVVLGDPSIDMSLKIINALIENGADGLELGIPFSDPIADGEIIQKANLRAFNSKINLHKCFDILSEIREKHQTIPIGLLLYSNLIFKFGINKFYLKCYKIGIDSILIADLPIEESYVFRKYAVINNILPVFICPPDAKKNVIKNIAIHSQGYIYLLSRSGVTGINQEIMIPPLSLINKLKKLTKTPLIQGFGVSYPYQIQKIILSGISGVICGSIIAKLIENYFQDDDKLIKEIIFLSKSFKKATIIIE

SEQ ID NO: 32264 - protein, 499 aa, Aspergillus flavus
MMVAWWSLFLYGLQVAAPALAATPADWRSQSIYFLLTDRFARTDGSTTATCNTADRKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCLIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 32265 - protein, 381 aa, Lolium perenne
MSAAPPSKRPPASFVFSTAAAVLIAALASSLIALSPRQAPPAAALRPIMSKARVYTDVNVVRPKEYWDYEALTVQWGEQDDYEVVRKVGRGKYSEVFEGINVTNSEKCVIKILKPVKKKKIKREIKILQNICGGPNIIKLLDIVRDQHSKTPSLIFEYVNNTDFKVLYPTLTDYDIRYYLYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLKKYHIELDPHLEHLVGRHSRKPWSKFINADNQHLVSPEAIDFLDKLLRYDHQDRLTAREAMAHPYFLQVKAAENSRSRPQ

SEQ ID NO: 32266 - protein, 333 aa, Lolium perenne
MSKAKVYADVNVVRPKEYWDYEALAVQWGEQDDYEVVRKVGRGKYSEVFEGINVNNNEKCVIKILKPVKKKKIKREIKILQNLCGGPNIVKLLDIVRDQHSKTPSLIFEYINNTDFKVLYPTLTDYDIRYYIYELLKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDGLNAYLNKYRIELDPQLEALVGRHSRKPWSKFINADNQHLVSPEAIDFLDKLLRYDHQDRLTAREAMAHPYFLQVRAAENSRTRAQ

SEQ ID NO: 32267 - protein, 461 aa, Hordeum vulgare subsp. vulgare
MVHQSNGHGEAAAAAANGKSNGHAAAANGKSNGHAAAAAVEWNFARGKDGILATTGAKNSIRAIRYKISASVEESGPRPVLPLAHGDPSVFPAFRTAVEAEDAVAAALRTGQFNCYAAGVGLPAARSAVAEHLSQGVPYKLSADDVFLTAGGTQAIEVIIPVLAQTAGANILLPRPGYPNYEARAAFNKLEVRHFDLIPDKGWEIDIDSLESIADKNTTAMVIINPNNPCGSVYSYDHLAKVAEVARKLGILVIADEVYGKLVLGSAPFIPMGVFGHIAPVLSIGSLSKSWIVPGWRLGWVAVYDPTKILEKTKISTSITNYLNVSTDPATFVQEALPKILENTKADFFKRIIGLLKESSEICYREIKENKYITCPHKPEGSMFVMVKLNLHLLEEIHDDIDFCCKLAKEESVILCPGSVLGMENWVRITFACVPSSLQDGLERVKSFCQRNKKKNSINGC

SEQ ID NO: 32268 - protein, 257 aa, Agrobacterium tumefaciens
MDATQPTLVAEDVHKNFGTLEVLKGISLTANKGDVVSIIGSSGSGKSTFLRCMNFLETPNKGRIAVGQEEVVVKTDAAGRLIGVDRKKIERMRMQLGMVFQSFNLWGHMTVLQNVMEGPLHVLKQPKGEVRDRAMDFLDKVGIANKHAAYPSQLSGGQQQRVSIARALAMQPSALLFDEPTSALDPELVGEVLKVIRKLAEEGRTMVVVTHEMGFARDVSSKVLFLEKGQIETQGTPQEVFQNPTSPRCRAFLSSVL

SEQ ID NO: 32269 - protein, 322 aa, Agrobacterium tumefaciens
MDKKVELIATGDVDKLRVSGCPPQEPGPGELRIRHDAIGVNYIDIYQRIGLYPLPLPAVLGVEGAGVIEAIGPDVDNIHVGDRVAYTGIPGAYSATRLLPAWRTIKLPDDISTRIAALSFLRGLTAHMLLTRTYSVKQGETLLIHAAAGGLGFVLTRWAKSLGCIVIGTTGSSEKADVARANGVDHVIVGREADVVSEIGRLTKGKGVDFAIDGIGGEMLRKTLGCVRRFGTVASIGQAAGPIPPVSVEELGPIRSLSLARPSVMAYAAEQETYHLAAKAVIAAIREGIMPEPGGEYPLSEAAQAQSDLESGRTAGSLMLVP

SEQ ID NO: 32270 - protein, 211 aa, Caulobacter vibrioides
SSEWAKNIICGFARMDGETVGIVANQPQVLAGVLDIDSSRKAARFVRFCDAFNIPIVTFVDVPGFMPGTKQEYGGLIKHGAKLLFAYTEATVPKITVITRKAYGGAYDVMSSKHLRGDLNYAWPTAEIAVMGAKGAVEIIFRQEAKDPEALAAREAEYKDRFANPFVAAQRGYIDDVIMPHGTRRRIVRGLKSLKGKELSNPWKKHDNIPL

SEQ ID NO: 32271 - protein, 125 aa, Brassica oleracea
DLPQTLQDEYEGFLNRQVIEDFRDFADLCFKEFGGKVKNWLTINQLYSVPTRGYSTGADAPGRCSPKVDARCYGGNSSTEPYIVAHNQLLAHAAVVNLYRTKYRFQRGRIGPVMITRWFLPFDET

SEQ ID NO: 32272 - protein, 125 aa, Brassica rapa
DLPQTLQDEYDGFLNRQVIEDFRDFADLCFKEFGGKVKNWLTINQLYSVPTRGYSTGADAPGRCSPKVDERCYGGNSSTEPYIVAHNQLLAHAAVVNLYRTKYRFQRGRIGPVMITRWFLPFDET

SEQ ID NO: 32273 - protein, 116 aa, Brassica rapa
DLPQVLQDEYEGFLDPQIIHDFKDYANLCFQEFGHKVKNWLTINQLYTVPTRGYGAGSDAPGRCSPMVDPTCYAGNSSTEPYIVAHNQLLAHATVVDLYRKNYSIGPVMITRWFLP

SEQ ID NO: 32274 - protein, 463 aa, Variovorax paradoxus
MNTVDITEIIEKQKPNRKVLALLILSFLIMLCDGYDLQAIAFASPTIIADWGIQKASFGFIFSGGLFGVMVGGFLFGYVADRIGRRPALLWGTLLFGVFTLAAVLATNITQLAVLRFVAGLGIGGITPIAIALNVEYAPKRFRASVVGLVMIGYVVGTSSGGIFAAWLVPTFGWQVLFYIGGLAPLLLLPFIAMSLPESIKYLVLSGQKPEAVARVVNAIDPSIRASSQTRFVLGTAEEGARIAGWKDSVKALFGGQLSKITPALWGAFVCSSVTVFFLASWIPVLTVGTGRSASLAAVGLALFSAGGAFGGIFSSRVIDRFGIGAMASIPLIAAVFVVSVGSFEFSDTGFLSMLCLIGFFVLGGHVGLMGAMGLFYSNANRANGVGWAISIGKFGSIIGPAIAAVLIAANTAISYLFMAAAAPLLMAGMGILVLGRLQKAADHEHRMGADRANDPEARPIDA

SEQ ID NO: 32275 - protein, 443 aa, Arabidopsis thaliana
MEQQLKTDGLNLSIRDAVKEDRISELPEDLLLQILSDIPTENVIATSVLSKRWRSLWKMVPNLTFDFTFDPKYHQTFSENLYRSLTSHEASVLESLQLNFTRGIDGLNIGMWIATAYVRHVRKLVLVSFGDVRDKRARFRSALFNFNDTLDILEIQDYILLDLPSPVCLKSLRELRLYEVHFKDEASVCNLLCGCPSLEVLSVHRERNVDVETFTIVVPSLQRLTIYDFCIGGGKGGYVINAPSLKYLNIVGFEGLDFCLIENAPELVEAEISDVSHIANENILESLTSVKRLSLESPIKIKFPTGKVFDQLVYLDVLTKEREWWNLLSRMLESSPKLQILKLTGLSCIEKGLDGQNWNPPKCVPECLLFHLEKFLWTGYEWQRGDEKEVATYILENARLLKKATFSTKRIDLENLEKRREMLNELASVARASDSCHLVFHSI

SEQ ID NO: 32276 - protein, 447 aa, Arabidopsis thaliana
MEQKCKIGGEGLRNRGLVNEEDRISELPEALLLLILSSLPTETVIATSVLSKQWKSLWKLVPNLKFDSKYHYHYTFSDNVFRSLISHKAPVLDSLHLKVEDKDDALDVGILIGIAFSRHMRKFVLKITLLEESFVRFPSAWCSCNDTLEILELKYCILLDFPSLVCLKSLRKLYLYHVRFNDEESVCNLLCGCPSLEDLVVHRHSTTDVESYTIAVPSLQRLTIYDDYYGEGVGGYVINAPSLKYLNIDGFNGLEFCLIEKAPELVEAKISAVFEIANENIMDSLTSAKCLSLHLAPFKIKYPTGKIFYQLLSLELRAYSYEWWNLLWFMLDSSPKLQILKLVDPYQFPKEDCSVGWEWSRPKCVPECLLFHLETFVWTRYEWQREDEKAVATYILKNARCLKKATLSTKPIGSEELEKLGKRREMLNELATQASPSNSCNLVFESE

SEQ ID NO: 32277 - protein, 197 aa, Medicago sativa
  misc_feature (78)..(78): Xaa can be any naturally occurring amino acid
  misc_feature (110)..(110): Xaa can be any naturally occurring amino acid
MSASRFIKCVTVGDGAVGKTCLLISYTSNTFPTDYVPTVFDNFSANVVVNGSIVNLGLWDTAGQEDYNRLRPLSYRGXDVFILAFSLISKASYENVSKKWIPELKHYAPXVPIILVGTKLDLRDDKQFCIDHPGAVPITTAQGEELRKLINAPAYIECSSKSQENVKAVFDAAIRVVLQPPKQKKKKNKAQKACSIL

SEQ ID NO: 32278 - protein, 342 aa, Arabidopsis thaliana
MEWVRGETIGFGTFSTVSTATKSRNSGDFPALIAVKSTDAYGAASLSNEKSVLDSLGDCPEIIRCYGEDSTVENGEEMHNLLLEYASRGSLASYMKKLGGEGLPESTVRRHTGSVLRGLRHIHAKGFAHCDIKLANILLFNDGSVKIADFGLAMRVDGDLTALRKSVEIRGTPLYMAPECVNDNEYGSAADVWALGCAVVEMFSGKTAWSVKEGSHFMSLLIRIGVGDELPKIPEMLSEEGKDFLSKCFVKDPAKRWTAEMLLNHSFVTIDLEDDHRENFVVKVKDEDKVLMSPKCPFEFDDWDSFTLDSNPSFDSPVERLGSLVSGSIPDWSVGGSWLTVR

SEQ ID NO: 32279 - protein, 403 aa, Arabidopsis thaliana
MVDVDRRMTGLRPAHAAGLRRLSARAAAPTTPTVRNSLVSFSSLADQVISHLHTSRIQVQPGLTDSEFARAEAEFAFAFPPDLRAVLTAGLPVGAGFPDWRSPGARLHLRAMIDLPIAAVSFQIARNTLWSKSWGLRPSDPEKALRVARNALKRAPLMIPIFDHCYIPCNPSLAGNPVFYIDETRIFCCGSDLSDFFERESVFRGSDTCPVVLTKQRSVSEKSAGSSSSSSSNFSRMSLDSGRVHGSSTPRWVEFWSDAAVDRRRRNSASSMSSSHSSSPERYLDLPRSETPKWVDDYVNRIGSVLRGGGWSESDVDDIVHVSASGFFEGEMVILDNQAVLDALLLKAGRFSESLRKAGWSSEEVSDALGFDFRPEKEKKPVKKLSPELVQRIGKLAESVSRS

SEQ ID NO: 32280 - protein, 472 aa, Arabidopsis thaliana
MAATLTGSGIALGFSCSAKFSKRASSSSNRRCIKMSVSVEEKTKKFTLQKSEEAFNAAKNLMPGGVNSPVRAFKSVGGQPVVMDSAKGSRIRDIDGNEYIDYVGSWGPAIIGHADDEVLAALAETMKKGTSFGAPCLLENVLAEMVISAVPSIEMVRFVNSGTEACMGVLRLARAFTGKQKFIKFEGCYHGHANSFLVKAGSGVATLGLPDSPGVPKAATSDTLTAPYNDIAAVEKLFEANKGEIAAIILEPVVGNSGFITPKPEFIEGIRRITKDNGALLIFDEVMTGFRLAYGGAQEYFGITPDLTTLGKIIGGGLPVGAYGGRRDIMEMVAPAGPMYQAGTLSGNPLAMTAGIHTLKRLSQPGTYEYLDKITKELTNGILEAGKKTGHAMCGGYISGMFGFFFTEGPVYDFSDAKKSDTEKFGKFFRGMLEEGVYLAPSQFEAGFTSLAHTSEDIQFTIAAAEKVLSRL

SEQ ID NO: 32281 - protein, 353 aa, Nicotiana tabacum
MEVISTNTNGSTIFKSGAIPMNGHHNGTSKHQNGHKNGTSEQQNGTISLDNGNELLGNSNCIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFNDPRVTLVLGDGAAFVKAAQAEYYDAIIVDSSDPIGPAKDLFERPFFEAVAKALRPGGVVCTQAESIWLHMHIIKQIIANCRQVFKGSVNYAWTTVPTYPTGVIGYMLCSTEGPEIDFKNPVNPIDKETAQVKSKLAPLKFYNSDIHKAAFILPSFARSMIES

SEQ ID NO: 32282 - protein, 375 aa, Nicotiana tabacum
MEVISTNTNGSTIFKNGAIPMNGHQNGTSEHLNGYQNGTSKHQNGHQNGTFEHRNGHQNGTSEQQNGTISHDNGNELLGSSDSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPSIEKIDIVEIDDVVVDVSRKFFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLGPLKFYNSDIHKAAFILPSFARSMIES

SEQ ID NO: 32283 - protein, 381 aa, Nicotiana tabacum
MEVISTNTNGSTIFKNGAIPMNGYQNGTSKHQNGHQNGTSEHRNGHQNGISEHQNGHQNGTSEHQNGHQNGTISHDNGNELQLLGSSNSIKPGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKFFPYLAANFSDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPVNPIDKETTQVKSKLAPLKFYNSDIHKAAFILPSFARSMIES

SEQ ID NO: 32284 - protein, 419 aa, Nicotiana tabacum
MEVISTNTNGSTIFKNGAIPMNGHQSGTSKHLNGYQNGTSKHQNGHHNGTSEHRNGHQNGISEHQNGHQNGTSEHRNGHQNGISEHQNGHQNGTSEHQNGHQNGTSEQQNGTISHDNGNELLGNSNSIKLGWFSEFSALWPGEAFSLKVEKLLFQGKSDYQDVMLFESATYGKVLTLDGAIQHTENGGFPYTEMIVHLPLGSIPNPKKVLIIGGGIGFTLFEMLRYPTIEKIDIVEIDDVVVDVSRKSFPYLAANFNDPRVTLVLGDGAAFVKAAQAGYYDAIIVDSSDPIGPAKDLFERPFFEAVAKALRPGGVVCTQAESIWLHMHIIKQIIANCRQVFKGSVNYAWTTVPTYPTGVIGYMLCSTEGPEVDFKNPINPIDKETTQVKSKLAPLKFYNSDIHKAAFILPSFARSMIES

SEQ ID NO: 32285 - protein, 332 aa, Lycopersicon esculentum
MPSVSGRVVCVTGAGGFIASWLVKLLLEKGYTVRGTVRNPDDPKNCHLRELEGAKERLTLCRGDLLDYQSLREAINGCDGVFHTASPVTDDPEQMVEPAVIGTKNVITAAAEANVRRVVFTSSIGAVYMDPSRDPEKVVDETCWSDPDFCKNTKNWYCYGKMVAEQAAWDEAREKGVDLVAINPVLVLGPLLQNTVNASVLHILKYLTGSAKTYANSVQAYVHVKDVALAHILLYETPSASGRYLCAESVLHRGDIVEILAKFFPEYPIPTKCSDVTKPRVKPYKFSNQKLKDLGMEFTPVKQCLYETVKSLQEKGHLPIPTQKDEIIRIQT

SEQ ID NO: 32286 - protein, 332 aa, Lycopersicon esculentum
MPSESGKVVCVTGAGGFIASWLVKLLLEKGYTVRGTVRNPDDSKNGHLKELEGAKERLILLRADLLDYQSLREAIYGCDGVFHTASPVTDDPEQMVEPAVIGTKNVITAAAETKVRRVVFTSSIGTVYMDPNRAPDKVVDETCWSDLDYCKNTKNWYCYGKTVAEKTARDEAREKGVDLVVINPVLVLGPLLQPTVNASVLHILKYLTGSAKTYANSIQAYVHVKDVALAHILLYEAPSASGRYICAERVLHRGDVVEILAKFFPEYPIPTKCSDETRPRAKPYIFTNQKLKDLGLEFTPVKQCLYETVKSLQEKGHLPVPTQNDEPIKIHS

SEQ ID NO: 32287 - protein, 254 aa, Bacillus anthracis str. A2012
MQSMRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 32288 - protein, 492 aa, Bacillus anthracis str. A2012
MGGTIMWESKFVKEGLTFDDVLLVPAKSDVLPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLSEAEKILQKYKIEKLPLVDNNGVLQGLITIKDIEKVIEFPNSAKDKQGRLLVGAAVGVTADAMTRIDALVKASVDAIVLDTAHGHSQGVIDKVKEVRAKYPSLNIIAGNVATAEATKALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFIRMSGAGLLESHPHHVQITKEAPNYSL

SEQ ID NO: 32289 - protein, 313 aa, Bacillus anthracis str. A2012
MLGVTGMRVAQSVSELIGKTPIVKLNRIVESDSADIYLKLEFMNPGSSVKDRIALAMIEDAEKKGLLKEGDTIIEPTSGNTGIGLAMVAAAKGYKAILVMPETMSVERRNLLRAYGAELVLTPGPEGMGGAIRQATELAKEHGYFIPQQFKNQSNPEIHRLTTGPEIVEQMGDQLDAFIAGIGTGGTITGAGEVLKEAYKDIKIYAVEPADSPVLSGGKPGPHKIQGIGAGFVPETLDVEVYDEIIQVKTEQAFEYARRVAKEEGILVGISSGAVIYAATEVAKKLGKGKKVLVIIPSNGERYLSTPLYQFES

SEQ ID NO: 32290 - protein, 141 aa, Bacillus anthracis str. A2012
MEKRIRMIDAKQLNSLALAYMGDAVYEQYIRYHLLQKGKVRPNQLHRLGTSFVSAKAQAKVVYHLLETAFLTEEEEAVLRRGRNANSGTVPKNTDVQTYRHSTAFEALIGYHHLLNNRERLDEIVYKAIAVLEEKEGGTSS

SEQ ID NO: 32291 - protein, 191 aa, Bacillus anthracis str. A2012
MGIVIITFFFIDFFDTAGTLVAVANQAGLMKNNKLPRAGKALFADAIATVIGAILGTSTTTSYIESSAGVAAGGRSGFTAVVTAGFFLLALFFSPLLSVVTPAVTAPALIIVGILMVSSLGEIDWKKFEIAVPAFFTIISMPLTYSIATGIAIGFIFYPITMVVSGRRKEIHPIMYVMGVLFVLYFIYVRK

SEQ ID NO: 32292 - protein, 458 aa, Bacillus anthracis str. A2012
MGYVMNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRCPEGLTEEQYDDFMIEEFKNFFISEVAPETIAAVVMEPVQGEGGFIVPSKKFAQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCTEANKRGLLLLSAGTYGNVIRVLMPLVITDEQLEEGLTIIEESLQICYEKANTARV

SEQ ID NO: 32293 - protein, 455 aa, Bacillus anthracis str. A2012
MIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTDTTEVDSL

SEQ ID NO: 32294 - protein, 300 aa, Bacillus anthracis str. A2012
MNTEKVRKKKYLNGIEMKKQRENPFAFFMSKMKQAVIFLPIFEYKKNVHALLGEGVSMLIEFRNVNKYYGNFQVLKDINVQVKKGEVVVVVGPSGSGKSTLLRCINQLESITDGELIVQNTEVHNAKTDMNELRRNIGMVFQHFYLYPHKTVLQNITLAPIKVNKISKEEAEKTAMFYLEKVGIPEKANVYPHQLSGGQQQRVAIARGLAMQPEIMLFDEPTSALDPEMIGEVLDVMKTLAKEGMTMVVVTHEMGFAREVADRILFMDDGKIIEDTTPAQFFASPEQERARLFLSRVLNH

SEQ ID NO: 32295 - protein, 418 aa, Bacillus anthracis str. A2012
MAGIITFLTMAYIIVVNPVILGDAGVPFEQAFTATIIAAVVGTLFMAIFTNLPIAIAPGMGLNAYFSYSVVKAHEGMTFAIAFSAVFVAGMILILLSFTSFRTKLMEAIPENLKHAITAGIGLFIAFIGLRLTGIVTKNEANLVGLGDLHSAPVLLALAGLGITIVLMSLNVNGALFIGMLLTGIIAFFTGQLTFSNGVTSMPGLPEGIIVSNPITAVSDVINYGLYGVVFSFFLVTLFDTTGTLLGVAQQGGFMKDGKLPKAGRALLSDSFSATIGSMFGTTPSTAYIESSAGVAAGGRTGLTTVTVAVLFALAAFFGPLVSAVSGVSAITAPSLIIVGSLMMGSVRHIDWDAFDEAFPAFLVILSMPLTSSIATGIALGFISYPLMKVAKGKFRAVHPLVYVFGILFAYQLIFLPH

SEQ ID NO: 32296 - protein, 232 aa, Bacillus anthracis str. A2012
MGWGLAVAVAAYVVGSISGAHLNPALTIGLAFKGAFPWGDVPGYIAAQMIGAIIGAVIVYLHYLPHWKETEDPGTKLGVFATGPAIPNTFANLLSEMIGTFVLVFGILAIGANKFADGLNPFIVGFLIVSIGLSLGGTTGYAINPARDLGPRIAHFFLPIAGKGGSNWKYAWIPVVGPILGGSLAGLFHQVVFEGKQNAALIYVIIATVIVLAISYMTSKKSGSNTNSRKVA

SEQ ID NO: 32297 - protein, 476 aa, Bacillus anthracis str. A2012
MLKIDIGKEGTDMTAIQAKNGPTEKLSLFLLTWPIFLEVFLFMLMGIADTFMLSALSDDAVSGVGAANQYLHIAILVLEVIGNGAAIVVSQYLGSKRFMEASKISALAVTLNLVVGLVISAGFLLFSKHMMMAMNLQGDVLMYAQSYLSIVGGAIFLQAIINSLAAIIRVHGFTKQAMFISLGMNIIHIAGNYVLIFGKFGFPELGVQGAAISSAVSRLIALIVFFWLLYRVMEYRVKLQYYFTLSKEYIGKILKIGIPSAFEQVMYQACQIVFLYYATYLGTESLAARQYATNISMFTYLFAIAIGMGTAIIIGRLVGGGEKDEAYERVWKSVKWAIGVTLCMVALVITFRTQLMGLFTDNPHIIALGASVLLLSVLLETGRTMNIVIINSLRAAGDAKYPVLIGAFSMVLMSLPLGYFFAFHLDMGLVGIWLAIAIDEWTRAIIMFFRWKSRAWERYALVKPEEQEEIVSVQAQ

SEQ ID NO: 32298 - protein, 478 aa, Bacillus anthracis str. A2012
MKIAGRNLNHHGTSAAFVKNKLLWKVEEMMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 32299 - protein, 329 aa, Bacillus anthracis str. A2012
  misc_feature (17)..(17): Xaa can be any naturally occurring amino acid
MMKAIVVTSFGGSEVMXYTDVDIPAISEDQVLIRVVATSVNFADIKSRYGKKGNKALPFILGIDAAGIVERVGSHVKNIYPGQRVIAFPQNGSYAEYVVANENLTFVLPDEVDFQTAAACPIVSFTSYNLLANVARLQQGESVLIHAAAGGIGTTAIQLAKLLGAGTVIGTVGSEAKKEIALDAGADYVIGHQDEDFVEKVNELTNGEGVDVILDSISGTVSERSLKCLAYYGRLIHFGNASGEIGNFQTKDLHASCRSILGFSFGTTRKKRPELLQETANEVFRYLRDGHLQIKATKSFPLQDAGKAHEWVESRKSTGKVILTVQSSS

SEQ ID NO: 32300 - protein, 169 aa, Bacillus anthracis str. A2012
MIVKRGAKTMTVYDFSAKTITGEEKSLKDYEGKVLLIVNVASKCGFTPQYKGLQEVYDKYKEQGLEILGFPCNQFGGQEPGTEADITSFCELNYGVNFPMFAKIDVKGDKAHPLYTYMTEQAPGLLGMKAVKWNFTKFLIGKDGKVVGRFAPQTKPVDLEVEIEKVLGE

SEQ ID NO: 32301 - protein, 489 aa, Bacillus anthracis str. A2012
MNMTVQTAQIVKNYIGGEWVESISTKMEAVYNPATGEVIAQVPLSTKVDVEQAVLAANEAFKSWSKTAVPRRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 32302 - protein, 1320 aa, Emericella nidulans
MGKTSAKDVAELKDYQLGDCLGRGAFGSVYRALNWNTGETVAVKQIKLADLPKSELRVIMLEIDLLKNLDHPNIVKYQGFVKSAETLNIILEYCENGSLHSIAKNFGRFPETLVGVYMSQVLHGLLYLHDQGVIHRDIKGANILTTKEGLVKLADFGVASRTTGLSESSVVGTPYWMAPEVIELSGATTASDIWSLGCTVIELLEGKPPYYNLQPMPALFRIVNDDHPPLPQGASPAVKDFLMQCFQKDPNLRVSARKLLKHPWIVNARRSDSVVPKKSTEYEEAVKSVQEWNEALRSPESNALRRGTRNENQNPPSLRLDTRHTPTKVTLPSPVSRIVADKFSSPSSGEEDNWDDDFATAISPSALQLPHLRPHDNFGGMLSSEKLKAFASLDGTVLKSDESFEESDDPFKGSLLAGEHDPLKTIRPPPSQQANSGTSQSQNGPYGAHMRRGPPLNTAITPVYGGQMLQNSSSPIRQQRPPLFYKENSVEDYSDLISANEDVLDRKISAFQVGPTLRTPEGSDHAADVHQESDEHKDLADTGRSREVIRYQSSYEQEDTPRIGRQISVKRYRGTVEIQQFAENEHDEDFSDILGVDGVTLDKAESDDGSNKSTLMLNTKLSNNSWLGDLDDEDDPFALLEEGLDETDLEANIARDKHARLRSQVEGLVGSLKTSQDEEVLGDISEQLLAVFCDFPETKNIIISAHGMLPILEILDLCRRRDITLCLLKIVNAIIYDDYEIQENLCFVGGIPIINEFAAKKYPREIRLEAAAFVQQMYQTSTLTLQMFVSAGGLNVLVEFLEDDYEDERDLVLVGVNGIWSVFELQGSTPKNDFCRILSRSSVLDPLSLVLSRVLDEEGELAEVVEGRIANIFFIFSQAENHVKEMVSERTVLHRVLKELKRMTPAHQITMLKFIKNLSMLSTTLDSLQNSNAIDVLTDLLRSTIKRPHFREVSNQILNTIYNMCRLNKSRQEDAALNGIVPLLQKIVKTERPLKEFALPILCDMAHSGKVGRRELWRNKGLAFYISLLSDPYWQVTALDAIFIWLQEETAKVEEHLLENRYDQPSFTDAIVRCLTLSKANAFENILEPLQKLLRLSPPIASTLARPDLFSRLGQKLHHSKAAVRLNLLRIISSICDSSEQQGGLLASYGLLDSIRELEHDPAILVRDMAGKLIQSSERNDSYGLCKLKPNVRRGSTSATSPGLLANQSAPVTPQLSRQNQSKGYYDSRETQRRPRSAISGSALALRPGSRDGPTPGIVGGANGSAGASRNRIARGVSNRLSHIELLPNDDDRIPSSITRRSSVLPRRRRLTQFEAERGS

SEQ ID NO: 32303 - protein, 474 aa, Bacillus anthracis str. A2012
  misc_feature (470)..(470): Xaa can be any naturally occurring amino acid
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 32304 - protein, 363 aa, Bacillus anthracis str. A2012
MGILMKKDGGNMTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 32305 - protein, 413 aa, Bacillus anthracis str. A2012
  misc_feature (378)..(411): Xaa can be any naturally occurring amino acid
MTLLSKSKYGAIVVRIFLGGRNMTSSNKKSASIYEGTNVNAWGSFENVAETKLFNSIQIGSWPLRNRIAMAPMTRCFADNETGAVGADVVEYYRKRAADGVGLIITEGIVISPRAKGNPGVPGIYTQEQIDSWKPVTEAVHKEGGTIIAQIWHVGRMSHHEIIGGQMPQAPSAIAAEGNVPRFRKPFDTPEAMTLEEIQEVIGQYAQAAKNAIEAGFDGVEIHGAHGYLIDQFTYEFVNKRTDKYGGDLKQRLTFMKEVTEAVIEAIGADKTLLRFSAFKGDNPTYMWENPELAIETFVNMFKEVGLTMIHPSTMSYTQVIADGKNFHQLVRKYWDGAIVGVGNLNPKEAEEALQEGTIDVAAFGRPLIANPDGIIEXXXXXXXXXXXXXXXXXXXXXXXXXXXXXXXXXXIS

SEQ ID NO: 32306 - protein, 449 aa, Bacillus anthracis str. A2012
MISIGGVIGAGLFVGSGAVVHSAGPGSIVSYALAGLLVVFVMRMLGEMAAINPTSGSFATYAREAIGPWAGYTIGWLYWFFWVIVIAIEATAGAGIIQYWIPEIPLWLLSLILTILLTLTNVFSVKSFGEFEYWFSFIKVISIVLFLCLGLAVILGFVPGTEAPGTSNLVGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKAFLKLNSSGVPVRAVLFGTFFAYIGVVFSYISPDKVFLFLVNASGGIALLVYLVIAISHLKIRKKMGRVEQQNLKVKMWFFPYVTYVTIAAIIAVLIAMLAIESLRSQALLTMLVTVLIIISYFIFNRNKNSTVLNTKSKNEESVRF

SEQ ID NO: 32307 - protein, 465 aa, Bacillus anthracis str. A2012
MTIVTFSKSTTDKPSYTYEELSVKNKAYVWHPFTQMKDYLEEDPVIIERGEGRKLYDVNGNEYWDGVSSIWLNVHGHQVPELDEAIREQLNKIAHSTMLGLANVPSILLAEKIIEVVPEGLKKVFYSDSGSSAVEIAIKMAFQYWQHKGKPKKQRFVTLKEAYHGDTIGAVSVGAIDLFYQVYSSLLFEAIKMPYPYTYRSPYGNDKAEIVKKHLEEMEELLKDKHEEIAAIIVEPLMQGAGGMITMPKGYLRGLRNLCTKYNVLFITDEVATGFGRTGKMFACEHENVTPDILTAGKGLTGGYLPVAITVTTDEIYNAFLGSYEEQKTFFHGHSYTGNPLGCAVAIANLELYEKTNLIEEVARKTEYVATQLEELFACKHVGDIRQCGLMVGIELVKNKETKEAFEWTERVGVQVCKRSRELGMILRPLGNTIVFMPPLASTIDEIDEMLRILYKAISDITEGE

SEQ ID NO: 32308 - protein, 456 aa, Micrococcus luteus
MRHPIPDYLASLVTELGAVNPGETAQYIPVLAEADPDRFGIALATPTGRLHCAGDADVEFTIQSASKPFTYAAALVDRGFAAVDRQVGLNPSGEAFNELSLEAESHRPDNAMINAGALAVHQLLVGPEASRKERLDRAVEIMSLLAGRRLSVDWETYESEMAVSDRNLSLAHMLRSYGVLQDSAEEIVAGYVAQCAVLVTVKDLAVMGACLATGGIHPMTGERMLPSIVARRVVSVMTSSGMYDAAGQWLADVGIPAKSGVAGGVLGALPGRVGIGVFSPRLDEVGNSARGVLACRRLSEDFRLHLMDGDSLGGTAVRFVEREGDRVFLHLQGVIRFGGAEAVLDALTDLRTGAEKPGTGWDAAVYPRWQEAAADRAALSAATGGGAVHEAAAAAARDENDGPIRTVVLNLARVDRIDDVGRRLIAEGVRRLQADGVRVEVEDPERILPLEEAGAH

SEQ ID NO: 32309 - protein, 212 aa, Mycoplasma fermentans
KSQTSEIEIGKKVFNVIIRSDVQGTAEAIKGKIDGMCNDEAMIKVIGAQAGQITNADLLLAQASDARIITFNVKPSAAIKQSAKHSGITIVNYSVIYKIIEDMEAHLKGQKAVVYEEKKIGSAHIIKVFFYSKVGAIAGCMMDEGVVKANCKVKVFRGRKMIHDGVIETLKRELNDSKEVEKGKDFGTHIKKFDDIKEDDILEFFEDVPVSL

SEQ ID NO: 32310 - protein, 493 aa, Prochlorococcus marinus
MQTNFLFMTTALQTPQRRSRSKLQDASLVNGPMLLLRSIRGFSSNRSMLWLATVPLALFGLGIFNLSAHAADLPELNAAFLANNLWLLIATILVIFMNAGFAMVEAGMCRSKNAVNILAKNLFVFALAVTSYWFIGYSLMYGGSVADGWLYFGGLFFDPTVTADMVTDAGLVPTVDFLFQSAFAGTAATIVSGLVAERVKFGEFVVFAIVLTAFIYPIAGSWKWNGGWLDSLGFVDFAGSSIVHSVGAWAGLVGAMLLGPRIGKYSDGKPQAMPGHNMAIATLGALILWIGWYGFNPGSQLAMDQWVPYVAVTTTLAAAAGAIGATIVSTLTSGKPDLTMIINGILAGLVSITAGCGDMTLAGAWFAGLVGGIIVVFSVAALDAAEIDDPVGAFSVHGVCGVWGTLVIGLWGTAVQGDGAGMGLFNGGGINLLLVQALGAAAYAIWTLVTCWIAWSIIGGLFGGIRVSEEEETQGLDISEHGMESYPDFASAK

SEQ ID NO: 32311 - protein, 263 aa, Vicia faba
AHIITAVIGSGVLSLAWAIAQMGWVAGPAVLLAFSLITYFTSTLLADSYRSPDPVHGKRNYTYSEVVRSVLGGRKFQLCGLAQYINLVGVTIGYTITASISMVAVKRSNCYHKHGHEAKCYTSNNPFMIVFACIQIVLSQIPNFHKLSWLSILAAVMSFAYSAIGLGLSVAKVVGGGPAVRTSLTGVQVGVDVTGTEKVWRMFQAIGDIAFAYTYSNVLIEIQDTLKSSPPENQVMKRASLIGVLTTSMFYMLCGCLGYAAFG

SEQ ID NO: 32312 - protein, 261 aa, Vicia faba
AHIITAVIGSGVLSLAWAIAQLGWIAGPSMMLLFSFVTYYTSTLLSACYRTGDQLNGKRNYTYTDAVRAYLGGFKVKICGLVQYVNLFGVAIGYTIAASISMMAIKRSNCFHSSGGKDPCHMNGNLYMISFGIVEIFFSQIPDFDQLWWLSTLAAVMSFTYSTIGLGLGVGKVIENKGIKGSLTGITVGTVTQTQKVGRSFQALGNIAFAYSYSMILIEIQDTIKSPPSESKTMKAATLISVVVTTIFYMLCGCLGYAAFG

SEQ ID NO: 32313 - protein, 343 aa, Sporidiobolus salmonicolor
MAKIDNAVLPEGSLVLVTGANGFVASHVVEQLLEHGYKVRGTARSASKLANLQKRWDAKYPGRFETAVVEDMLKQGAYDEVIKGAAGVAHIASVVSFSNKYDEVVTPAIGGTLNALRAAAATPSVKRFVLTSSTVSALIPKPNVEGIYLDEKSWNLESIDKAKTLPESDPQKSLWVYAASKTEAELAAWKFMDENKPHFTLNAVLPNYTIGTIFDPETQSGSTSGWMMSLFNGEVSPALALMPPQYYVSAVDIGLLHLGCLVLPQIERRRVYGTAGTFDWNTVLATFRKLYPSKTFPADFPDQGQDLSKFDTAPSLEILKSLGRPGWRSIEESIKDLVGSETA

SEQ ID NO: 32314 - protein, 505 aa, Pseudomonas sp. DJ-12
MQTVNELLRRAATRAPDHCALADPARGLRLTHAELQTRVEAVAARLHADGLRPQQRVAVVAPNSADVVIAILALHRLGAVPALLNPRLKSAELAELIKRGEMAAAVIAVGQQVADTIFQSGSRAQIIFLGDLVRDGEPCDSYGPPIEDPQREPAQPAFIFYTSGTTGLPKAAIIPQRAAESRVLFMSTQVGLRHGQHNVVLGLMPLYHVVGFFAVLVAALALDGTCVVVEEFRPVDALQLVQQELVTSLFATPTHLDALAAAAAQAGSSLKLDSLRHITFAGATMPDAVLEAVHQHLPGEKVNIYGTTEAMNSLYMRQPKTGTEMVPGFFSEVRIVRVGGGVDEVMANGEEGELIVAASDSAFVGYLNQPQATAEKLQDGWYRTSDAAVWTPEGTVRILGRVDDMIISGGENIHPSEIERVLGAAPGVAEVVVIGLADQRWGQSVTACVVPRPGETLSEDALDAFCRSSELADFKRPKRYFILDQLPKNALNKVLRRQLVQQVSS

SEQ ID NO: 32315 - protein, 320 aa, Arabidopsis thaliana
MAVKQKVCVTGAGGFIASWLVKFLLSRGYTVHGTVRDPCDEKNDHLRKLDNASKNLKLFKADLFDDEGLFSAIDGCSGVFHIASPVPFEGEELIKPALTGTKNVLEACTETKVQKVVVVSSIAAVVYNPKWPQDVAKDEDCWSDTQYLHSLEGYWRYYYLAKTLTEREALEWSKRNFADVVTLCPSVIIGPRLQSTLNSSSLGLLKFIKGGIKSLLSDELYLVDVRDVADALLLVYENREATGRYICNSHSLYTDSLMEKLKNMYPKRNFPESFTEVKEKEVRPLSAEKLKNLGWKFRPLEETIDDSVVSFEAAGDLPKA

SEQ ID NO: 32316 - protein, 231 aa, Schizosaccharomyces pombe
MQLYSSESESDDSQYWVDWFLGLKGNEFFCEVDEDFIQDRFNLTGLSHEVPHYSQSLDLILDVLDPDLPEEVQDEVEASARHLYGLIHARYILTAQGLYKMLEKYKKCDFGHCPRVLCNGQPMLPVGLSDIAHTKSVKLYCPRCEDVYTPKSQRHASIDGAYFGTSFPHMLFQVYPELAVPKSQERYIPRIFGFKVHSYSATFKKQDVYKEKQKKRLQGAEAESKNKLAIT

SEQ ID NO: 32317 - protein, 338 aa, Streptomyces coelicolor A3(2)
MTDSRIPTARLGTDGPEVGAQGLGCMGMSFAYGPTDTEASRATLERALELGVTLYDTADAYGAGENERFLAPFFKAHRDEVVVATKFALSIPPDDPTKRIIRNDAPYIREAVEASLRRLDLDVIDLYYMHRRDVNVPIEETVAVMADLVREGKVKQLGLSEVTGDELRAAQTVHPIAAVQSEWSLFSRDIEAGVVPAARELGVTLVPYSPLGRGFLTGSFANAEQDLTDGDFRRQQPRFTGDNAAANAALLTPVRALAEAHDATLGQIALAWVQQRAQVHGLPVIPIPGTRKPARVAENTAATRLVLTEAELSLLEPIAEKVAGDRYADMTFASAGRE

SEQ ID NO: 32318 - protein, 477 aa, Streptomyces coelicolor A3(2)
MTQSDSLTYDVVVIGAGPVGENVADRTRAAGLSTAIVESELVGGECSYWACMPSKALLRPVLARADARRLPGLAQSLQEPLDATAVLARRDEFTSHWKDDGQVQWVEGIGADLYRGQGRLAGPRTVEVAGPDGTRRTLSARHAVAVCTGSAAALPPLPGLAEVRPWTSREATSAERAPGRLIVVGAGVVAVEMATAWQALGSRVTMLVRGDGGLLARMEPFAGELVAEALTEAGVDIRTGVSVESVTRENGTVVAVTDTGDRLEADEILFATGRTPRTGDIGLDTVGLKPGSWLPVDDSLRVEGSDWLYAVGDVNHRALLTHQGKYQARIAGAAIAARASGVPILESDPWGAHAATADHDAVPQVVFTDPEVASVGLTLAEAEQAGHRVRAVDVPIAVAGSSLYGDGYKGRARMVVDLEDEIVRGVTFVGPGVGEMIHSATIAVAGRVPISRLWHAVPSYPTISEVWLRLLETYRDN

SEQ ID NO: 32319 - protein, 308 aa, Streptococcus suis
MAIYQNITQLVGKTPVIKLNNIVPEGAAEVYVKLEAFNPGSSVKDRIALAMIEDAEKAGTIKPGDTIVEPTSGNTGIGLAWVGAAKGYNVIIVMPETMSVERRKIIQAYGAELVLTPGSEGMKGAIAKAKEIAEEKNGWVPFQFANPSNPKVHEDTTGQEILEDFGTTGLDAFVSGVGTGGTVSGVSHVLKTANPDIAIYAVEADESAVLSGEAPGPHKIQGISAGFIPDTLDTSAYDGIIRVKSDDALATGRAIGGKEGFLVGISSGAAIHAAIEVAKELGTGKKVLAILPDNGERYLSTALYEFND

SEQ ID NO: 32320 - protein, 475 aa, Altingia excelsa
  misc_feature (1)..(9): Xaa can be any naturally occurring amino acid
XXXXXXXXXSVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32321 - protein, 168 aa, Avena clauda
VMASSATSVAPFQGLKSTAGLPVSRRSASSLGSVSNGGRIRCMQVWPTEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32322 - protein, 168 aa, Avena clauda
VMASSATSVAPFQGLKSTAGLPVSRRSASSLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32323 - protein, 168 aa, Avena maroccana
VMASSATSVAPFQGLKSTAGLPVSRRSNAGLGSVSNGGRIRCMQVWPIEGIKKFETLSYLPPLSEEALLKQIDFLIRSKWVPCLEFSKVGFIFREHGSTPGYYDGRYWTMWKLPMFGCTDASQVIKEVEEVKKEYPDAYVRIIGFDNIRQVQCVSFIAFKPPGCEESG

SEQ ID NO: 32324 - protein, 262 aa, Salmonella typhimurium
MMSENKLHVIDLHKRYGGHEVLKGVSLQARAGDVISIIGSSGSGKSTFLRCINFLEKPSEGAIIVNGQNINLVRDKDGQLKVADKNQLRLLRTRLTMVFQHFNLWSHMTVLENVMEAPIQVLGLSKHDARERALKYLAKVGIDERAQGKYPVHLSGGQQQRVSIARALAMEPDVLLFDEPTSALDPELVGEVLRIMQQLAEEGKTMVVVTHEMGFARHVSSHVIFLHQGKIEEEGDPEQVFGNPQSPRLQQFLKGSLKKLEH

SEQ ID NO: 32325 - protein, 475 aa, Wijkia concavifolia
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLSTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDLPRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 32326 - protein, 468 aa, Yersinia pseudotuberculosis (type O:1b)
MLLPVIMAGGAGSRLWPLSRALYPKQFLALTSDLTMLQETLLRLDGLPHLAPLVICNEEHRFIIAEQLRQKNLVHSGIVLEPVGRNTAPAIALSALRATMSGDDPLLLVLAADHVIQDKLAFIRAVQRAEPLAEAGKLVTFGIVPKSPETGYGYIRQGKQVVDGAYQVAAFVEKPDLITAERYLASGDYYWNSGMFVFKASRYLQELDLHRPDILAACKQAIAGQHTDLDFIRLNEEAFSSCPDESIDYAVMEKTSDAVVVPLDAQWNDVGCWSALWEINTKDDHGNVIRGDVLIEDTNNSYVYSQNRLIATVGINDLVIVETKDAILVAHKDKVQNVKGIVGQLKLESRCEYLQHREVYRPWGSHDAIAEGVRYHVQHVTVKPGQRIATQIHYHRAEHWIVVSGIAKVHYGKETYLVNENESTYIPVGIAHSIENPGQIPLEIIEVHTGNYISEDDVERIDDLGVGY

SEQ ID NO: 32327 - protein, 155 aa, Zymomonas mobilis
MDNLEYRSGVGIMLLNKDNLVFAACRNDMKEEAWQMPQGGLEAKETPEVGVLRELEEETGIPPRMVAIISHTKEWLTYDFPADLQASFFKNKYRGQRQLWFLARYLGRDEDININTDKPEFRAWKWVEPKQLPDLIVAFKKPLYEKILSEFSASL

SEQ ID NO: 32328 - protein, 338 aa, Schizosaccharomyces pombe
MGLEQFKKYPLTFGPTPITSMKRLSKTLGGKVEIFAKREDCNSGLAFGGNKIRKLEYLIPEAIDGGYDTLVSIGGIQSNQTRQVAAVAAHLGLDCVLIQEDWVDYKDTMYDRVGNIELSRIVNADVRLDSSKFDIGIRPSFKNALEELTKKGKKPFPIPAGCSEHPYGGLGFVGCVEEIYEQEKQLGFKFDKIVVCTVTGSSFAGIIVGMALTGRQKDVIGIDASATPEKTKAQVLRIAQNTAKLIGLEKELTESDVNIDTRFAHPAYGIPNEGTIEAIKLCGATEGVLTDPVYEGKSMQGLIHLVRNNEIAEGSKVLYIHLGGAPALSAYSAYFKNT

SEQ ID NO: 32329 - protein, 496 aa, Schizosaccharomyces pombe
MSEDLFVSINFPNGKSVKQPIGLYINGEWHKSAETWETVDPSIEEVIAKVYLAGEKEIDYAVKSAKEAFKTWKKVPGSEKGELLMKLAELTEKHADTLAAIEAMDSGKPLVSNARGDVDGTIALLRYCAGWADKIYGQVIPTGPEKLAYAKRTPIGVCGQIVPWNYPLNMAGWKIAPALAAGNCIIIKSAETTPLSLLYFATLVEEAGFPKGVVNIISGLGTVAGSYMAKHPGIDKIAFTGSTKVGVIVQQLAASNLKAVTLECGGKSPFLVFEDADLDQAVKWAALGIMYNSGQICTSNSRIYVQDSVYDKFIELFKKHVIQDYIVGMPFDDNTVVGPVVNKTQYNRIKNYIEQGKKEGAKLVLGDEPLPLKQGYFISPTIFADCSENMTIVKEEIFGPVVAISKFKTEDEAIEKANNTTYGLAAMCFTKDLERAHRVSDELEAGMVFINSTENSDIQAPFGGIKMSGIGNELGSNGIEMYTQIKAVHINFNNKL

SEQ ID NO: 32330 - protein, 341 aa, Schizosaccharomyces pombe
MSQTTTETIIPLDSSVKDKLDPEYVNFYNKYVCSNLPIVKTHTYPVDFLRNNGNVMPGQSELLPVESTEDITIPRKHTKAPSGVPSRIFRPHGTAPEGGWPCFLWFHGGGWVLGNINTENSFATHMCEQAKCVVVNVDYRLAPEDPFPACIDDGWEALLYCYENADTLGINPNKIAVGGSSAGGNIAAVLSHKVAASPANFPPLVLQLLVVPVCDNTANAKTHKSWELFENTPQLPAAKMMWYRRHYLPNEKDWSNPEASPFFYPDSSFKNVCPALICAAGCDVLSSEAIAYNEKLTKAGVESTIKIYEGCPHPVMAMDAVLEKGRILNKDATNALLAAFA

SEQ ID NO: 32331 - protein, 448 aa, Schizosaccharomyces pombe
MSSHVSNNSILDPVTFWNQANKSLIRYGGDFAPKIIVRAKGCCVYDEQDNAILDFTSGQMSAILGHSHPDITACIEKNLPKLVHLFSGFLSPPVVQLATELSDLLPDGLDKTLFLSTGGEANEAALRMAKVYTNKYECVAFSSSWHGVTGGAASLTFAAARRGYGPALPGSYTIPEPNPKLSPFRDAKGNYDWQKELDYSFYMLDKQSTGSLACMIVETILSTGGIIELPQGYLKALKKKCEERGMLLIIDEAQTGIGRTGSMFSFEHHGIVPDILTLSKSLGAGTALAAVITSEEIEKVCYDNGFVFYTTHASDPLPAAIGSTVLKVVKRDNLVEKAKISGELLRSDLLRLKDKHPLIVDVRGLGLLQGIEIASCTDPSKPSDFLGTVIGDKCLELGMNCNIVHLRGIGGVFRIAPPLTVTDEEIHKAIEIFDSALTFTAKEFSGSY

SEQ ID NO: 32332 - protein, 183 aa, Chlamydia trachomatis
MSKLTQVFKQTKPCIGYLTAGDGGTSYTIEAAKALIQGGVDILELGFPFSDPVADDPEIQVSHDRALAENLTSETLLEIVEGIRAFNQEVPLILYSYYNPLLQRDLDYLRRLKDAGINGVCVIDLPAPLSHGEKSPFEDLLAVGLDPILLISAGTTPERMSLIQEHARGLLYYIPYKLREILK

SEQ ID NO: 32333 - protein, 183 aa, Chlamydia trachomatis
MSKLTQVFKQTKPCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFEDLLAVGLDPILLISAGTTPERMSLIQEHARGLLYYIPYKLREILK

SEQ ID NO: 32334 - protein, 314 aa, Mesorhizobium huakuii
VMFDGSSIAGWKAINESDMVLMPDPDTVHMDPFFAQSTMVILCDILDPVSGESYNRDPRGTAKKAEAYMKSEGIGDQIFVGPEAEFFVFDDVKYKADPYNTGFKLDSTELPSNDDTDYETGNLGHRPRVKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 32335 - protein, 314 aa, Mesorhizobium loti
VMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFRLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPIFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 32336 - protein, 314 aa, Mesorhizobium mediterraneum
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 32337 - protein, 314 aa, Mesorhizobium ciceri
  misc_feature (100)..(100): Xaa can be any naturally occurring amino acid
VMFDGSSIAGWKAITKSDMVLMPDPETVHMDPFFAQSTMVILCDILDPVSGESYNRDPRGTAKKAEAYMKAEGIGDTIFVGPEAEFFVFDDVKYKADPYXTGFKLDSTELPSNDDTDYETGNLGHRPRIKGGYFPVPPIDSAQDMRSEMLTVLAEMGVRVEKHHHEVAAAQHELGIKFDALVRNADKMLIYKYVVHQVANAYGKTATFMPKPIFGDNGSGMHVHMSIWKNGKPTFAGNEYAGLSESCLFFIGGVIKHAKAINAFTNPLTNSYKRLVPGYEAPVLLAYSARNRSASCRIPFGSSPKAKRVEVRFP

SEQ ID NO: 32338 - protein, 314 aa, Rhizobium leguminosarum bv. viciae
VMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 32339 - protein, 314 aa, Rhizobium etli
VMFDGSSIGGWKAINESDMVLMPDTETVHMDPFFAQSTMVILCDILDPVSGEAYNRDPRGTAKKAEAYLKASGIGDTIFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 32340 - protein, 314 aa, Rhizobium tropici
VMFDGSSIAGWKAINESDMVLMPDPDTVHMDPFFAQSTMVILCDILDPISGESYNRDPRGTAKKAEAYLKASGIGDTAFFGPEAEFFVFDDVKYKADPYNTGFKLDSSELPSNDDTDYETGNLGHRPRVKGGYFPVPPIDSCQDMRSEMLTVLTEMGVTVEKHHHEVAAAQHELGIKFDTLVRSADGMQIYKYVVHQVANAYGKTATFMPKPIFGDNGSGMHVHQSVWKGGKPTFAGDEYAGLSETCLYYIGGIIKHAKAINAFTNPSTNSYKRLVPGYEAPVLLAYSARNRSASCRIPFGSNPKAKRVEVRFP

SEQ ID NO: 32341 - protein, 314 aa, Rhizobium tropici
VMFDGSSIAGWKAINESDMVLMPDTETVHMDPFFAQSTMVILCDILDPVSGEAYNRDPRGTAKKAEAYLKASGIGDTAFFGPEAEFFVFDDVKYKADPYNTGFKLDSSELPSNDDTDYETGNLGHRPRVKGGYFPVPPVDSAQDMRSEMLTVLAEMGVVVEKHHHEVAAAQHELGIKFDTLVRNADKMQIYKYVVHQVANAYGKTATFMPKPIFGDNGSGMHVHQSIWKSGKPTFAGDEYAGLSESCLFYIGGIIKHAKAINAFTNPSTNSYKRLVPGYEAPVLLAYSARNRSASCRIPFGSNPKAKRVEVRFP

SEQ ID NO: 32342 - protein, 314 aa, Sinorhizobium terangae
VMFDGSSISGWKAINESDMVLMPDPETAHMDPFFAQSTMVILCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPIDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 32343 - protein, 314 aa, Sinorhizobium fredii
VMFDGSSIAGWKAINESDMVLMPDPETAHMDPFFAQSTMVIVCDILDPVSGEAYNRDPRGTAKKAEAYLKASGIGDTVFVGPEAEFFVFDDVKYKADPYNTGFKLDSSELPSNDDTDYETGNLGHRPRIKGGYFPVPPVDSCQDMRSEMLTVLAEMGVTVEKHHHEVAAAQHELGVKFDALVRNADKMQIYKYVVHQVANAYGKTATFMPKPVFGDNGSGMHVHLSIWKDGKPTFAGDEYAGLSETCLYFIGGIIKHAKALNAFTNPSTNSYKRLVPGYEAPVLLAYSARNRSASCRIPFGSNPKAKRVEVRFP

SEQ ID NO: 32344 - protein, 314 aa, Sinorhizobium medicae
VMFDGSSIGGWKAINESDMVLMPDPETAHMDPFFAQSTMVIFCDILDPVSGEAYNRDPRGTAKKAEAYLKASGIGDTVFVGPEAEFFVFDDVKYKADPYNTGFKLDSSELPSNDDTDYETGNLGHRPRVKGGYFPVPPVDSSQDMRSEMLTVLTEMGVTVEKHHHEVAAAQHELGIKFDALVRNADKMQIYKYVVHQVANAYGKTATFMPKPIFGDNGSGMHVHLSIWKDGKPTFAGDEYAGLSETCLYFIGGIIKHAKALNAFTNPSTNSYKRLVPGYEAPVLLAYSARNRSASCRIPFGSNPKSKRVEVRFP

SEQ ID NO: 32345 - protein, 314 aa, Sinorhizobium saheli
VMFDGSSIAGWKAINESDMVLMPDPETAHMDPFFAQSTMVIFCDILDPVSGEAYNRDPRGTAKKAEAYLKASGIGDAVFVGPEAEFFVFDDVKYKADPYNTGFKLDCSELPSNDDTDYETGNLGHRPRIKGGYFPVPPVDSSQDMRSEMLTVLAEMGVTVEKHHHEVAAAQHELGVKFDALVRNADKMQIYKYVVHQVANAYGKTATFMPKPIFGDNGSGMHVHLSIWKDGRPTFAGDEYAGLSENCLFFIGGIIKHAKALNAFTNPSTNSYKRLVPGYEAPVLLAYSARNRSASCRIPFGSNPKAKRVEVRFP

SEQ ID NO: 32346 - protein, 314 aa, Rhizobium galegae
VMFDGSSIGGWKAINESDMVLMPDPATVHMDPFFAQSTMVIFCDILDPISGEAYNRDPRGTAKKAEAYLKASGIGDTVFVGPEPEFFVFDDVKYKADPYNTGFKLDSSELPSNDDTDYETGNLGHRPRVKGGYFPVPPVDSLQDMRSEMLTVLAEMGVVVEKHHHEVASAQHELGVKFDTLVRNADKIQIYKYVVHQVANAYGKTATFMPKPIFGDNGSGMHVHQSIWKDGKPTFAGDEYAGLSESCLFYIGGIIKHAKAINAFTNPTTNSYKRLVPGYEAPVLLAYSARNRSASCRIPFGTGPKSKRVEVRFP

SEQ ID NO: 32347 - protein, 314 aa, Bradyrhizobium japonicum
TMFDGSSIAGWKAINESDMCLMPDPVTETIDPFFAETTMVIACDVLEPTTGEPYNRDPRGIAKKAEAMVKSMGVGDSVFVGPEAEFFVFDDVRFSSSPYNTGFRLDSSELPTNTDTEYEGGNLGHRIRTKAGYFPVPPQDSVQDMRSEMLGAMAKMGVKVEKHHHEVASAQHELGMKFDTLTLMADHLQIYKYCVHQVAHIYGKTATFMPKPVYGDNGSGMHVHQSIWKDGKPVFAGNKYADLSETCLHYIGGIIKHAKAINAFTNPSTNSYKRLVPGYEAPVLLAYSARNRSASCRIPYTASPKAKRVEVRFP

SEQ ID NO: 32348 - protein, 314 aa, Mesorhizobium tianshanense
VMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRVEKHHHEVAAAQHELGIKFDTLVRNADKMLIYKYVVHQVANAYGKTATFMPKPVFGDNGSGMHVHQSIWKGGKPTFAGNEYAGLSESCLFYIGGIIKHAKAINAFTNPLTNSYKRLVPGYEAPVLLAYSARNRSASCRIPFGSSPKAKRVEVRFP

SEQ ID NO: 32349 - protein, 499 aa, Pseudomonas syringae pv. syringae B728a
MQMTTLTRADWEQRARNLKIEGRAFIQGEYTAASSGETFDCISPVDGRMLAKVASCDAADAQRAVDSARSAFNSGVWSRLAPAKRKATMIRFAGLLEQNAEELALLETLDMGKPISDSLGVDIPGGARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSTKIAKQLMIYAGESNMKRVWLEAGGKSPNIVFADAPDLQAAASAAASAIAFNQGEVCTAGSRLLVERSIKDRFLPMVIEALSAWKPGNPLDPATTVGALVDTQQMNTVLSYIEAGHSDGAKLVAGGKRILQETGGTYVEPTIFDGVNNAMKIAQEEIFGPVLSVLTFDTAEEAIQIANDTQYGLAAAVWTANISKAHLTAKALRAGSVWVNQYDGGDMTAPFGGFKQSGNGRDKSLHAFDKYTELKSTWIKL

SEQ ID NO: 32350 - protein, 244 aa, Pseudomonas syringae pv. syringae B728a
MPLLRISALHKYYGDHHVLKGIDLSVEEGQVVAIIGRSGSGKSTLLRTLNGLESINDGVIEVDGEYLDAARADLRTLRQKVGMVFQQFNLFPHLSVGENVMLAPQVVQKVPKAEAAKLARKMLERVGLGEKFDAFPDRLSGGQQQRVAIARALAMSPKVLLCDEITSALDPELVNEVLSVVRQLAADGMTLIMVTHEMRFAREVGDKLVFMHQGKVHEVGDPKELFANPKTPELANFIGTVEHA

SEQ ID NO: 32351 - protein, 1300 aa, Pseudomonas syringae pv. syringae B728a
MKAAAHSIDRTPHWLIKQAIFNYLEKLESGATLLELDGAAGKDNEDRGELAEEAGLQCFLDFAESIQPQSVLRAAITSAYRRPEPEVVPMLLEQARLSAPVAEATNKMAASIAEKLRNQKSAGGRAGIVQGLLQEFSLSSQEGVALMCLAEALLRIPDKGTRDALIRDKISNGNWQPHLGNSPSLFVNAATWGLLLTGRLVATHNEAGLTSSLSRIIGKSGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVSQIERMATQEGGFGLPHPRIPLPRDLYGTERANSSGIDMANEHRLASLSSALLATAHNDWKAAPMLGCPASAGTLSAALNPSDLRDVVGHVQEASLQDVDNAIQCALSAGPIWQATPPVERAAILERAADLMEAEIQPLMGLLVREAGKTFANAIAEVREAVDFLRYYAVQARNDFTNDGHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVAGRLDSQGRPIPLIAETGGQNAMIVDSSALTEQVVIDVVSSAFDSAGQRCSALRVLCLQEDSADRVIEMLKGAMAENRLGNPERLSVDIGPVIDAEAKAGIEKHIQAMRDKGRTVYQVAIADSAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPQDAIEKSFVRSDALSAPDTRLREVLGKPLQALKAWAASNQQSDLDALCSQYAEQSQSGITRQLAGPTGERNSYAILPREHVLCLADDENDLLIQLAAVLAVGSSAVWPETDIGKPLRARLPKDVQARIKLIPDWAKDEVIFDAVLHHGDSDQLRAICQQIAQRSGAIVGVNGLSHGETNVPLERLVIERALSVNTAAAGGNASLMTIG

SEQ ID NO: 32352 - protein, 472 aa, Pseudomonas syringae pv. syringae B728a
MFTPVILAGGSGSRLWPLSRQSFPKQFLALDGQDQGTMFQRTLARLKGLEHAPAVVVSNENHRFIVAEQLRVAKMGSRRVILEPLARNTAPAIALAALEATADGTDPILLVLAADHHIHDEEAFRQAVAVAQVHAEAGRLVTFGITPTHAETGFGYIHCGESIAQGGFAIEAFKEKPSPEMAAEYLSSGAYLWNSGMFMFRASVFLAELKKHRSDILSACRVALADSDADSYFLHVSAEKFALCADESVDYAVMEHTDLGLVVPLDAGWNDLGSWAAIWDVGPHDENVNRLEGDVMAIDTRNCLVQSHHRLVATVGVEDLIVIETKDAVLVANKHNSQQVKDVVKRLQAEERPEFVTHPLVNRPWGHYDTIDLGERYQVKRISVLPGECLSLQMHYHRAEHWIVVSGTAKVICDDKELILSENQSTYIPLGVKHSLANPGKVPLELIEVQSGSYLGEDDIVRFEDRYGRLKK

SEQ ID NO: 32353 - protein, 185 aa, Pseudomonas syringae pv. syringae B728a
MSADLEHIRQVMREADCLYTEAEVDAAIARVGAQINAELAERNPVVFCVMNGGLIFSGKLLTHLNFPLEASYLHATRYRNETTGGDLFWKAKPEVSFMDRDVLIIDDILDEGHTLGAIIDFCKHAGARAVHTAVLIDKDHDRKARPDLKADYVGLPCIDRYIFGFGMDYKGYWRNAAGIYAVKGM

SEQ ID NO: 32354 - protein, 483 aa, Pseudomonas syringae pv. syringae B728a
MIPVILSGGSGSRLWPLSRKQFPKQFLALTGEHTLFQQTLERLVFEGMQEPIVVCNKDHRFIVNEQLAALNLETQAILMEPFGRNTAPAVALTAMKLVNEGNDGLMLVLPADHVIEDQKALQRALALATVAAERGEMVLFGVPANKPETGYGYIKSTADALLPEGVSRVSQFVEKPDEKRAKEFVEAGGYYWNSGMFLFRASRFLEELKKHDPDIYDTCLLTLERSVQDGDALEIDSSTFACCPDNSIDYAVMEKTQRACVVPLSAGWSDVGCWSSLWEVNAKDANGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 32355 - protein, 473 aa, Pseudomonas syringae pv. syringae B728a
MSSSSTSAAAGQQGRQRAASNRLIFISVLVATMGALAFGYDTGIIAGALPFMTLPADQGGLGLDAYSEGMVTASLIVGAAFGSLASGYISDRFGRRLTLRLLSVLFIAGALGTAIAPSIPFMIAARFVLGIAVGGGSATVPVFIAEIAGPSRRARLVSRNELMIVSGQLLAYVLSAVMAALLHTPGIWRYMLAVAMVPGVLLLVGTFFVPASPRWLASKGRFDEAQDVLEQLRPSKQDAQREVDEMKAQDEEARHRPKARELLRQRWVIKLLLIGVGLGFTAQFTGVNAFMYYTPIILKNTGMGTNAALTATIGNGVVSVIATLLGIWAIGRYGRRHLLMTGLVIVILMQAALGCVLQFMPQNMTQSYTALACILVFLLFMQMCISPVYWLLMSELFPMQVRGLLTGTAVSMQWLFNASVAFTFPIAVDTIGNPTFFIFAAINIGSLIFVFLCLPETKGKSLEQIEKHLKKEL

SEQ ID NO: 32356 - protein, 184 aa, Pseudomonas syringae pv. syringae B728a
MAKASTSEAFIVGTPCHFALFDLKPEFQLDLDQLATRYRELARNVHPDRFADAPEREQRVALERSASLNEAYQTLKSPPKRARYLLAMNGNEVPLEVTVHDPEFLLQQMQLREDLEDLQDEADLAGVATFKRQLKIAQDELNQSFAACWNDAAQREHAEKLMRRMQFLDKLSDEVRQLEERLDD

SEQ ID NO: 32357 - protein, 215 aa, Pseudomonas syringae pv. syringae B728a
MRVILLGAPGAGKGTQAKFITEKFGIPQVSTGDMLRAAVKAETELGLKAKSVMDSGGLVSDDLIIGLIKDRLAEPDCANGVLFDGFPRTIPQAEALLNAGLEIDHVLEIAVDDEEIVKRMSGRRVHEGSGRIYHTIFNPPKVEGIDDVTGEPLLQRKDDVEETVRHRLSVYHAQTKPLVEFYSKLEAKNGKPKCSHIPGVGSVEDITAKVLKALS

SEQ ID NO: 32358 - protein, 455 aa, Pseudomonas syringae pv. syringae B728a
MSVSERRVSRLFDPGSFKEDLEGQNTHFICGAGTIHSIKTYVAMSRGRDCEFQSSRQWSTAQQIIKTVGLARAAEAPLIYIQDKIGGNNDTEGFDTARVFSSDMSSLLLSPSGMGSVSASLAELAKLNLLMSVILGPTSGPLALPVMLADLVLMTRRGALCMGRPDMVKAMLAQQTDLYSLGGSDIHSTASGSVHLVFDDEADLFADLRKLLLYLIAGKSSTYGEFSTPLEVDFNRLLPPSHNIPFDVQHLVRSFVDSDSLIEIGASHAPEVLVGLASLQGQVFAVVANNSAHGGGVIYKRTARKMIHVIDLAGKMSLPILFIADIPGIMIGEEAERDGIFAAVADLFRAHTRCKVKKLLLVARKAYTGGVYAMSGPGFEPVAVLAYPDANIGVFSTLTMEKIIKSSSMTDAQRAVVSALDEEIRSPLLLKDKGLITDVISVRDTRQAVFKYLFH

SEQ ID NO: 32359 - protein, 324 aa, Pseudomonas syringae pv. syringae B728a
MSRIYADNAHSIGNTPLVQINRIAPRGVTILAKIEGRNPGYSVKCRIGANMIWDAESSGRLKPGMTIVEPTSGNTGIGLAFVAAARGYKLMLTMPASMSIERRKVLKALGAELVLTEAAKGMKGAIAKAEELLAGNPGKYFMPAQFENPANPAIHEKTTGPEIWADTDGAIDVLVAGVGTGGTITGISRYIKHTEGKPILSVAVEPDGSPIITQAMAGETITPSPHKIQGIGAGFIPKNLDLSIVDRVERVTDEESKAMARRLMQEEGILCGISCGAAMAAAVRLAEKPEMQGKTIVVVLPDSGERYLSSMLFSDLFTDQELSQ

SEQ ID NO: 32360 - protein, 320 aa, Pseudomonas syringae pv. syringae B728a
MKALQGVEGHVEWVEEPSPALDVGQVRIKVAAAGLNRADLLQREGKYPPPPGVTQTLGLECSGVIAEVGPGSPWVVGDRVCALLAGGAMAEEVVVDGRHVLPVPEGLSLHEAAAIPEVYATAWLNLFELAGLKPGEKVLLHAGASGVGSAGIQLCKAFGNPVWVSVGSAERLAYCVELGAQGGVVRSESLEGLNDFAPFNVILDPVGASYAELNVKLLALDGRWVLIGVMSGREAKVDLAHVLGKRIRLMGSTLRSRDDTFKADLLSDLGQHVWPLFTEGRLKPQLAKSFAIKDAEAAFEELATNTVSGKIVLVIDESLV

SEQ ID NO: 32361 - protein, 403 aa, Pseudomonas syringae pv. syringae B728a
MTQEWDAGRLDSDLEGVGFDTLAVRAGHHRTPEGEHGEPMFFTSSYVFRTAADAAARFSGEVPGNVYSRYTNPTVRSFEERIAALEGAEQAVATATGMAATLAVVMSLCSAGDHVLVSRSVFGSTISLFDKYFKRFGVEVDYVPLADLSGWDAAIKPNTKMLFVESPSNPLAELVDIAALAEIAHAKGAMLIVDNCFCTPALQQPLLLGADIVVHSATKFIDGQGRCMGGVVAGRSEQMKEVVGFLRTAGPTLSPFNAWIFLKGLETLNLRMRAHCANAQALAEWLEQQDGIEKVHYAGLKSHPQHELAQRQQKGFGAVVSFEVKGGKDGAWRFIDATRLISITANLGDSKTTITHPSTTSHGRLAPQEREAAGIRDSLIRVAVGLEDLADLQADLARGLAAL

SEQ ID NO: 32362 - protein, 331 aa, Pseudomonas syringae pv. syringae B728a
MDYVKLGNTGLDISRLCLGCMTFGEPDAGTHPWTLGEEASRPIIKHAVEQGINFFDTANSYSAGTSETIVGKLLKEFTRRDETVIATKVFFPANMWEGSTRPNEKGLSRKAIMSSIDASLTRLGTDYVDLYQIHRWDYDTPIEETMEALHDVVRAGKARYIGASSMYVWQFAKAQQVATAHGWSRFVSMQNYLNLVYREEEREMIPLCIDQGVGLMPWSPMARGRLTRPHGQQTERTRTDVSGQSFYEATEKEDGRVIDAVEQLAAERGVPMAQIALAWVLAKRGVSAPIVGASKATQLDDAIAALQLVLSDEDIKRLEAPYVPHAVTGFV

SEQ ID NO: 32363 - protein, 426 aa, Pseudomonas syringae pv. syringae B728a
MNPSMAIYERESNVRSYCRDCDVVFATAQGAVIEDVEGRQFIDFFAGAGSLNYGHNNPRLKKELLDYIQQDGITTTLDFHSAAKSRFIEQFERIILTPRGMNYKLQFTGPTGTNAIEAALKLARKITGRTCIAAFTHAFHGVTLGSLALTANADKRAVSGVELSNVVRLPYDGFLGRDIDSAHIIETMFSSAGAGFEPPAAIILEVVQGEGGLNCARPQWLQRIQQLCRASGALLIIDDIQAGCGRTGTFFSFESADISPDIICLSKSISGYGLPMSLVLIKPEHDQWAPGEHNGTFRGNNTAFVTAAAALSYWQDNAFERSIAQRSAVLRLALEKIIAHSPPEAVRIVGRGLFMGLRFGDSRRASRLSAECLSQGLLVETCGPLNEVLKLMPPLTIDLPVLERGLDILKRAYLSTLHNESSRGIA

SEQ ID NO: 32364 - protein, 350 aa, Pseudomonas syringae pv. syringae B728a
MYTAIGYAAQSANAPLAPMTFERRALRADDVAIEILYCGVCHSDIHQARNEWGIAVYPLMPGHEIVGRVTATGSSATQYQVGDMVGVGCMVDSCRECSACKSDLEQYCLEGPTMTYATPDRVDGSNTMGGYSNSIVVAEHFVVRVPEKLDPAAAAPILCAGITTYSPLKHYGVKAGDKVGILGMGGLGHMGIKFAKAMGAEVTLFTRSAAKAQEAHRQGADHVIVSTDAEQMKAAAGHFDFLLDTIPVQHDLNPYLETLRFDGAHILVGLIEPIEPPVHAANLVMSRRVLAGSLIGGIAETQEVLDFCAENDITCDIEMLDIRNINEAYERMLAGDVKYRFVIDMATLKA

SEQ ID NO: 32365 - protein, 363 aa, Pseudomonas syringae pv. syringae B728a
MSALFEPFKLKDVTLRNRIAIPPMCQYSATEGVINDWHHVHLASMARGGAGLLVVEATAVAPEGRITPGCTGIWNDEQAQAFVPVVKAIKAAGCVPGIQIAHAGRKASANRPWEGDDHIAASNSRGWDTIAPSAIAFGANLPKVPRAMTLDDIARVRQNFVDAARRARDAGFEWIELHFAHGYLGQSFFSEHSNQRTDEYGGSFDNRSRFLLETLAAVREVWPENLPLTARFGVIEYDGRDEQTLAESIELARRFKAGGLDLLSVSVGFSTPDANIPWGPAFMGPIAERVRREADIPVTSAWGFGEPKLAEEAVKSGQLDLVSIGRAHLADPHWAYFAAKELGVEKSAWTLPAPYAHWLERYR

SEQ ID NO: 32366 - protein, 476 aa, Pseudomonas syringae pv. syringae B728a
MYPDVQLYIDGQWRASRDNRTLSVINPATGEALGAVAHAGIADLDEALAAAERGFATWRATSAYDRYKLMQKAANLVRERADSIARIMTQEQGKPLAEARMETLSAADIIDWLAEEGRRSYGRLVPSRNVSIEQKVIKEPVGPVAAFTPWNFPINQVVRKLSSALAAGCSIIVKAPEETPASPAELIRAFADAGVPAGVIGLVYGDPAEISGYLIPHPVIRKVTFTGSTPVGKQLAALAGKHMKRATMELGGHAPALVFDDADIDLAARVLATAKFRNAGQVCVSPTRILVQRKVLDAFTEKFVGLTREIKVGNGLEAGTTMGPVANDRRIPALVDLIDDAVRGGATLSAGGKAGEGPGYFFEPTVLSGLKPHMRIMNEEPFGPVALLVPFDTLEEAIAESNRVPFGLASYAFTTSMKTAQALSTYIEAGMLSINHQGIGLPEVPFGGIKDSGYGSEGGTEAIEAYLNTKLVTQYN

SEQ ID NO: 32367 - protein, 374 aa, Pseudomonas syringae pv. syringae B728a
MLSYGVTLIPIEQVTVMVKTYSYAAQSAQDTLKPHQFERCSPGADDVQIDILYCGVCHSDLHTARNEWHNTLYPSVPGHEIVGRVTAVGSDVKQFKVGDLAGVGCMVDSCQQCASCAEGDEQYCESGFTGTYNGPVFGGENTFGGYSDKIVVKEKFVLRISHDANLAAVAPLLCAGITTYSPLRHWKVGPGKKVGIVGLGGLGHMGVKIAHAMGAHVVLFTTSPDKREDGLRLGADEVVVSRDAGQMAAQANSLDFILNTVAAPHDLDAFLSLLKRDGTMTLVGAPAEPHPSPAVFNLIFKRRSLAGSLIGGIQETQEMLDFCAEHGIVSDIEVIAMQDINEAYERMLKGDVKYRFVIDMDSLKQEAAADSNAA

SEQ ID NO: 32368 - protein, 482 aa, Pseudomonas syringae pv. syringae B728a
MLDVPLLIGGQSCPARDGRTFERCNPVTGKVVSRVAAATLEDADAAVAAAQAAFPGWAAMLPGERRARLLEAAAQLQARSGEFIAAAGETGAMANWYGFNVQLAADMLREAASMTTQITGDVIPSNVPGNFAMALRQPCGVVLGIAPWNAPVILATRAIAMPLACGNTVVLKASELSPAVHRLIGQVLQDAGLGDGVVNVISNAPADAPAIVERLIANPAVRRVNFTGSTHVGRIVGELSARYLKPALLELGGKAPFLVLDDADLDAAVEAAAFGAYFNQGQICLSTERLIVDHKVADTFVARLTAKIKTLRAGNPDDSESVLGSLVDVGAGTRIKGLIDDAVARGATLVIGGQLQGSILQPTLLDGVTDAMRLYREESFGPVAVVLRGDGDEALLRLANDSDFGLSAAIFSRDTSRALALAQRVESGICHINGPTVHDEAQMPFGGVKSSGYGSFGGKASIEQFTQLRWVTLQNGPRHYPI

SEQ ID NO: 32369 - protein, 261 aa, Pseudomonas syringae pv. syringae B728a
MSEASTPVRAGRIQIQGVGKRFGSQQVLKDIDLSIEPGKVTVILGPSGSGKSTLLRTINHLEKIDSGYITIDGDYVGYRRKGDLLYELKEREILKRRIEVGFVFQNFNLFAHLTAWENIAEAPLAHKRWSKSEARARASELLARVGLADKTDAYPRQLSGGQQQRVAIARALALDPKVLLFDEPTSALDPELVGEVLDVIKGLTQLGVTLVVVTHEIGFAREVADHVVFLCEGRLIEQGPPEQVFHQPRHPRTAAFLGKVL

SEQ ID NO: 32370 - protein, 340 aa, Pseudomonas syringae pv. syringae B728a
MSRTIRFHQFGPAEVLKVEEHPVASPVTGEVQVRVQAIGVSWYDVLWRQNLAATHARLPAGLGYEMAGVVTALGDGVDDLQVGDKVASFPAADANQHPVYGESIVMPRRALTRYPDALTPVQASVHYTPYLVAYFAYVDLARIKSGQTVLVTDASHCSGPAFVQLGKALGARVIAATKTEDAREYLLSLGADKVVVTEEQDLLMAINKYTDNRGVDAVFDGLGGPQMSIMGDVLAPRGSLVLYGLQGGNQTPFPACAAFQKNIQFYVHCLGNFTGKPELGITQDQEALQRALQDINQMTRDKVLMPLQTRSFPFDQVVQAHRYMDVCPIGGRAVLEVEAV

SEQ ID NO: 32371 - protein, 367 aa, Pseudomonas syringae pv. syringae B728a
MHDPRTTTDLFSPVTLGSMELANRIVMAPVTRSRYGEDGVPNELHATYYAQRATAGLIVAEATNISAQGRGYAATPGIWSEQQVAGWRLVTDAVHAAGGKIVSQLWHVGRFSSVDLQPNGEAPVAPSAIKAEGNTYTAGGFVPVSMPRALETGEIPGIIEQYKHAAENAKRAGFDGIEVHSANSYLLDQFLRDSTNQRTDQYGGSIENRARLTLEVTQAIVDIWGSDRVGIRLSPVTPDAGNTAPDSNVMGLHGYLIQQLNTFNLAYLHFVEGATATSREVPEGVDMDALSAGFNGPFIGNNNYDLKMAIERRAQGKIDAVAFGRLFISNPDLVARLRHGAELTIAPRESYYGGGAKGYIDWPMGKY

SEQ ID NO: 32372 - protein, 324 aa, Pseudomonas syringae pv. syringae B728a
MQLGIIGLGRMGGNIARRLMLNGHTTVVYDRDEASRNALANDGSTAVADLKELVGALARPRAVWVMLPAGAPTEETIQTLSQLLDADDVIIDGGNTFYKDDIRRAQELTEKGLHYVDVGTSGGVWGLERGYCMMIGGEAAVVERLDPLFATLAPGLGSIERTRDRTSTDDRAERGYIHSGPAGSGHFVKMIHNGIEYGMMQAFAEGFDLLKQKNSELLPPEQRFDLNTADIAEVWRRGSVVSSWLLDLTADALATDPHLDAFSGSVADSGEGRWTIEAAIEQAVPVPVLSSALFARFRSRQTSSYADKMLSAMRFGFGGHKEPK

SEQ ID NO: 32373 - protein, 505 aa, Pseudomonas syringae pv. syringae B728a
MSTARILELMRPYWGDRSVIASYVGGQFIEGHGAPVEVRNAHDDSLLLSFPDADESLVEVADKAARAAQQQWWALTAQARGRAMYQVGNLIRDELENLAQIESLTANKPIRDARVEVLKVAEMFEYYAGWADKLHGEIIPVPTTHLNYVTYEPLGTVLQITPWNAPIFTCGWQIAPAIAAGNAVILKPSELTPLSSLMVGVLIERAGVPKGLVNVIAGFGHSIGQAFIAKADIRKVVFVGSPATGRHIAVAAAQRCIPAVLELGGKSANIVFDDADLEVALRGAQAAIFSGAGQSCVSGSRLLVQESIFEKFTNALAVAATQFKVGDPSDPETQIGPINNAKQYNHVKNMVEQALKDGAKLVGEHADPIPEKPGYYINPTVLAGTNALYCAQEEIFGPVVVAIPFKDEEDAIRIANDSRFGLAGGVWTRDVGRAHRVARQVRAGTFWVNGYKTIHVSSPFGGYGESGYGRSSGLDALREYSEVKSVWVETAAKPAASFGYGASLE

SEQ ID NO: 32374 - protein, 405 aa, Pseudomonas syringae pv. syringae B728a
MSVEHAAVQRADFDQVMVPNYAPAGFIPVRGAGSRVWDQAGRELVDFSGGIAVNVLGHCHPALVGALTEQANNLWHVSNVFTNEPTLRLAKKLVDATFAERVFFCNSGAEANEAAFKLARRVAHDQYGPEKYEIIAALNSFHGRTLFTVSVGGQPKYSDGFGPKITGISHVPYNDLDALKAAVTDKTCAVVLEPIQGEGGVLPGQLEYLQGARKLCDEHNALLVFDEVQSGMGRSGHLFAYMHYGVTPDILSSAKSIGGGFPLAAMLTTEKLARHFAVGVHGTTYGGNPLACAVGEAVIDVINTPEVLAGVQRKHQQFKTRLQSIGQQYGVFSEVRGLGLLIGCVLSDAWKGKAKDIFNAAEAQDLMILQAGPDVIRFAPSLVIEDADIEEGLNRFERAIAQLTS

SEQ ID NO: 32375 - protein, 403 aa, Pseudomonas syringae pv. syringae B728a
MQFNKSNKLANVCYDIRGPVLKHAKRLEEEGHRILKLNIGNPAPFGFEAPDEILQDVIRNLPTAQGYSDSKGLFSARKAVMQYYQQKQVEGVGIEDIYLGNGVSELIVMSMQALLNNGDEVLVPAPDYPLWTAAVALSGGSPVHYLCDEQANWWPDLEDIKAKITPNTKAMVIINPNNPTGAVYSREVLLGMLELARQHNLVVFSDEIYDKILYDDAVHICTASLAPDLLCLTFNGLSKSYRVAGFRSGWIAISGPKHNAQSYIEGIDILANMRLCANVPSQHAIQTALGGYQSINDLILPPGRLLEQRNRTWELLNDIPGVSCVKPMGALYAFPRIDPKVCPILNDEKFVLDLLLSEKLLVVQGTAFNWPYPDHFRVVTLPRVDELEQAIGRIGNFLKGYRQ

SEQ ID NO: 32376 - protein, 184 aa, Pseudomonas syringae pv. syringae B728a
MMKLRFFSIPLLLLAMSGAAMAADCPPLLQGELPKLRAKENIDLCKRFAGKPLVVVNTASFCGFAPQFKGLEALSQRYKGQGLEVLGVPSNDFKQEAKDGEETAKVCYVNYGVTFTMTEPQAVRGDDATHLFKVLAEQSSAPRWNFYKYVVDRQGKVIANFSSMTKPDDPELIAAIEKAIASKP

SEQ ID NO: 32377 - protein, 251 aa, Pseudomonas syringae pv. syringae B728a
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 32378 - protein, 300 aa, Pseudomonas syringae pv. syringae B728a
MSVLIRTHDRVLTKLEMNSPGGSHKYRAANLIVKNALRNGKIIPGITTVIEKAGGNFGFGLLSACHAYGIPVELAVGLGFSQTKRDLLECFGAKLIGKDMLIAGASPRDVVAHHLEHQVEMDKCYYYTDQFNNQIGIEAYRYQTAFELACQLEEAEADKELLFIGCAGTGASFTGITLGLKDNGFDVSTVLVDPSGCDSKNGVFSDHRFEGMAVGVCPPFLDWSLVNRCYQVEHGEMLAAQRGFYIQSGTFVGNTAAACLAVAQRLACLPEYAETTLVTIAYDNGLWYQDLQRSVALSAA

SEQ ID NO: 32379 - protein, 387 aa, Pseudomonas syringae pv. syringae B728a
MTVLKMTDLDLQGKRVLIREDLNVPVKDGVVSSDARILASLPTIRLALEKGAAVMVCSHLGRPTEGEFSAENSLKPVADYLSKALGRDVPLVADYLDGVDVKAGEVVLFENVRFNKGEKKNADELAQQYAALCDVFVMDAFGTAHRAEGSTHGVAKFAKVAAAGPLLAAELEALGKALGAPAQPMTAIVAGSKVSTKLDVLNSLSGICNQLIVGGGIANTFLAAAGHKVGKSLYEPDLLDTARAIAAKVSVPLPTDVVVAKEFAESAAATVKLIADVADDDMILDIGPQTAAHFAELLKSSGTILWNGPVGVFEFDQFGEGTKTLAKAIAESQAFSIAGGGDTLAAIDKYGVAQQISYISTGGGAFLEFVEGKVLPAVEVLEQRAKA

SEQ ID NO: 32380 - protein, 458 aa, Pseudomonas syringae pv. syringae B728a
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSASGSEIGISNLWAHGGFMPNGVTGLIASFAVVMFAFGGIEIIGITAGEAKDPRRSLPQAINAVPLRILLFYVLTLFVLMCIYPWPQIGTQGSPFVQIFDNLGIASAATILNIVVISAAVSAINSDIFGAGRMMYGLAREGQAPASFARVSRHGVPWMTVLVMGIALLGGVLLNYLIPKDVFLLIASLATFATVWVWLMILLTQVSMRRSMSREEAAQLKFAVPFWPYGPAAAIAFMLFIFGVLGYFPDNRAALIVGAIWIVLLLIAYAVWVKPKALNTTH

SEQ ID NO: 32381 - protein, 407 aa, Musa acuminata
MAAFMFFLTIAAFTAPVYSSRAPLTSAAVRDPELVVQEVQRSLNVSRRRLGYLSCGTGNPIDDCWRCDPDWADNRQRLADCAIGFGKNAIGGRDGEIYVVTDSGDDDPVNPKTGTLRYAVIQEEPLWIIFKRDMVIQLKEELIMNSHKTIDGRGASVHISGGPCITIQYVTNIIIHGVHIHDCKQGGNAYVRDSPGHYGWRTVSDGDGVSIFGGSHVWVDHCTLSNCHDGLIDAIHGSTAITISNNYLSHHDKVMLLGHSDELTSDKSMQVTIAFNHFGEDLVQRMPRCRHGYFHVVNNDYTHWEMYAIGGSAAPTINSQGNRFLAPNDRFAKEVTKREDAQESEWKKWNWRSEGDQMLNGAFFTPSGAGASSSYAKASSLGARSSSLVGTITVSAGVLSCKKGSRC

SEQ ID NO: 32382 - protein, 454 aa, Musa acuminata
MTAGLRWIPPLLLLLLGFLLVLNGSRGWIGSERSSGSRNGGASRRSLREASANATSADASLEERAVTRAAEAAVDDPEEVASTVLTTIINSTARRSLGYLSCGSGNPIDDCWRCDPDWHVNRKKLADCGIGFGRNAIGGRDGELYVVTDSGDDDPVNPRPGTLRYAVIQDVPLWITFKHDMEITLKEELIMNSFKTIDGRGVNVHIANGACITIQYITNVIIHGLHIHDCKPTGNAMVRSSPSHYGWRTMADGDAVSIFGSSHIWVDHCSLSNCADGLVDAVMGSTAITVSNNYFTHHNEVMLLGHTDSYARDSIMQVTIAFNHFGEGLIQRMPRCRHGYFHVVNNDYTHWEMYAIGGSANPTINSQGNRYLAPTNPFAKEVTKRVDTDQSTWKNWNWRSEGDLLLNGAFFTPSGAGASASYARASSFGAKPSSLVDTLTSDAGVLSCQVGTRC

SEQ ID NO: 32383 - protein, 431 aa, Pseudomonas fluorescens
MLEKLFQLKAHNTNVRTEILAGVTTFLAMAYILFVNPSILGETGMDKGAVFVATCLAAAIGSTVMGLIANYPIALAPGMGLNAFFTYTVVLHMGHTWQVALGAVFISAVLFFLLSIFRIREWIINSIPLPLRSAIAAGIGLFLALIALHNAGIVVSNPATMVGLGDLKQPAPILATLGFALIVALEALKVRGAVLIGILVVTIVSIVLGFTPFGGVMSMPPSLAPTFLQLDIKGALDIGLVSVIFAFLLVDLFDNSGTLIGVAKRAGLMGKDGHMPKMGRALIADSTAAMAGSLLGTSTTTSYIESAAGVSAGGRTGLTAVVVAILFLLALFFSPLAASVPAFATAPALLFVAVLMTSGLAEIDWDDITVAAPVVITALAMPFTYSIANGIAFGFIAWTAIKLLSGRYRELNPALVILSILFVIKLGWFNA

SEQ ID NO: 32384 - protein, 484 aa, Comamonas testosteroni
MKDIQNFINGAYVSTGRSFDKHSPLTGKVIAKVHEAGRNEVDAAVTAARTALNGPWGRMSVAERVEKLYAVADGINRRFEEFLAAECADTGKPRSVASHIDIPRGAANFKIFADVVKNVPTEFFEMATPDGRGAINYGHRGPVGVVGVICPWNLPLLLMTWKVGPALACGNTVVVKPSEESPQTAALLGEVMNEAGIPPGVYNVVHGFGPDSAGEFVTSHPGVDAITFTGETRTGEAIMKAAAKGARPVSLEMGGKNAAIVFADCDFDAAIDGTLRSAFVNSGQVCLGTERVYVERPIYERFVAALKQQIEGWKIGVPEDDDTKLGPLISKEHQAKVLSYYQLAVQEGATVVTGGGMPDLGAQYADGAWVQPTIWTGLPETARVIKEEIFGPCCHIAPFDTEEEVLTKANDNVYGLASAIWTQDLARAHRVAQRMHVGISWVNSWFLRDLRTPFGGAKQSGIGREGGVHSLEFYTELKNVCIKL

SEQ ID NO: 32385 - protein, 211 aa, Carica papaya
MSYDYLFKYIIIGDTGVGKSCLLLQFTDKRFQPVHDLTIGVEFGARMVAIDGRPIKLQIRDTAGQESFRSITRSYYRGAAGALLVYDITRRETFNHLASWLEDARQHANPNMSIMLIGNKSDLSHRRAVSKEEGEQFAKEHGLLFLEASARTAQNVEEAFIRTAAKILQNIQEGVIDVSNESSGIKFGYGRPQGTAGARDGAVAQRSGCCG

SEQ ID NO: 32386 - protein, 454 aa, Medicago truncatula
MDLIELSKAVENVELVDTLDTDVSFVRILWVDNSGQHRCRAIPRKRFYDVVTKNGVGLAFVSMVMTSFLDGSPAGSGLGSVGEARLTPDLSTKRTIPWSKQDEIVLGDLNLQPGQAWEYCPREALRRVSKILKDEFDLAMNAGFENEFFLLKSAIREGKEEWIQFDSTPYCSSSAFDVASPILREVTSALHSMGIPVEQLHAEAGKGQFELVLGHMVCTKSADNLVYTRETVRAIARKHGLLATFVPKYTLDDLGSGCHVHLSLWQNGRNVFMASDESSKYGISTLGKEFMAGVLHHLPSILSFVAPLPISYDRLQPNTWSGAYMFWGNENREAPLRASTPPGTPNGFASNFEFKSFDGCANPYLGLSAIIAAGIDGLRRHLSLPEPVDTNPDPEKLQRLPKSLSESLEALHKADFLEEFIGDKLLTAIKAIRKAEIDHYSKNKDAYKQLIHRY

SEQ ID NO: 32387 - protein, 220 aa, Gossypium hirsutum
MDADTWSVRLSSASKRYQSSLESRSNMLMGFEEIDEEDDIREEFPCPFCSEYFDIVGLCCHIDDEHPVEAKNGVCPVCALRVGVDMVAHITLQHGHIVKMQRKRKSRKGGSHSTLSLLKEELREGNLQTLLGGSSCIVSSSNSAPDPLLSLFILPMVDDFVSDQPPFRTETSRNNKSSDMNKSERTTQSSPLSVKDQEEKAKRCACVQGLLLSTIVDDIL

SEQ ID NO: 32388 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 32389 - protein, 458 aa, Vibrio cholerae non-O1
MSVVSQVLSHMRGDFFRRLIAIALPITLQNIMFSSRGLVDVLMLGQLGEAEIAAVGVAARATFVTTIMLVGVTTGGALLTAQYWGAGDRKGVRESTALTWLVSNFFAFFTVLLFLFFPQQIMSLTTDSEQVNALGSQYLIITSFTMFAVACVSSMAVGLRAMHKPGVSTFFSGIGIVSNVVLNWILIFGKFGFPAMGIQGAAIATVLSGAIEIACLYSYLYGKKHLMAFGLQDIKAVIDWPKISRFLCLSLPTTFNFLIWAAGLFTYHAIMGQTGVQGLAALSVMTPVESISLSLLIGMSTAAAVLVGNQLGAKNYEAVYYQAIGVTACSVLVGIVVAIGLYLVQIPVLGTFTALTPETRELSEKFMLILCLGIVLRSFPMTAIVGVLRAGGDVKFCLGQDIVAQWCIGIPLAAFAALVLKVEPEWIYLLFLTEEAVKWFGSLHRMKSKKWMKNLIEN

SEQ ID NO: 32390 - protein, 201 aa, Fragaria x ananassa
MEAKEEDVSLGANKYPERQPIGIAAQSQDDGKDYKEPPPAPLFEPGELTSWSFYRAGIAEFIATFLFLYITVLTVMGVLKGPTKCQTVGIQGIAWAFGGMIFALVYCTAGISGGHINPAVTFGLFLARKLSLTRAVFYIIMQTLGAIAGAAVVKAFENKNHFFELNGGGANSVAHGYTKGSGLGAEIMGTFVLVYTVFSAT

SEQ ID NO: 32391 - protein, 124 aa, Capsicum annuum
YIVSTKCGRYKEGFDFCAERVTKSIDESLERLQLDYVDIFHCHDIEFGSLDQIVNETLPALLKLKQAGKIRFIGITGLPLGIFTYVLDRVPPGTVDVILSYCHYSINDSTLEDLLPYLKSKGVG

SEQ ID NO: 32392 - protein, 471 aa, Arabidopsis thaliana
MAPALSPTRSHHVAVIGAGPAGLVAARELRREGHSVVVFEKQKQVGGTWIYTDEVESDPLSVDPTRSVVHSSVYRSLRINGTRECTGYRDFPFVVRSGVSRDRRRFPSHGEVLAYLKDFAKEFGIEEMVRFETEVVKVSPAAEEGIGKWRIESTEKEKKVRRDEIYDAVVVCNGHYVEPRLAQIPGISSWPGKEMHSHNYRIPEPFRDKVAVLIGNSSSAEDISRDIARVAKEIESVHEDGSVVYQNGKTISVDIIMHCTGYKYHFPFLDTNGIVTVDDNRVGPLYKDVFPPAFAPWLSFIGIPWQVLPFPMFELQSKWIAGVLSGRIPLPSKEDMMIEIKTFYSTLEVQGIPKRYTHRMGNTQFEYDNWLASQCGCSETEEWRKEMCLANGVRKEAHPETYRDEWDDHHLVSEAYQDFSLNYDGLLLAVGGVISSSLALANTMTLIAKITKQNLRKNFNVRDQDDNRLVF

SEQ ID NO: 32393 - protein, 372 aa, Pseudomonas sp.
MIKSRAAVAFAPNQPLQIVEVDVAPPKAGEVLVRVVATGVCHTDAYTLSGADSEGVFPCILGHEGGGIVEAVGEGVTSLAVGDHVIPLYTAECRECKFFKSGKTNLCQKVRATQGKGLMPDGTSRFSYNGQPIYHYMGCSTFSEYTVLPEISLAKIPKNAPLEKVCLLGCGVTTGIGAVLNTAKVEEGATVAIFGLGGIGLAAIIGAKMAKASRIIAIDINPSKFDVARELGATDFVNPNDHAKPIQDVIVEMTDGGVDYSFECIGNVRLMRAALECCHKGWGESVIIGVAPAGAEINTRPFHLVTGRVWRGSAFGGVKGRTELPSYVEKAQQGEIPLDTFITHTMGLDDINTAFDLMDEGKSIRSVVQLSR

SEQ ID NO: 32394 - protein, 140 aa, Lactuca sativa
TRGEKQSLKKLESSLKLYAPESAPALAIKATMEKTKRRFDNYGKQGLLCGSDGLPHLIVSGDQRHWGEFITPGILFLYIAGWIGWVGRSYLIAIRDEKKPTMKEIIIDVPLASSLVFRGFIWPVAAYRELLNGELIDPSV

SEQ ID NO: 32395 - protein, 181 aa, Lactuca sativa
MASISSSAVATVNRSTPAQASLAAPFTGLKSNVAFPVTKKANNDFSSLPSNGGRVQCMKVWPPIGLKKYETLSYLPPLSDEALSKEIDYLIRNKWVPCLEFELEHGFVYREHHHSPGYYDGRYWTMWKLPMFGCTDSAQVMKEVGECKKEYPNAFIRVIGFDSVRQVQCISFIVSKPPGVL

SEQ ID NO: 32396 - protein, 483 aa, Cupriavidus necator
MELQHTALLRTHCLIDGEWTGAQSGAELAVCNPATGERIGSVPLAGAAEAEQAVRAAERALPAWRAQTGKAVPPVLRRWADLMLAHQEDLARLMTAEQGKPLPDARGEVAYAASFLEWFGEEAKRVDGEVLASPRSSQKMLVLREPVGVCAAITPWNFPAAMITRKVGPALAAGCTIIVKPAEQTPLTALALAVLGEQAGVPRGVLQVVTGDAVQIGGVLCASPVVRKLSFTGSTAIGKLLMAQCAGTVKKLSLELGGNAPLIIFDDADMDSAVEGIIASKFRNTRQTCVCANRIYVHDRVYDEVARRLVSAVEQLLPGHGVDSGVTQGPLIDADAVAKVEAHIADALAQGATVLTGGQRHALGGTFFAPTVLANATASMRVAREETFGPLAPLFRFTSEAEVVAMANDTESGLAAYFFSRDMAKIWRVAQGLEYGMVGINTGLISNEVAPFGGVKQSGLGREGSRHGIDEYLETKYLCMEVE

SEQ ID NO: 32397 - protein, 333 aa, Brassica oleracea
DLKPDNFLMGLGRRANQVYIIDFGLAKKYRDSTTHQHIPYRENKNLTGTARYASMNTHLGIEQSRRDDLESLGYILMYFLKGSLPWQGLKAGNKKQKYERISEKKVSTSIEVLCRGYPSEFASYFHYCRSLRFDDKPDYAYLKRIFRDLFIREGFQFDYVFDWTILKYQQSQLTAPPSRNLNPAVGTSAALPPGVSNIDRYTGEEEGRPVGYSHMESSRRRASGTLDHSGNLSNQQTSSFNRDSMMPSSSMFAQSAGSSRRVAAVSSRDNLLSGEEFQRSHRTGDVSRGGVISRNSPVEAGKRSSSSRRHYESAIKGIDNLQVSSDDKFHHHH

SEQ ID NO: 32398 - protein, 426 aa, Brassica oleracea
ENVKTKHPQLLYESKLYKVLQGGTGVPNIKWYGVEGEYNVLVIDLLGPSLEDLFNFCSRKLSLKTVLMLADQMINRIEFVHQRSFLHRDIKPDNFLMGLGRRANQVYIIDFGLAKKYRDSNHQHIPYRENKNLTGTARYASMNTHLGIEQSRRDDLESLGFVLMYFLKGSLPWQGLKAGNKKQKYERISEKKVSTSIESLCRGYPSEFASYFHYCRSLRFDDKPDYAYLKRLFRDLFIREGFQFDYVFDWTILKYQQSQLSTPPRPNVPGVGQSSGLPPAIASAERPSGGEEARTSGWPSGNARRISGQIFNSGNLAKQKAPVSSDPAISKNVMLSSSSFLRATGSSRRAAVSGSREAAVPGTDSEPSNPQIIEAGTSSNPKIHGGRSSPIVSSENKKLSSPSRGNTSVMKNYESNLNKGIEGLHF

SEQ ID NO: 32399 - protein, 466 aa, Sinorhizobium fredii
MSKRFRSRSAARAARHRLRRGEQDMSNRLNTTPNDLSAFWMPFTANRQFKKEPRLFVGAKDMYYTTHDGRTVLDGTAGLWCVNAGHCRPKITEAIREQAGELDYAPAFQLGHPKAFELANRLVDIAPEGLNHVLYTNSGSESVDTALKVALAYHRAKGNGSRFRLIGRERGYHGVNFGGISVGGIVANRKMFGTLLTGVDHLPHTHLPAKNAFTRGEPKHGGDLASELERIVTLHDASTIAAVIVEPVAGSTGVLIPPKGYLQKLREICTKHGILLIFDEVITGYGRLGTPFAAQYFDVKPDIITTAKGLTNGVIPMGAVFVTSEIHDAFMTGPEHLIEFFHGYTYSGNPIASAAALGTLDTYKEEGLLTRAAELASYWEEALHSLKDCPHVIDIRNIGLIGAVELEPIAGEPTKRAFSAFLKAYEKGLLIRTTGDIIALSPPLIIEKHQIDELIDKLRDVLKNNI

SEQ ID NO: 32400 - protein, 229 aa, Glycine max
KGCTGVFHVATPMDFDSKDPENEVIKPTINGLLDIMKACVKAKTVRRLVFTSSAGTVDVTEHPNPVIDENCWSDVDFCTRVKMTGWMYFVSKTLAEQEAWKYAKEHNIDFISVIPPLVVGPFLMPTMPPSLITALSLITGNESHYHIIKQGQFVHLDDLCLGHIFVFENPKAEGRYICCSHEATIHDIAKLLNQKYPEYNVLTKFKNIPDELDIIKFSSKKITDLGFKF

SEQ ID NO: 32401 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 32402 - protein, 416 aa, Bacillus sp. TS-47
KELGHEVLKPYDGWAAYGEGTTGGAMASPQNVFVVTNRTELIQALGGNNHTNQYNSVPKIIYVKGTIDLNVDDNNQPVGPDFYKDPHFDFEAYLREYDPATWGKKEVEGPLEEARVRSQKKQKDRIMVYVGSNTSIIGVGKDAKIKGGGFLIKNVDNVIIRNIEFEAPLDYFPEWDPTDGTLGEWNSEYDSISIEGSSHIWIDHNTFTDGDHPDRSLGTYFGRPFQQHDGALDIKNSSDFITISYNVFTNHDKVTLIGASDSRMADSGHLRVTLHHNYYKNVTQRLPRVRFGQVHIYNNYYEFSNLADYDFQYAWGVGVFSQIYAQNNYFSFDWDIDPSLIIKVWSKNEESMYETGTIVDLPNGRRYIDLVASYNESNTLQLKKEVTWKPMFYHVIHPTPSVPALVKAKAGAGNLH

SEQ ID NO: 32403 - protein, 316 aa, Haemophilus influenzae
  misc_feature (42)..(42): Xaa can be any naturally occurring amino acid
MAIYADNSYSIGNTPLVRLKHFGHNGNVVVKIEGRNPSYSVXCRIGANMVWQAEKDGTLTKGKEIVDATSGNTGIALAYVAAARGYKITLTMPETMSLERKRLLCGLGVNLVLTEGAKGMKGAIAKAEEIVASDPSRYVMLKQFENPANPQIHRETTGPEIWKDTDGKVDVVVAGVGTGGSITGISRAIKLDFGKQITSVAVEPVESPVISQTLAGEEVKPGPHKIQGIGAGFIPKNLDLSIIDRVETVDSDTALATARRLMAEEGILAGISSGAAVAAADRLAKLPEFADKLIVVILPSASERYLSTALFEGIEG

SEQ ID NO: 32404 - protein, 464 aa, Thermotoga maritima
MGSDKIHHHHHHMKRILVSLYEKEKYLDILRELHEKGWEIWASSGTAKFLKSNGIEANDVSTITGFENLLGGLVKTLHPEIFAGILGPEPRWDVVFVDLYPPPDIDIGGVALLRAAAKNWKKVKPAFDMETLKLAIEIDDEETRKYLAGMTFAFTSVYDSIRANQFVEGISLAFKREDLQLRYGENPHEKAFVYGKPAFEILHEGKTISFNNILDAENAWFMAKNLPRMGAVVVKHQSPCGAAIGEDKVEIVKKAIEADDESSFGGILAVNFEMDEEVAKSLKKYLEVIVAPSFTQEAIEVLSKKKVRLLKPGDYASWAGKMAFGSLVLSERKYPEGNFELVVGEPLSEKELEDLEFAYRVVEGAKSNAVLIAKDGVTVGIGSGQPSRKRAAWIATVMAGEKAKGAVAASDAFFPFPDSLEILAQAGVKAVVAPLGSIRDEEVIEKARELGITFYKAPSRVFRH

SEQ ID NO: 32405 - protein, 459 aa, Botryotinia fuckeliana
MSSPSGSSQASGAGKANGALNKAFPHIDLDGHNLPPSPAPSSPHNGRRYALATELVYTETKDQYGASSMPIYQSATFKQNLAGGGSEYDYTRSGNPTRTHLERHLAKIMNANRALVVGSGMGALDVITRVLRPGDEVITGDDLYGGTNRLLTYLAANTGIIVHHVDTTTPDKVKAVLGPKTAMVLLETPTNPLIKIVDIATIARTAHELNEKALVVVDNTMLSPMLCNPLDLGADIVYESGTKYLSGHHDIMAGVLAFNDPAIGDKMYFTINSTGCGLSPNDSFLLMRGIKTLAIRMERQQTNAQAIAEFLETHGFRVRYPGLKSHPQYDLHWSMARGAGAVLSFETGDVALSERIVEAAKLWGISVSFGCVNSLISMPCQMSHASIDAKTRKERQMPEDIIRLCVGIEDVNDLIDDLSRALVQAGAVKVTLDGFHAIDAAQAIAEVPIAESDAAAAPL

SEQ ID NO: 32406 - protein, 294 aa, Spirulina sp.
AKTDIPVNIYKPKNPYIGKCLSNEELVREGGTGTVRHLIFDISGGDLRYLEGQSIGIIPPGTDNNGKPHKLRLYSIASTRHGDHVDDKTVSLCVRQLEYKHPETGETVYGVCSTYLCNLEAGADVAITGPVGKEMLLPEDEDATIIMMATGTGIAPFRAFLWRIFKEQHEDYKFKGLAWLFFGIPYSPNILYQQELEELQEEFPENFRLTLAISREQQNPEGGKMYIQDRIKENADQLWELIQKPNTHTYICGLKGMEGGIDEGMSAAAGKFDVDWSDYQKELKKKHRWHVETY

SEQ ID NO: 32407 - protein, 320 aa, Arabidopsis thaliana
MATAVGGGSDVEVGFAKLQGEDFEYYMQSYSIILGRNSKKATVDVDLSSLGGGMNISRNHARIFYDFTRRRFSLEVLGKNGCLVEGVLHLPGNPNVKLDSQDLLQIGDKEFYFLLPVRSILGGPLGPRHHVSGQTSVVPYHNYQSGPGSGSGKKGVRSRELYEYDDEDDDDDDDEEDDMRGSGKKTRRDGHEVVYASGEKKREGRSKVDREADDQQFLQLEEKDVVSSVATVLSDLCGPGEWMPMEKLHSVILKEYGNVWHHSRVRRYLSQEDWAIPEAKGKPWYGLLMLLRKYPEHFVINTRSKGRVTLEFVSLVTLLS

SEQ ID NO: 32408 - protein, 512 aa, Cunninghamella elegans
MAIVSQISRFITFTIISMGYSVLAVGVALTIHILSQLIVPKNPNEPPNVFSLIPVLGNAVQFGMNPVAFLQECQKKYGDVFTFTMVGKRVTVCLGADGNQFVFNSKQNLSSAAEAYNHMTKYVFGPDVVYDAPHAVFMEQKKFIKAGLNSDCFRQHVPMIVQETEEFFKKFNKPTGFIEAYETFGSLIIYTASRCLMGKEIRASLDGNVAKLYYDLDQGFKPINFIFPNLPLPSYRRRDVACKKMADLYSSIIQRRKDEKDNNNADLLQALMDATYKDGTHIPDHHIAGMMIAVLFGGQHTSATTSAWTILELANRPDIIKALREEQIEKLGSLKADLTFDNLKDLPLLEAAIRETLRLHPPIFQMMRRVVADKIVYEKNGMEIPKGNFICAAPGVTQVDPTYFNEPTTYNPYRWIEKTDPVHQLEQGDDANIDYGFGAVGISSKSPFLPFGAGRHRCIGEQFGYLQLKTVISTFIRTFDFDLDGKSVPKSDYTSMVVVPEHTAKVRYTWRE

SEQ ID NO: 32409 - protein, 398 aa, Daucus carota
MALQAASFLPSSFSINKEGKANVSLKETSLFGVTFSDSLRTDFSSLRTRRGCRQISQTGAIRSQAVATTPSVNRATGEGKKTLRKGSVIITGASSGLGLATAKALAETGKWHVIMACRDFLKAERAAKSAGMPKENYTIMHLDLASLDSVRQFVETFRRSERPLDVLVCNAAVYFPTAKEPTYTADGFELSVGTNHLGHFLLSRLLLDDLNKSDYPSKRLIIVGSITGNTNTLAGNVPPKANLGDLRGLAGGLNGMNSSAMIDGAEFDGAKAYKDSKVCNMLTMQEFHRRYHEETGITFASLYPGCIATTGLFREHIPLFRTLFPPFQKYITKGYVSEAESGKRLAQVVSEPSLTKSGVYWSWNKDSASFENQLSEEASDVEKARKVWEVSEKLVGLA

SEQ ID NO: 32410 - protein, 474 aa, Anabaena azollae
MTTSQEVLKRIQDEKIPLIHLKSIDTVGTWQHLTLYQNQIDESSFTDGVPFDGSSIRGWKAINESDMTMVLDPNTAWIDPFMEVPTLSIVCSIKEPRTGEWYNRCPRVIAQKAVDYLVATGIGDTAFFGPEAEFFIFDSARFAQTANEGYYFLDSVEGAWNSGKEGTADKPNLAYKPRFKEGYFPVSPTDSFQDIRTEMLLTMAKLGVPIEKHHHEVATGGQCELGLRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 32411 - protein, 253 aa, Fragaria x ananassa
MAFTSCLAITLLVSVLNLCIRGTYADYGAGWVGGHATFYGGGDASGTMGGACGYGNLYSQGYGTNTAALSTALFNDGLSCGSCYEMRCDNDPRWCLPGSIIVTATNFCPPNFAQANDNGGWCNPPLQHFDLAEPAFLQIAQYRAGIVPVSFRRVACVKKGGIRFTINGHSYFNLVLITNVAGAGDVHSVSIKGSKGGWQSMSRNWGQNWQSNNYLNGQALSFQVTTSDGRTVTSNNVAPGNWQFGQTFSGGQF

SEQ ID NO: 32412 - protein, 429 aa, Methylobacillus flagellatus
MQEISKSSKLSNVCYDIRGPVLDRARQMEEDGHRIIKLNIGNPAPFGFAAPEEILQDVIRNMDSASGYTDSKGLFAARKAIMHYTQQKNIQGVTIDDIIIGNGVSELIVMAMQALLNNGDQVLVPMPDYPLWTAAVNLAGGTARHYVCDEQTGWLPDLRDIENKITANTRGIVIINPNNPTGALYPRETLEGIIEIARHHGLVIFADEIYDKVLFDGNTHTSIASLADDVLFVTFNGLSKNYRTCGYRAGWLVISGEKRHAGDYIEGLNMLASMRLSRQCARAVGDPDRAGRYQSIDDLVAPTGRLCKQRDLAYKMLTDIPGVSCVKPKAGLYLFPRLDPKIYPIQDDQQFILDLLLEEKVLLVQGTGFNWRAPDHFRVVFLPNVDDLTEAFTRIARFLENYRKQHSTITIVEAKPRKRAQTTSQSASA

SEQ ID NO: 32413 - protein, 185 aa, Synechocystis sp. PCC 6803 [sequence omitted]

SEQ ID NO: 32414 - protein, 486 aa, Pyrococcus horikoshii
MGKFVEKLEKAIKGYTFDDVLLIPQATEVEPKDVDVSTRITPNVKLNIPILSAAMDTVTEWEMAVAMAREGGLGVIHRNMGIEEQVEQVKRVKRAERLIVEDVITIAPDETVDFALFLMEKHGIDGLPVVEDEKVVGIITKKDIAAREGKLVKELMTKEVITVPESIEVEEALKIMIENRIDRLPVVDERGKLVGLITMSDLVARKKYKNAVRDENGELLVAAAVSPFDIKRAIELDKAGVDVIVVDTAHAHNLKAIKSMKEMRQKVDADFIVGNIANPKAVDDLTFADAVKVGIGPGSICTTRIVAGVGVPQITAVAMVADRAQEYGLYVIADGGIRYSGDIVKAIAAGADAVMLGNLLAGTKEAPGKEVIINGRKYKQYRGMGSLGAMMKGGAERYYQGGYMKTRKFVPEGVEGVVPYRGTVSEVLYQLVGGLKAGMGYVGARNIRELKEKGEFVIITHAGIKESHPHDIIITNEAPNYPLEKF

SEQ ID NO: 32415 - protein, 444 aa, Arabidopsis thaliana
MVGSHKASGVLLVLLVVMATTIANGTPVVDKAKNAATAVEDTAKNAATAVGGAAASVGAKVSGAKPGAAVDVKASGAKGDSKTDDSAAFAAAWKEACAAGSTITVPKGEYMVESLEFKGPCKGPVTLELNGNFKAPATVKTTKPHAGWIDFENIADFTLNGNKAIFDGQGSLAWKANDCAKTGKCNSLPINIRFTGLTNSKINSITSTNSKLFHMNILNCKNITLSDIGIDAPPESLNTDGIHIGRSNGVNLIGAKIKTGDDCVSIGDGTENLIVENVECGPGHGISIGSLGRYPNEQPVKGVTVRKCLIKNTDNGVRIKTWPGSPPGIASNILFEDITMDNVSLPVLIDQEYCPYGHCKAGVPSQVKLSDVTIKGIKGTSATKVAVKLMCSKGVPCTNIALSDINLVHNGKEGPAVSACSNIKPILSGKLVPAACTEVAKPGP

SEQ ID NO: 32416 - protein, 484 aa, Synechococcus sp. PCC 7002
MTFSFDSWFRGLSPRLSYPFRRQGRLLLLACMLPLLWQGVAIAQGSLGEIPPAVQVTLDTLWVVFAAMLVFFMNAGFAMLESGFCRAKNTVNILAKNLIVFALSSLAFWAIGFALMFGDGNAVLGWNGFFLTGADNSPLTGSAYSGIFSSLSWAGIPLYTKFFFQLAFAGTAATIVSGAVAERIKFASFVIFSLFLVGFSYGITGHWVWGGGWLATLGFYDFAGSTVVHSVGGWAALMGVILLGPRLEKFAGDRINAIPGHNMSTATLGGLILWLGWFGFNPGSTMAADPDAISHIIVTTNMAAAAGAIAATITSWIQFGKPDLSMIINGVLAGLVGITAACAYVNVPSAIVIGAIAGVIVVFSVLTFEGLRFDDPVGALSVHLVCGIWGTLAVGLFSVGGDIYPWYAADAGPSAGLLFGGGVAQLLSQFIGVVVVGMFTAGFSFAIWLVLELSMGLRVSKEEELEGLDIGEHGMEAYHRFFRE

SEQ ID NO: 32417 - protein, 395 aa, Campylobacter jejuni
MKMDYKEQSHIVPAYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGIKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKNVKVAKVIQKCQENALLLISCGENDLRFLPPLILQKEHIDEMSEKLRKALKSF

SEQ ID NO: 32418 - protein, 372 aa, Oryza sativa (japonica cultivar-group)
MGEAVKGPVVVTGASGFVGSWLVMKLLQAGYTVRATVRDPSNVGKTKPLLELAGSKERLTLWKADLGEEGSFDAAIRGCTGVFHVATPMDFESEDPENEVVKPTVEGMLSIMRACRDAGTVKRIVFTSSAGTVNIEERQRPSYDHDDWSDIDFCRRVKMTGWMYFVSKSLAEKAAMEYAREHGLDLISVIPTLVVGPFISNGMPPSHVTALALLTGNEAHYSILKQVQFVHLDDLCDAEIFLFESPEARGRYVCSSHDATIHGLATMLADMFPEYDVPRSFPGIDADHLQPVHFSSWKLLAHGFRFRYTLEDMFEAAVRTCREKGLLPPLPPPPTTAVAGGDGSAGVAGEKEPILGRGTGTAVGAETEALVK

SEQ ID NO: 32419 - protein, 461 aa, Candida albicans
MAPTSTKNSIKHFDYLVIGGGSGGVASARRAAKYGAKVLLIESNFKKFGGTCVNVGCVPKKVMWYTADLAHKKHDLYAYGLDKEPESIKYGDFDWAKLKHKRDAYVTRLNGIYENNLKREKVDYAYGFAKFINSEGEVEVTLSGDQELPFLDEGKTYKKGEKLVFSADMTLIATGGTAIVPPSVPGAELGTTSDGFFALEKQPKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVGVKINDKQQIVADEYQVTNNPKIFSLGDVVGKVELTPVAIAAVSSIDIVSDCKIMDIHIHQCILTSRAGLWFITREPLKIRGGNLKYIILNLSPMYYAMMMIKKINHLSSTRSFVSDPEEKVIKMGATKKDFDNCVAIHPTSAEELVTMT

SEQ ID NO: 32420 - protein, 338 aa, Zygosaccharomyces rouxii
MTKVFVTGANGFVAQHVVHQLLEKNYTVVGSVRSTEKGDKLAKLLNNPKFSYEIIKDMVNSRDEFDKALQKHSDVEIVLHTASPVFPGGIKDVEKEMIQPAVNGTRNVLLSIKDNLPNVKRFVYTSSLAAVRTEGAGYSADEVVTEDSWNNIALKDATKDEGTAYEASKTYGEKEVWNFFEKTKNVNFDFAIINPVYVFGPQLFEEYVTDKLNFSSEIINSIIKGEKKEIEGYEIDVRDIARAHISAVENPATTRQRLIPAVAPYNQQTILDVLNENFPELKGKIDVGKPGSQNEFIKKYYKLDNSKTKKVLGFEFISQEQTIKDAAAQILSVKNGKK

SEQ ID NO: 32421 - protein, 230 aa, Borrelia turicatae
MIQKLTKIVATISDLRCDPEHIKELYEAGVNVIRLNTAHQSHDDAIRVINNVRKVSNKIALMIDTKGPEVRTANIENPITVKIGDKIIISTSPINESNALQTNYDGFVNEVPNGSTILIDDGELEMTVIEKLTDRLICKVKNDGQIKNKKSINTPGISLKLQSVTEKDKGFIELAAKQNIDFIAHSFVRHAKDIQDVKDILNAAGNPDVKIIAKVENQEGIDNIEEIAKA

SEQ ID NO: 32422 - protein, 509 aa, Vicia faba
MDGSAGPGGGNVNAFLRNYKMGKTLGIGSFGKVKIAEHVLTGHKVAIKILNRRKIKNMEMEEKVRREIKILRLFMHHHIIRLYEVVETPTDIYVVMEYVKSGELFDYIVEKGRLQEDEARSFFQQIISGVEYCHRNMVVHRDLKPENLLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLAYQGVGMRQQFPAERKWALGLQSRAQPREIMVEVLKALQGLNVCWKKIGHYNMKCRWVVGIPGHQGGMVNNSVLNNNFLGNVGIIENEAVPKSSVVKFELQLYKTQEKYLLDLQRVEGPQFLFLDLCAAFLAQLRVL

SEQ ID NO: 32423 - protein, 509 aa, Pisum sativum
MDGSAGPGGGNVNAFLRNYKMGKTLGIGSFGKVKIAEHVLTGHKVAIKILNRRKIKNMEMEEKVRREIQILRLFMHHHIIRLYEVVETPTDIYVVMEYVKSGELFDYIVEKGRLQEDEARSFFQQIISGVEYCHRNMVVHRDLKPENVLLDSKWSVKIADFGLSNIMRDGHFLKTSCGSPNYAAPEVISGKLYAGPEVDVWSCGVILYALLCGTLPFDDENIPNLFKKIKGGIYTLPSHLSPGARDLIPRLLVVDPMKRITIPEIRQHQWFQLRLPRYLAVPPPDTLQQAKKIDEEILQEVVNRGFDRDQLVESLSNRVQNEGTVTYYLLLDNRYRVSTGYLGAEFQETMDPGLNRINSGEVVSPAGGHHFLGYQGVGMRQQFPAERKWALGLQSRAQPREIMVEVLKALQGLNVCWKKIGHYNMKCRWVVGIPGHQGGMVNNSVLNNNFLGNVGIIESEAVPKSSVVKFELQLYKTQEKYLLDLQRVEGPQFLFLDLCAAFLAQLRVL

SEQ ID NO: 32424 - protein, 446 aa, Lycopersicon esculentum
MKKVKRKLGKYEVGRTIGEGTFAKVKFARNTETGENVAIKVLAKSTILKHRMVEQIKREISIMKIVRHPCIVRLHEVLASQTKIYIVQEFVTGGELFDKIVHLGRLSEDEARRYFQELIDAIAHCHSKGVYHRDLKPENLLLDFQGNLKISDFGLSALPQQGVELLYTTCGTPNYVAPEVLGNRGYDGAAADVWSCGIILYVLMAGYLPFDETDLPTLYTKIKAAEFSCPFWFSPGATSLIQKIIDPNPQTRIKIDGIKRDPWFRKNYRAVKAKADEVVNLDDIHAVFDDIEDAFVSEKSEDSESGPLVMNAFEMITLSQGLNLSALFDRRQDYVKRQTRFISRQPAKVVIETIEAAAESLGLKVHTRDYKTRIEGVTANRAGQFAVVLEVFQVAPSLFMVDVRKAAGDTLEYHKFYKTFCTKIDDVIWKPKEGMSNAVLLRTRTR

SEQ ID NO: 32425 - protein, 499 aa, Arabidopsis thaliana
MFKKIMKGGHRKPSKSEANEPSSYGIGLPDNRSGPGSNVVVSHASRGALVNSSPSPVTATPPPPPLGSVEPLPLFRDVPVSERQTLFLRKLQNCCFLFDFTDTIKNARDKEIKRQTLLELVDFIQSGSSKISESCQEEMIKMISVNIFRSLPPASHENTGQEPADPEEEEPYLEPSWPHLQLVYELLLRYVVSTDTDTKVAKRYIDHSFVLKLLDLFDSEDPREREYLKTILHRIYGKFMVHRPFIRKAINNIFYRFIYETERHSGIGELLEILGSIINGFALPMKEEHKLFLIRVLIPLHKPKPIVVYHQQLSYCIVQFVEKDYKLADTVIRGLLKYWPVTNCSKENLFLGELEEVLEATQPVEFQRCMVPLFQQIGRCLTSSHFQVAERALFLWNNEHIVGLIAQNRSVILPIIYPTLEKNIQSHWNQAVHGLTTNIKKMFMEMDPELFEECQRQYEEKQAKSKEVEEQRQYTWKRLAEAAAERDGGGGEEDHMITS

SEQ ID NO: 32426 - protein, 378 aa, Arabidopsis thaliana
MGNLHGIHRSHHGGSNFPGEAPNSPFPPPYTAAPAPAPAPSSPSDHHMTVGPYCHVDSSLRSLAGKAEGFGRAAVGGLNGPICHVTSLADEGPGSLREACKRPEPLWIVFDVSGTINLSSFVNVSSHTTVDGRGQKVKITGKGLRLKECENVIICNLEFEGGVGPDADAIQIKPKSHNIWIDRCSLKNYYDGLIDITRESTDITVSRCHFMNHNKTMLIGADTSHVTDRCIRVTIHHCFFDGTRQRHPRVRFAKVHLFNNYTRHWAIYAVGAGVESQIHSQCNIYEAGEKKTVFKYITEKAADKEKPGAGFVRSEGDLLLNGAKSCLSQGGERYVFSPIQHYSEWTVESPTDILKNYLKHSTGWQNLPLPLDRPPTTA

SEQ ID NO: 32427 - protein, 334 aa, Arabidopsis thaliana
MDAKETSATDLKRPREEDDNGGAATMETENGDQKKEPACFSTVIPGWFSEMSPMWPGEAHSLKVEKVLFQGKSDYQDVIVFQSATYGKVLVLDGVIQLTERDECAYQEMITHLPLCSIPNPKKVLVIGGGDGGVLREVARHASIEQIDMCEIDKMVVDVSKQFFPDVAIGYEDPRVNLVIGDGVAFLKNAAEGSYDAVIVDSSDPIGPAKELFEKPFFQSVARALRPGGVVCTQAESLWLHMDIIEDIVSNCREIFKGSVNYAWTSVPTYPSGVIGFMLCSTEGPDVDFKHPLNPIDESSSKSNGPLKFYNAEIHSAAFCLPSFAKKVIESKAN

SEQ ID NO: 32428 - protein, 215 aa, Brassica oleracea
VSKFTVGDVVGVGVIVGCCGRCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLASLKLDGKLILMGVINTPLQFITPLVILGRKVIS

SEQ ID NO: 32429 - protein, 211 aa, Brassica rapa
VSKFTVGDVVGVGVIVGCCGSCKPCSSDLEQYCNKRIWSYNDVYTDGKPTQGGFADTMIVNQKFVVKIPEGMPVEQAAPLLCAGVTVYSPLSHFGLMSSGLRGGILGLGGVGHMGVKIAKAMGHHVTVISSSERKREEAMDHLGADDYVVSSDQAEMQRIADSLDYIIDTVPVFHPLEPYLACLKLDGKLILMGVINTPLQFITPLVILGR

SEQ ID NO: 32430 - protein, 379 aa, Aubrieta deltoidea
MSTTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKDHEKPVQQVIAEMTDGGVDRSVECTGSVQAMIQAFECVHDGWGVAVLVGVPSKDDAFKSHPMNFLNERTLKGTFFGNYKPKTDIPGVVEKYMNKELDIEKFITHTVPFSEINKAFDYMLKGEGIRCIITMGA

SEQ ID NO: 32431 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 32432 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRHCHSEESNMCDLLRINTERGGMIHDGESRFSIDGKPIYHFVGTSTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIIAMGA

SEQ ID NO: 32433 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESVGEGMTDLAPGDHVLPIFTGECGDCRYCHSEESNMCDLLRINTDRGGMIHDGESRFSIDGKPIYHFVGTFTFSEYTVVHSGQVAKINPEAPLDKVCIVSCGLSTGLGATLNVAKPKKGQSVAIFGLGAVGLAAAEGARMAGAGRIIGVDLNRKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 32434 - protein, 379 aa, Arabis alpina
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCRYCHSEESNMCDLLRINTDRGGMIHDGESRFSIDGKPIYHFLGTSTFSEYTVVHSGQVAKINPEAPLDKVCIVSCGVSTGLGATLNVAKPKKGQSVAIFGLGAVGLAAAEGARMAGAGRIIGVDLNPKRFEEAKKFGVTEFVNPKDHDKPVQQVIAEMTDGGVDRSVECTGSVQAMIQAFECVHDGWGVAVLVGVPSKDDAFKTHPMNLLNERTLKGTFFGNYKPKTDIPGVVEQYMNKELEVEKFITHTVPFSEINKAFDYMLKGEGIRCIITMGA

SEQ ID NO: 32435 - protein, 379 aa, Cardamine amara
MITTGQIIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRKNTDRVGMIHDGVSRFSINGKPIHHFLGTSTFSEYTMVHSGQVAKINPEAPLDKVCIVSCGLSTGLGATLNVAKPKKGQSVAVFGLGAVGLAACEGARMSGASRIIGVDLNPKRFEEAKKFGVTEFVNPREHDKPVQQVIAEMTNGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGESIRCIITMGA

SEQ ID NO: 32436 - protein, 379 aa, Arabis blepharophylla
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSEESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTLKGTFFGNYKPKTDIPGVVEQYMNKELEIEKFITHTVPFSEINKAFDYMLKGEGNRCIIRMGA

SEQ ID NO: 32437 - protein, 379 aa, Arabis blepharophylla
MSTTGQIIRCKAAVAWEAGKPLVMEEVEVAPPQKHEVRIKILFTSLCHTDVYFWEAKGQTPLFPRIFGHEAGGIVESVGEGVTDLAPGDHVLPIFTGECGDCPHCHSVESNMCDLLRINTERGGMIHDGESRFSIDGKPIYHFVGTSTFSEYTVIHSGQVAKINPDAPLDKVCIVSCGLSTGLGATLNVAKPKKGQSVAIFGLGAVGLAAAEGARIAGASRIIGVDLSSKRFDEAKKFGVTEFVNPKDHDKPVQEVIAEMTDGGVDRSVECTGSVQAMIQAFECVHDGWGVAVLVGVPSKDDAFKTHPMNFLNERTLKGTFFGNYKPKTDIPGVVEMYMNKELEIEKFITHTVPFSEINKAFDYMLKGEGIRCIITMGA

SEQ ID NO: 32438 - protein, 379 aa, Brassica oleracea
  misc_feature (86)..(86): Xaa can be any naturally occurring amino acid
MSTTGQIIRCKAAVCWEAGKPLVMEEVEVAPPQKHEVRIKILFTSLCHTDVYFWEAKGQTPLFPRIFGHEAGGIVESVGEGVTDLXPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLNVAKPKKGQSVAIFGLGAVGLAAAEGARIAGAGRIIGVDLNPKRFEEAKKFGVTEFVNPKEHDKPVQEVIAEMTNGGVDRSVECTGSIQAMIQAFECVHDGWGVAVLVGVPSKDDAFKTHPMNLLNERTLKGTFFGNYKPKTDIPGVVEKYMNKELELEKFITHTVPFSEINKAFDYMLKGESIRCIITMGA

SEQ ID NO: 32439 - protein, 379 aa, Capsella rubella
  misc_feature (376)..(376): Xaa can be any naturally occurring amino acid
MITTGLFIRCKAAVSWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNPSRFDQAKKFGVTEFVNPKDHDKPVQQVIAEMTNGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMLKGESIRCIIXMGA

SEQ ID NO: 32440 - protein, 379 aa, Arabis drummondii
MSTTGQIIRCKAAVAWEAGKPLVMAEVEVAPPQKHEVRIKILFTSLCHTDIYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLGATLNVAKPKKGQSVAIFGLGAVGLAAAEGARIAGAFRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSGINKAFDYMLKGESIRCIIPMGA

SEQ ID NO: 32441 - protein, 379 aa, Arabis drummondii
  misc_feature (366)..(366): Xaa can be any naturally occurring amino acid
MITTGQIIRCKAAVAWEAGKPLVMEEVEVAPPQKHEVRIKILFTSLCHTDVYFWEAKGQTPLFPRIFGHEAGGIVESAGEGVTDLQPGDHVLPVFTGECGDCRHCHSEESNMCDLLRINTERGVTIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECAHDGWGVAVLVGVPSKDDAFKSHPMNFLNERTLKGTFFGNYKPKTDIPGIVEMYMNKELELEKFITHTVPFSEINKAFDNMXKGESIRCIITMGA

SEQ ID NO: 32442 - protein, 379 aa, Arabis fendleri
MITTGQIIRCKAAVAWEAGKPLVMEEVEVAPPQKHEVRIKILFTSLCHTDVYFWEAKGQTPRFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 32443 - protein, 379 aa, Arabis glabra
  misc_feature (6)..(6): Xaa can be any naturally occurring amino acid
MITTGXIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVGKPKRGQSVAIFGLGAVGLAAAEGARIAGASRIIGVDLNSKRFDQAKEFGVTEFVNPKDHDKPVQQVLAEMTDGGVDRSVECTGSVQAMIQAFECVHDGWGVAVLVGVPSKDDAFKSHPMNFLNERTLKGTFFGNYKPKTDIPGVVEKYMNKELELEKFITHTVPFSEINKAFDYMMKGESIRCIITMGA

SEQ ID NO: 32444 - protein, 379 aa, Olimarabidopsis pumila
MITTGQIIRCKAAVAWEAGKPLVMEEVEVAPPQKHEVRIKILFTSLCHTDVYFWEVKGQTPLFPRIFGHEAGGIVESVGEGVTDLQPGDHVLPIFTGECGDCRHCHSEESNMCDLLRINTERGGMIHDGESRFSINGKPIHHFLGTSTFSEYTVVHSGQVAKINPDAPLDKVCIVSCGLSTGLEATLNVAKGKKGQSVEIFGLGAVGLAAAEGARIAGASRIIGVDLNSKRFDQAKEFGVTEFVNPRDHDKPVQQGIAEMTDGGVDRSVECTGSVQAMIQAFECVHDGWGVAVLVGVPSKDDAFKTHPMNLLNERTLKGTFFGNYKPKTDIPGVVEKYMNKELELEKFITHTVPFSEINKAFDHMLKEESIRCIITMGA

SEQ ID NO: 32445 - protein, 379 aa, Halimolobos perplexa var. lemhiensis
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGGMIHDGESRFSINGKPIHHFVGTSTFSEYTVVHSGQVAKINPDAPLDKVCIVSCGLSTGLGATLNVAKPKKGQSVAVFGLGAVGLAAAEGARIAGASRIIGIDLNPKRFDEAKKFGVTEFVNPKDHDKPVQQVIAEMTDGGVDRSLECTGNVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 32446 - protein, 379 aa, Arabidopsis halleri
MITTGQSIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 32447 - protein, 379 aa, Arabis hirsuta
MITTGQIIRCKAAVAWEAGKPLVMEEVEVAPPQKHEVRIKILFTSLCHTDVYFWEAKGQTPLFPRIFGHEAGGIVESVGEGVTDLAPGDHVLPVFTGECGDCPHCHSEESNMCDLLRINTERGGMIHDGESRFSIDGKPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTNGGVDRSVECTGSVQAMIQALECVHDGWGVAVLVGVPSKDDAFKTHPMNLLNERTLKGTFFGNYKPKTDIPGVVEKYMNKELELEKFITHTVPFSEINKAFDYILKGESIRCIITMGA

SEQ ID NO: 32448 - protein, 379 aa, Arabis hirsuta
  misc_feature (183)..(183): Xaa can be any naturally occurring amino acid
  misc_feature (372)..(372): Xaa can be any naturally occurring amino acid
MITTGQIIRCKAAVAFEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGKPIYHFVGTSTFSEYTVVHSGQVAKINPDAPLDKVCIVSCGLSTGXGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAYKTHPMNFLNERTLKGTFFGNYKPKTDIPGLVEKYMNKELEIEKFITHTVPFSEINRAFDYMLKGEGIXCKITMGA

SEQ ID NO: 32449 - protein, 379 aa, Arabis hirsuta
  misc_feature (317)..(317): Xaa can be any naturally occurring amino acid
MSTTGQIIRCKAAVAWEAGKPLVMEEVEVAPPQKNEVRIKILFTSLCHTDVYFWEAKGQTPLFPRIFGHEAGGIVESVGEGVTDLAPGDHVLPIFTGECGDCPHCHSEESNMCDLLRINTERGVMINDGESRFSIDGNPIYHFVGTSTFSEYTVVHSGQVAKINPDAPLDKVCIVSCGLSTGLGATLNVAKPKKGQSVAIFGLGAVGLAAAEGARIAGASRIIGVDLNSKRFDEAKKFGVTEFVNPKDHDKPVQQVIAEMTDGGVDRSVECTGSVQAMIQAFECVHDGWGVAVLVGVPSKDDAFKTHPMNFLNERTXKGTFFGNYKPKTDIPGLVEKYMNKELEIEKFITHTVPFSEINKAFDYMLKGEGIRCIITMGA

SEQ ID NO: 32450 - protein, 379 aa, Arabis jacquinii
MITTGQIFRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDCPHCHSEESNMCDLLRINTERGGMIHDGESRFSINGKPIHHFVGTSTFFEYTVVHSGQVAKIIPDAPLDKVCIVSCGLSTGLEATLNVAKPKKGQSVAIFGLGAVGLAAAEGARIAGASRIIGVDLNSKRFDEAKKFGVTEFVDPKDHDKPVQQVIAEMTDGGVDRSVECTGSVQAMIQAFECVHDGWGVAVLVGVPSKGDAFKTHPMNFLNERTLKGTFFGNYKPKTDIPGVVEKYMNKELELEKFITHTVPLSEINKAFDYMMKGESIRCIITMGA

SEQ ID NO: 32451 - protein, 379 aa, Arabis lignifera
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIYHFVGTSTFSEYTVVHSGQVAKINPDAPLDKVCIVSCGLSTGLRATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGSYKPKTDIPGIVEMYMNKELELEKFITHTVPFSEINKAFDYMLKGESIRCIITMGA

SEQ ID NO: 32452 - protein, 379 aa, Arabis lyallii
MSTTGQIIRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 32453 - protein, 379 aa, Arabidopsis lyrata subsp. lyrata
  misc_feature (374)..(374): Xaa can be any naturally occurring amino acid
MITTGQIIRCKAAVAWVAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGGTLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCXIPMGA

SEQ ID NO: 32454 - protein, 379 aa, Arabis parishii
MSTTGQIVRCKAAVAWEAGKPLVMEEVEVAPPQKHEVRIKILFTSLCHTDVYFWEAKGQTPLFPRIFGHEAGGIVESVGEGVTDLQPGDHVLPVFTGECGDCRHCHSEESNMCDLLRINTERGVMIHDGESRFSINGKPIHHFVGTSTFSEYTVVHSGQVAKINPDAPLDKVCIVSCGLSTGLGATLNVAKPKKGQSVAIFGLGAVGLAAAEGARIAGASRVIGVDLNPKRFDEAKKFGVTEFVNPKDHDKPVQQVIAEMTDGGVDRSVECTGSVQAMIQAFECVHDGWGVAVLVGVPSKDDAFKSHPMNFLNERTLKGTFFGNYKPKTDIPGIVEMYMNKELELEKFITHTVPFSEINKAFDYMLKGESIRCIITMGA

SEQ ID NO: 32455 - protein, 379 aa, Arabis pauciflora
MITTGQIIRCKAAVAWEAGKPLVMEEVEVAPPQKHEVRIKILFTSLCHTDVYFWEAKGQTPLFPRIFSHEAGGIVESVGEGVTDLQPGDHVLPIFTGECGDCRHCHSEESNMCDLLRINTERGGMIHDGESRFSINGKPIYHFLGTSTFSEYTVVHSGQVAKINPDAPLDKVCIVSCGLSTGLGATLNVAKPKKGQSVAILGLGAVGLAAAEGARIAGAARIIGVDLNPKRFEEAKKFGVTEFVNPREHDKPVQEVIAEMTDGGVDRSLECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 32456 - protein, 379 aa, Arabidopsis lyrata subsp. petraea
MITTGQIIRCKAAVAWEAGKPLVMEEVEVAPPQKHKVRIKILFTSLCHTDVYFWEAKGQTPLFPRIFGHEAGGIVESVGEGLTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVVKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGESIRCIITMGA

SEQ ID NO: 32457 - protein, 379 aa, Arabidopsis lyrata subsp. petraea
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVIEKYMNKELELEKFITHTLPFSEINKAFDYMLKGESIRCIITLGA

SEQ ID NO: 32458 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGIVESIGEGVTDLAPGDHVLPIFTGECGDWPHCHSEESNMCDLLRINTERGGMIHDGESRFSINGKPIHHFVGTSTFSEYTVIHSGQVAKINPDAPLDKVCIVSCGLSTGLEAPLNVANPKKGQSVAIFGLGAVGLAAVEGARIAGASRIIGVDLNSKRFDEAKKFGVTEFVNPKDHDKLVQQVIAEMTNGGVDRSVECTGSVQAMIQAFECVHDGWGVAVLVGVPSKDDAFKTHPMNFLNERTLKGTFFGNYKPKTDIPGLVEKYMNKELEIEKFITHTVPFSEINKAFDYMMKGEGIRCIITMGA

SEQ ID NO: 32459 - protein, 379 aa, Arabis procurrens
MITTGQIIRCKAAVAWEAGKPLVMEEVEVAPPQKHEVRIKILFTSLCHTDVYFWEAKGQTPLFPRIFGHEAGGVVESVGESVTDLAPGDHVLPIFTGECGDCPHCHSEESNMCDLLRINTERGVMIHDGESRFSIDGKPIYHFVGTSTFSEYTVIHSGQVAKINPDAPLDKVCIVSCGLSTGLGATLNVAKPKKGQSVAIFGLGAAGLAAAEGARIAGASRIIGVDLNSKRFDEAKKFGVTEFVNPRDHDKPVQQVIAEMTDGGVDRSVECTGSVQAMIQAFECVHDGWGVAVLVGVPSKDDAFKTDPMNFLNERTLKGTFFGNYKPKTDIPGLVEKYMNKELEIEKFITHTVPFSEINKAFDYMLKGKGIRCIITMGA

SEQ ID NO: 32460 - protein, 379 aa, Arabidopsis thaliana
MSTTGQIIRCKAAVAWEAGKPLVIEEVEVAPPQKHEVRIKILFTSLCHTDVYFWEAKGQTPLFPRIFGHEAGGIVESVGEGVTDLQPGDHVLPIFTGECGDCRHCKSEESNMCDLLRINTERGGMIHDGESRFSINGKPIYHFLGTSTFSEYTVVHSGQVAKINPDAPLDKVCIVSCGLSTGLGATLNVAKPKKGQSVAIFGLGAVGLGAAEGARIAGASRIIGVDFNSKRFDQAKEFGVTECVNPKDHDKPIQQVIAEMTDGGVDRSVECTGSVQAMIQAFECVHDGWGVAVLVGVPSKDDAFKTHPMNFLNERTLKGTFFGNYKPKTDIPGVVEKYMNKELELEKFITHTVPFSEINKAFDYMLKGESIRCIITMGA

SEQ ID NO: 32461 - protein, 379 aa, Arabis turrita
MITTGQIIRCKAAVAWEAGKPLVMEVVEVAPPQKHEVRIKILFTSLCHTDVYFWEAKGQTPLFPRIFGHEAGGIVESVGEGVTDLQPGDHVLPIFTGECGDCRHCHSEESNMCDLLRINTERGVMIHGGESRFSINGKPIYHFLGTSTFSEYTVVHSGQVAKINPEAPLDKVCIVSCGLSTGLGATLNVAKPKKGHSVAIFGLGAVGLAAAEGARISGASRIIGVDLNPKRFEEAKKFGVTEFVNPRDHDKPVQQVIAEMTDGGVDRSVECTGSVQAMIQAFECVHDGWGVAVLVGVPSKDDAFKTHPMNFLNERTLKGTFFGNYKPKTDIPGVVEKYMNKELEIEKFITHTVPFSEINKAFDYMLKGEGIRCIITMGA

SEQ ID NO: 32462 - protein, 379 aa, Barbarea vulgaris
MITTGQIIRCKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPEAPLDKVCIVSCGLSTGLGATLTVAKPKKGQSVAVFGLGAVGLGAAEGAKMAGASRIIGVDLNPKRFEEAKKFGVTEFVNPREHDKPVQQVIADMTNGGVDRSVECTGSVQAMIQAFECVHDGWGVAVLVGVPSKDDAFKTHPMNFLNERTLKGTFFGNYKPKTDIPGVVEMYMNKELELEKFITHTVPFSEINKAFDYMLKGESIRCIITMGA

SEQ ID NO: 32463 - protein, 421 aa, Halomonas elongata
MQTQILERMESDVRTYSRSFPVVFTKARNARLTDEEGREYIDFLAGAGTLNYGHNNPHLKQALLDYIDSDGIVHGLDFWTAAKRDYLETLEEVILKPRGLDYKVHLPGPTGTNAVEAAIRLARVAKGRHNIVSFTNGFHGVTMGALATTGNRKFREATGGVPTQAASFMPFDGYLGSSTDTLDYFEKLLGDKSGGLDVPAAVIVETVQGEGGINVAGLEWLKRLESICRANDILLIIDDIQAGCGRTGKFFSFEHAGITPDIVTNSKSLSGYGLPFAHVLMRPELDKWKPGQYNGTFRGFNLAFATAAAAMRKYWSDDTFERDVQRKARIVEERFGKIAAWLSENGIEASERGRGLMRGIDVGSGDIADKITHQAFENGLIIETSGQDGEVVKCLCPLTIPDEDLVEGLDILETSTKQAFS

SEQ ID NO: 32464 - protein, 474 aa, Arabidopsis thaliana
MVEVYELLTVMVSLIVVKLFHWIYQSKNPKPNEKLPPGSMGFPIIGETFEFMKPHDAFQFPTFIKERIIRYGPIFRTSLFGAKVIISTDIELNMEIAKTNHAPGLTKSIAQLFGENNLFFQSKESHKHVRNLTFQLLGSQGLKLSVMQDIDLLTRTHMEEGARRGCLDVKEISSKILIECLAKKVTGDMEPEAAKELALCWRCFPSGWFRFPLNLPGTGVYKMMKARKRMLHLLKETILKKRASGEELGEFFKIIFEGAETMSVDNAIEYIYTLFLLANETTPRILAATIKLISDNPKVMKELHREHEGIVRGKTEKETSITWEEYKSMTFTQMVINESLRITSTAPTVFRIFDHEFQVGSYKIPAGWIFMGYPNNHFNPKTYDDPLVFNPWRWEGKDLGAIVSRTYIPFGAGSRQCVGAEFAKLQMAIFIHHLSRDSQSFYLHVIYLIYGLKVVNEDRNHNTSKLCTHVSKWM

SEQ ID NO: 32465 - protein, 443 aa, Arabidopsis thaliana
MANDGNGDNNDDPLRQYLMNPRINPPPPSLLTLPENNDVTIPMPITPLELKNRLIFGSFVRSRKESSLPIDALSQNPSTSSSATTSFSDSTDLLLPLTEPNKPVRKSKPTINFHRSKTAPAMAAINNISHPNDPKTDQQSDSKTIVNQAVALLVVYLSLGVLIYWLNRDSYNVKQTHPVVDALYFCIVTMCTIGYGDITPDSVVTKLFSIFFVLVGFGFMDILLSGMVTYVLDLQENYMLETARNESLNLNDRDKVRSYIIDVKKGRMRIRLKVGLALGVVVLCLGFGVLIMHFVEKIGWLDSFYFSVMSVTTVGYGDRAFNTLAGRLLAAMWLLVSTLAVARAILFLAESRVDKRNRERAKKVLGESMSISQFLDADIDCNGCVSKAEFVIHKLKKMDKITEKDINPIGFQFDKLDRTNSGRITLLDLLESSTKDLPTATSI

SEQ ID NO: 32466 - protein, 406 aa, Aspergillus tubingensis
MALYRNLYLLASLGLSSAAPSKVQRAPDSSIHARAVCTPTAGGDSSTDDVPAITEALSSCGNGGTIVFPEGSTYYLNSVLDLGSCSDCDIQVEGLLKFASDTDYWSGRTAMISVSNVDGLKLRSLTGSGVIDGNGQDAWDLFASDSSYSRPTLLYITGGSNLEISGLRQKNPPNVFNSVKGGATNVVFSNLKMDANSKSDNPPKNTDGFDIGESTYVTITEVTVVNDDDCVAFKPSSNYVTVDTISCTGSHGISVGSLGKSSDDSVKNIYVTGATMINSTKAAGIKTYPSGGDHGTSTVSNVTFNDFTVDNSDYAFQIQSCYGEDDDYCEENPGNAKLTDIVVSSFSGTTSDKYDPVVANLDCGADGTCGISISGFDVKAPSGKSEVLCANTPSDLGVTCTSGASG

SEQ ID NO: 32467 - protein, 466 aa, Fagonia cretica
SVGFKAGVKDYKLTYYTPEYETKDTDILAAFRVSPQPGVPPEEAGAAVAAESSTGTWTAVWTDGLTSLDRYKGRCYNLEAVPGEDNQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAACARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNIIIREASKWSPELAAACEIWKEIKFEFPAMDTL

SEQ ID NO: 32468 - protein, 466 aa, Fagonia luntii
SVGFKAGVKDYKLNYYTPEYETKDTDILAAFRVSPQPGVPPEEAGAAVAAESSTGTWTAVWTDGLTSLDRYKGRCYNLEAVPGEDNQYIAYVAYPLDLFEEGSVTNMLTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCTEAIFKAQAETGEIKGHYLNATAGTCEEMMKRAACARELGVPIIMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNIIIREASKWSPELAAACEVWKEIKFEFPAMDTL

SEQ ID NO: 32469 - protein, 218 aa, Lycopersicon esculentum
MAGYRGDDEYDYLFKLVLIGDSGVGKSNLLSRFTKNEFNLESKSTIGVEFATKSLNIDGKVIKAQIWDTAGQERYRAITIAYYRGAVGALLVYDVTRHVTFENVNRWLKELRDHTDPNIVVMLLGNKSDLRHLVAVSTEEAKSLAEREALYFMETSALEATNVENAFTEALTQIYRIVSKKAVEAGDEGATSTAPPKGQTINIKDEGSAWKKFGCCSS

SEQ ID NO: 32470 - protein, 170 aa, Lycopersicon esculentum var. cerasiforme
DASGTMGGACGYGNLYSQGYGVNNGALSTALFNNGLSCGACFEIKCDNYPQWCHPGSPSIFITATNFCPPNFALPNDNGGWCNPPRPHFDLAMPMFLHIAEYRAGIVPVVYRRVPCRKQGGIRFTINGFRYFNLVLVTNVAGAGDIVSLSIKGSKTNWISMSRNWGQNWQ

SEQ ID NO: 32471 - protein, 497 aa, Legionella pneumophila
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDIDTHVQFTDFKNNIPVLMALIGIWNNNFLNIHYDLIGYNFKEYFVPYVQQLDMESNGKSIDVNGRMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFEQSVIWNINPFDQPGIESAKSAHREITLSSES

SEQ ID NO: 32472 - protein, 484 aa, Nicotiana tabacum
MVFISGNVQKQQLLSKIATNDGHGENSAYFDGWKAYENDPFHLSNNPNGVIQMGLAENQLCFDLIQEWVVNNPKASICTTEGAEDFKDIAIFQDYHGLPEFRQAVARFMEKVRGDRVTFDPNRIVMSGGATGAHETLAFCLANPGDAFLVPTPYYPGFDRDLRWRTGVQLFPVVCDSSNDFKVTKKALEAAYEKAQESNINIKGLLINNPSNPLGTLLDSDTLRDIVTFINSKNIHLICDEIYAATVFDQPKFFSVSEIVEEHVGCNKDLIHIVYSLSKDLGFPGFRVGIVYSYNDTVVNIARKMSSFGLVSTQTQHLIASMLSDEIFIEKFIAESSERLGKRHGMFTKGLAQVGISTLKSNAGLFFWMDLRRLLKEPTLESELELWRIIINEVKLNVSPGCSFHCSEPGWFRVCFANMDDETMRTALRRIRNFVLQTKGLNNKAAVKKQCSRSKLQISLSFRRMDDFMNSPVHSPMNSPLVRT

SEQ ID NO: 32473 - protein, 354 aa, Streptomyces coelicolor A3(2)
MTGARPAPEEHDDTPVRGPVEGAAGPAAGHWWPPRGPVVCVGETMAAMAPAPPDSLDDTESLRLSVAGAESNVAVYLADLGLPVSWLSALGDDAFGRRVRAAVARAGVDVSGVRTDPARPTGLLLKEPGAAGTRVHYYRRGSAASALGPDVLDDERFGGAALLHLTGVTPALSPSCRALVERALRTPPARRTHAVSFDVNHRPALWPPDTAAAVLRDLADRADIAFVGLDEAQDLWGGGLTATDVRRLLSGPRVLVVKDGGRSATAFTGQGACTVPALATEVVEPVGAGDAFAAGFLAGLWRGTDLTRALRLGHITAASALKVVGDHGPLPDEDTVGAMLSLTEQDWCRAPVVS

SEQ ID NO: 32474 - protein, 261 aa, Streptomyces coelicolor A3(2)
MPTDTLPNPEKSPERSSGELIRLEQVTKRFGDNTVLDHLDFSVDAGKHVTLIGPSGSGKTTILRLLMTLLKPDEGTITVDGQKLFPATEKERREVRKQIGMVFQQFNLFPNMSVLRNITEAPVTVLGMPKDEAVERAKGLLDMVGLADKCDARPAQLSGGQQQRVAIARALAMRPKVLLLDEVTSALDPELVAGVLDLLRDIARSTDITMLCVTHEMNFARDISDQVLMFDSGRVIEAGAPEKIFSEPEHDRTREFLSAVL

SEQ ID NO: 32475 - protein, 511 aa, Schizosaccharomyces pombe
MLNSVIKRSALCRFKFTCLQVSECRPAQIEISKRLYSAKASGNGEYDLCVIGGGPGGYVAAIRGAQLGLKTICVEKRGTLGGTCLNVGCIPSKALLNNSHIYHTVKHDTKRRGIDVSGVSVNLSQMMKAKDDSVKSLTSGIEYLFKKNKVEYAKGTGSFIDPQTLSVKGIDGAADQTIKAKNFIIATGSEVKPFPGVTIDEKKIVSSTGALSLSEVPKKMTVLGGGIIGLEMGSVWSRLGAEVTVVEFLPAVGGPMDADISKALSRIISKQGIKFKTSTKLLSAKVNGDSVEVEIENMKNNKRETYQTDVLLVAIGRVPYTEGLGLDKLGISMDKSNRVIMDSEYRTNIPHIRVIGDATLGPMLAHKAEDEGIAAVEYIAKGQGHVNYNCIPAVMYTHPEVAWVGITEQKAKESGIKYRIGTFPFSANSRAKTNMDADGLVKVIVDAETDRLLGVHMIGPMAGELIGEATLALEYGASAEDVARVCHAHPTLSEATKEAMMAAWCGKSIHF

SEQ ID NO: 32476 - protein, 498 aa, Schizosaccharomyces pombe
MSTSSKLSTNIKDLSLFDLEEFPARSYIGGKWVTAASGKTFDVENPGLNETLAPVTDMSVEETRKAIKVAHEAFLSYRNSDIKERYAILRRWYDLIMENADDLATMMTLENGKALGDAKGEVVYAAKFIDWFAGEALRISGDSSMSSNPQNRIITIKQPVGVVGIITPWNFPAAMITRKVGAALAAGCTVVIRPAAETPFTALALAKLAERAGVPAGVLNMVTANSPSEHGIELTTNPLIRKVSFTGSTNVGKILAKQSSSTLKKLSLELGGNAPFIVFEDADLEKAADALMACKFRGSGQTCVCANRIYVHSSVYDAFVDLVTERVSKFKLGYGLDAGVTHGPLISEKAISKVKQHVEDAVQKGGVVVTGGKVASNLGPMYFEPTVIINAKQGMLISEEETFGPVGALFKFDTEDEVVAWANDSPVGLAGYLFSKDISRVFRVGEALQVGMVGCNTGLVSDVLSPFGGVKESGFGREGSKYGISEYLDIKSLTISTL

SEQ ID NO: 32477 - protein, 435 aa, Thermus thermophilus
MIHDPAQLEKERPDRLRVLWLSTLAFTLMFAAWLMFGVLGVPIRKEFGLSDVQLSWISALAILNGSLWRLLAGILADRYGGRLVFTLMLFFTAIPAYLVSRAGSYEELLLYAFLVGFAGNSFSVGIAWNSAWFPKDQQGFALGVFGAGNVGASVTKFIGPALIASVPASGYLGGLIPGGWRFIPFLYAVLLVLMGFVLWFGTPRKDKRPGQGRPFLDMLKPLRYVRVWRFSLYYVVVFGAYVALSAWLPKYYVDVFGLPLHEAALLTALFIFPASLLRPVGGYLSDRFGARRIMYWTFGIILLASGVLMMPEGHIVLYTKQGAKEVMQFTMGVELFTLLVFLIGVGMGIGKAAVYKHIPTYFPQDVGAVGGLVGMLGALGGFFLPPLFAYAQAWTGLPQMTFFVLFLLAAISFLWMHLTVLKLLQQEAQHLKKRL

SEQ ID NO: 32478 - protein, 268 aa, Vibrio metschnikovii
MDRYQHLFQRLAAHNQGAFVPFVTIGDPNPQQSLRIMQTLVEAGADALELGIPFSDPLADGPTIQGAISALDSGTKPIRCFEADQAPIRAQDIPIYLLMYANLVYARGIDNFYQRCQQAGVDSVLIADVPTNESAEFGPAAKKYAIHPIFIAPPTASDETLQSVAELGSGYTYLLSRSGVTGAETKANMPVHALLERLNQFSAPPRRLGFGISEPEQVKQAIESGAAGAISGSAVVKIIEHHLAKPEAMLAELKTFVSAMKSATKHDK

SEQ ID NO: 32479 - protein, 466 aa, Zygophyllum album
SVGFKAGVKDYKLTYYTPDYETKDTDILAAFRVTPQPGVPPEEAGAAVAAESSTGTWTTVWTDGLTSLDRYKGRCYNLEAVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAACARELGVPIVMHDYLTGGFTANTTLAHYCRDNGLLLHIHRAMHAVIDRQKNHGIHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNTIIREAAKWSPELAAACEVWKEIKFEFPAMDTL

SEQ ID NO: 32480 - protein, 466 aa, Zygophyllum coccineum
SVGFKAGVKDYKLTYYTPDYETKDTDILAAFRVTPQPGVPPEEAGAAVAAESSTGTWTTVWTDGLTSLDRYKGRCYNLEAVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAACARELGVPIVMHDYLTGGFTANTTLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAACEVWKEIKFEFPAMDTL

SEQ ID NO: 32481 - protein, 466 aa, Zygophyllum cylindrifolium
  misc_feature (1)..(1): Xaa can be any naturally occurring amino acid
XVGFKAGVKDYKLTYYTPDYETKDTDILAAFRVTPQPGVPPEEAGAAVAAESSTGTWTTVWTDGLTSLDRYKGRCYNLEAVPGEENQYIAYVAYPLDLFEEGSVTNMFTSIVGNVFGFKALRALRLEDLRIPTSYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAACARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNTIIREAAKWSPELAAACEVWKEIKFEFPAMDTL

SEQ ID NO: 32482 - protein, 466 aa, Zygophyllum decumbens
SVGFKAGVKDYKLTYYTPEYETKDTDILAAFRVTPQPGVPPEEAGAAVAAESSTGTWTTVWADGLTSLDRYKGRCYNLEAVPGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAACARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLATEGNTIIREACKWSPELAAACEVWKEIKFEFPAMDTL

SEQ ID NO: 32483 - protein, 466 aa, Zygophyllum fruticulosum
SVGFKAGVKDYKLTYYTPDYETKDTDILAAFRVSPQPGVPPEEAGAAVAAESSTGTWTTVWTDGLTNLDRYKGRCYNLEAVPGEDNQYIAYVAYPLDLFEEGSVTNMFTSIVGNVFGFKALRALRLEYLRIPTAYTKTFQGPPHGIQVERDKLNKYGRPLLGCTIKPKLGLSAKNYGRAVYECLRGGLDFTKDDENVNSQPFMRWRDRFLFCAEAIFESQTETGEIKGHYLNATAGTCEEMMKRAACARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAACEVWKEIKFEFPAMDTI

SEQ ID NO: 32484 - protein, 466 aa, Zygophyllum glaucum
SVGFKAGVKDYKLTYYTPDYETKDTDILAAFRVSPQPGVPPEEAGAAVAAESSTGTWTTVWTDGLTNLDRYKGRCYNLEAVPGEDNQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIFKAQTETGEIKGHYLNATAGTCEEMMKRAACARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAACEVWKEIKFEFPAMDTI

SEQ ID NO: 32485 - protein, 467 aa, Zygophyllum hildebrandtii
SVGFKAGVKDYKLTYYTPEYETKDTDILAAFRVTPQPGVPPEEAGAAVAAESSTGTWTTVWTDGLTSLDRYKGRCYNLEAVPGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCTEAIFKAQAETGEIKGHYLNATAGTCEEMMKRAACARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNTIIREATKWSPELAAACEVWKEIKFEFPAMDTLD

SEQ ID NO: 32486 - protein, 464 aa, Zygophyllum hirticaule
GFKAGVKDYKLTYYTPDYETKDTDILAAFRVSPQPGVPPEEAGAAVAAESSTGTWTTVWTDGLTNLDRYKGRCYNLEAVPGEDNQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIFKAQTETGEIKGHYLNATAGTCEEMMKRAACARELGVPIVMHDYLTGGFTANTTLAHYCRDNGLLLHIHRAMHAVIDRQKNHGIHFRVLAKALRMSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNTIIREACKWSPELAAACEVWKEIKFEFPAMDTI

SEQ ID NO: 32487 - protein, 342 aa, Arabidopsis thaliana
MDQTLTHTGSKKACVIGGTGNLASILIKHLLQSGYKVNTTVRDPENEKKIAHLRQLQELGDLKIFKADLTDEDSFESSFSGCEYIFHVATPINFKSEDPEKDMIKPAIQGVINVLKSCLKSKSVKRVIYTSSAAAVSINNLSGTGLVMNEENWTDIDFLTEEKPFNWGYPISKVLAEKKAWEFAEENKINLVTVIPALIAGNSLLSDPPSSLSLSMSFITGKEMHVTGLKEMQKLSGSISFVHVDDLARAHLFLAEKETASGRYICCAYNTSVPEIADFLIQRYPKYNVLSEFEEGLSIPKLTLSSQKLINEGFRFEYGINEMYDQMIEYFESKGLIKAKES

SEQ ID NO: 32488 - protein, 473 aa, Agastache foeniculum
MSPQTETKASVGFKAGVKEYKLTYYTPEYETKDTDILAAFRVTPQPGVPPEEAGAAVAAESSTGTWTTVWTDGLTSLDRYKGRCYHIEPVPGEKDQYICYVAYPLDLFEEGSVTNMFTSIVGNVFGFKALRALRLEDLRVPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAAEGNAIIREACKWSPELAAACEVWKEIKFEFPAMD

SEQ ID NO: 32489 - protein, 473 aa, Agastache mexicana
MSPQTETKASVGFKAGVKEYKLTYYTPEYETKDTDILAAFRVTPQPGVPPEEAGAAVAAESSTGTWTTVWTDGLTSLDRYKGRCYHIEPVPGEKDQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFYAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAAEGNAIIREACKWSPELAAACEVWKEIKFEFPAMD

SEQ ID NO: 32490 - protein, 387 aa, Debaryomyces hansenii
MVSDGEFTRTQIFGTVFEITNRYTDLNPVGMGAFGLVCSAIDKLTGQNVAVKKIMKPFLTSVLAKRTYRELKLLKHLRHENLITLDDIFLSPLEDIYFVTELQGTDLHRLLTSRPLEKQFIQYFTYQILRGLKYVHSAGVIHRDLKPSNILINENCDLKICDFGLARIQDPQMTGYVSTRYYRAPEIMLTWQKYDTEVDLWSVGCILSEMIEGKPLFPGKDHVHQFSIITELLGSPPPDVIETICSENTLRFVQSLPHRDPIPFSERFAQCTHVEPEAIDLLAKMLIFDPKKRISALDALSHPYMEPYHDPTDEPVCEVKFDWSFNDADLPVDTWRVMMYSEILDFHQIIGAGANGTTQEQMAQIQQEGIQAPSSQYQQTNQEQKVE

SEQ ID NO: 32491 - protein, 169 aa, Oryza sativa (japonica cultivar-group)
MPRSRINGNFIDKTFSIVANILLRIIPTTSGEKRAFTYYRDGMLAQSEGNYAEALQNYYEATRLESDPYDRSYILYNIGLIHTSNGEHTKALEYYFRALERNPFLPQAFNNMAVICHYGEQAILQGDSEIAEAWFDQAAEYWKQAIGLTPGNYIEAQNWLKITKRFEFE

SEQ ID NO: 32492 - protein, 256 aa, Vibrio alginolyticus
MNDVPALDIKDLHKTFGQNEVLKGISLAAHKGDVISIIGSSGSGKSTFLRCINLLETPTAGEIWVNGELIQMKNNRAGESVPANEKQVQRIRSRLAMVFQGFNLWSHLTVLENVIEAPVHVLGVPKAQAIENAEVLLKKVGLYERKDYYPGHLSGGQQQRAAIARALAVDPEVMLFDEPTSALDPELVGEVLGVMRDLADEGRTMLVVTHEMAFARDVSNHVMFLHQGLVEEQGNPAKLFTNPDSERLQQFISSIY

SEQ ID NO: 32493 - protein, 470 aa, Moritella marina
MKKTKIVCTIGPKTESVEKLTELVNAGMNVMRLNFSHGNFAEHSVRIQNIRQVSENLNKKIAVLLDTKGPEIRTIKLENGDDVMLTAGQSFTFTTDINVVGNKDCVAVTYAGFAKDLNPGAIILVDDGLIEMEVVATTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMISNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKAAQQLCLTKGVSSCIVEQIDSTDEFYRKGKELALATGLAKEGDIVVMVSGALVPSGTTNTASVHQL

SEQ ID NO: 32494 - protein, 506 aa, Corynebacterium ammoniagenes
MTENRVSTGGDDPNKVALHGLTFDDVLLLPAESNVVPSEVDTSAQFTRNTRLGIPLASAAMDTVTEARMAIAMARQGGIGVLHRNLSSQEQAEQVEIVKRSESGMVTDPVTANPDMTIQEVDDLCARFRISGLPVVNEDGTLLGICTNRDMRFERDYSRKVSDIMTAMPLVVAKEGVSKEEALDLLSTNKVEKLPIVDKNNKLVGLITVKDFVKTEQFPNSSKDASGRLLVAAGIGTGEESYERAGLLVDAGVDVLIVDSAHAHNNRVLEMVSRVKNDFGSKIDVVGGNLATRSAAKAMIEAGADAIKVGIGPGSICTTRVVAGVGAPQITAIMEAATVASAAGVPLIADGGMQYSGDVAKALAAGADSVMLGSMFAGTLEAPGDIVIVGGKQYKRYRGMGSMGAMQGRGLSGEKRSYSKDRYFQADVRSEDKLVPEGVEGKVPYRGEIGQITHQIVGGLRAAMGYTGSATIEELKTKQFVRITTAGLAESHPHHLQQTVEAPNYR

SEQ ID NO: 32495 - protein, 509 aa, Bacillus cereus
MWESKFVKEGLTFDDVLLVPAKSDVLPREVSVKTVLSESLQLNIPLISAGMDTVTEADMAIAMARQGGLGIIHKNMSIEQQAEQVDKVKRSESGVISDPFFLTPEHQVYDAEHLMGKYRISGVPVVNNLDERKLVGIITNRDMRFIQDYSIKISDVMTKEQLITAPVGTTLDEAEKILQKYKIEKLPLVDNNGVLQGLITIKDIEKVIEFPNSAKDKQGRLLVGAAVGVTADAMTRIDALVKASVDAIVLDTAHGHSQGVIDKVKEVRAKYPSLNIIAGNVATAEATGALIEAGANVVKVGIGPGSICTTRVVAGVGVPQLTAVYDCATEARKHGIPVIADGGIKYSGDMVKALAAGAHVVMLGSMFAGVAESPGETEIYQGRQFKVYRGMGSVGAMEKGSKDRYFQEGNKKLVPEGIEGRVPYKGPLADTVHQLVGGLRAGMGYCGAQDLEFLRENAQFVRMSGAGLLESHPHHVQITKEAPTTHYNVLYINRRRFYISVYFFLIMLE

SEQ ID NO: 32496 - protein, 343 aa, Acinetobacter calcoaceticus
LVVRLNDGGERVVAFDRCLVATGASPAVPPIPGLKESPYWTSTEALVSDTLPERLAVIGSSVVALELAQAFARLGSQVTILARNTLFFRDDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKPAAQTFNKDVKQLSCCAG

SEQ ID NO: 32497 - protein, 220 aa, Acinetobacter lwoffii
ASDTIPDRLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTR

SEQ ID NO: 32498 - protein, 329 aa, Acinetobacter lwoffii
FDRCLVATGASPAVPPIPGLKESPYWTSTEALVSDTLPERLAVIGSSVVALELAQAFARLGSQVTILARNTLFFRDDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 32499 - protein, 331 aa, Acinetobacter lwoffii
VMFDRCLVATGASPAVPPIPGLKESPYWTSTEALASDTIPERLAVIGSSVVALELAQAFARLGSKVTVLARNTLFFREDPAIGEAVTAAFRAEGIEVLEHTQASQVAHMDGEFVLTTTHGELRADKLLVATGRTPNTRSLALDAAGVTVNAQGAIVIDQGMRTSNPNIYAAGDCTDQPQFVYVAAAAGTRAAINMTGGDAALDLTAMPAVVFTDPQVATVGYSEAEAHHDGIETDSRTLTLDNVPRALANFDTRGFIKLVIEEGSHRLIGVQAVAPEAGELIQTAALAIRNRMTVQELADQLFPYLTMVEGLKLAAQTFNKDVKQLSCCAG

SEQ ID NO: 32500 - protein, 406 aa, Medicago sativa
MASNGNGSVATENGSNGLPKITTQKSVNGICHDDSGPTVNAKTIDELHSLQKKRSAPSTPNTGTSTPFATLSDLELQKLQLQSISASLASLTRESGPKVVKGDPAKSQNLDHNLHHHHVPAPTIAVSDSALKFTHVLYNLSPAELYEQAIKYEKGSFITYNGAMATLSGAKTGRSPRDKRVVKDKVTENELWWGKGSPNIEMDEETFMVNRERAVDYLNSLDKVFVNDQFLNWDPENRIKVRIVSARAYHSLFMHNMCIRPSPEELENFGTPDFTIYNAGKFPCNRFTHYMTSSTSIDLNHARREMVILNTQYAGEMKKGLFSVMHYLMPKRQILSLHSGSNMGKRGGVALFFGLSGTGKTTLSTDHNRYLIGDDEHCWSENGVSHIEGGRHAKCIALSPEKEPEI

SEQ ID NO: 32501 - protein, 500 aa, Streptococcus thermophilus
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGPYPVESVRTMATIHKNAQTLLKEYGRLNSSTFDRSSNTEVVASAVKDATNSMHIQLIVALTESGNTASLIDTYRPEADIWAITFDELTQKSLMLNWGVIPVVTETPSSTDDMFEVAERVALESGLVESGDNIVIVAGVPVGSGNTNTMRIRTVK

SEQ ID NO: 32502 - protein, 357 aa, Arabidopsis thaliana
MYVMHVAAVVWGPKVPLVIQEICVDPPQKMEVRVKILYSSICHTDLGCWNGTSVGEGVKDVKEGDYVIPTFNGECGECKVCKREESNLCERYHVDPMKRVMVNDGGTRFSTTINKDGGSSQSQPIYHFLNTSTFTEYTVLDSACVVKIDPNSPLKQMSLLSCGVSTGVGAAWNIANVKEGKSTAVFGLGSVGLAVAEGARARGASRIIGVDANASKFEKGTVPIYDYVHIITILLQSNIAGKLMGVTDFINPKDLTKPVHQGWGSTVLVGIYPTPRTLPLHPMELFDGRRITGSVFGGFKPKSQLPNFAQQCMKGVVKLEPFITNELPFEKINDAFQLLRDGKSLRCILQISKLLKR

SEQ ID NO: 32503 - protein, 472 aa, Arabidopsis thaliana
MDLLSSLPDEVRCLILSFLTTKESASTSVLSKKWRNLFALVPNLDFDDSEFLHPEEGKRERDGILQSFMDFVDRVLSLQGNSSIRKFSLKCETGVPPARVNRWLCEVLQRDVSDIDLTIDLGYGYYLPEELFVSETLVNLKLKSAFNIDWWPGAEGTSLPMLKSLCVYGVRVFCDDELQELLPCFPVLEELQMSNMQWLDSDETVSSATLTTLHITGIRSENPKSISFDTPNLLSFVYTDFVAEDYPLVNMKNLSLARLALRANDDQIKRVRGPSNDLLEYDVVRHFGNVVKLMNGIQNVQELHLCPDTLELLSVCCESMPVFNNVKKLLIYSDEDRGWQAVPVLLRNCPRLETLIFEGIVHHVTDKCGDACDCIFRKDKGRSLKSCPVKVVEINGFGVTMKEKYLIEHFLDYFSCLKEMKIYINCEEDGVTQQVMKNREVSKLVLDEMEEYNEFYSCNVKLFLCKKKSIPQ

SEQ ID NO: 32504 - protein, 181 aa, Arabidopsis thaliana
MDSDSWSDRLASATRRYQLAFPSRSDTFLGFEEIDGEEEFREEFACPFCSDYFDIVSLCCHIDEDHPMEAKNGVCPVCAVRVGVDMSLFGGSSCIVSSSSSSNVAADPLLSSFISPIADGFFTTESCISAETGPVKKTTIQCLPEQNAKKTSLSAEDHKQKLKRSEFVRELLSSTILDDSL

SEQ ID NO: 32505 - protein, 393 aa, Salix gilgiana
MGLKVVSSAIISFSLLLLLTSTAKAQSNGVFDVTKYGGKEDITEALNNAWKDACASTNPSKVHIPSGTYSLRQVTLAGPCKAAIELQVDGILKAPVDPNQFSGGHWVDFSHVDQLTLSGSGTFDGQGSVAWSKSTCSKDKNCEGFPMNIRFDFITNGFVRDITTRDSKNFHVNVLECKNLTFQHFTVTAPAESINTDGIHIGRSTGIYIIDSKIGTGDDCISVGDGTEDLHVTGVTCGPGHGISVGSLGRYPNEKPVSGIFVKNCTISNTANGVRIKSWPDLYGGDASNMHFEDIVMNNVQNPVAVDQEYCPWNQCSLKAPSKVKISDVSFKNIRGTSATPVVVKLACSSGIPCEKVELADINLVYSGSEGPAKSQCSNVKPIISGIMSASGC

SEQ ID NO: 32506 - protein, 453 aa, Streptomyces coelicolor A3(2)
MDKQQEFVIRTLEERDIRFVRLWFTDVLGFLKSVAVAPAELEQAFDEGIGFDGSAIEGFARVYESDMIAKPDPSTFQVLPWRAEAPGTARMFCDILMPDGSPSFADPRYVLKRALARTSDLGFTFYTHPEIEFFLLKDKPVDGSVPTPADNSGYFDHTPQNIGMDFRRQAITMLESMGISVEFSHHEGAPGQQEIDLRYADALSTADNVMTFRLVMKQVALEQGLQATFMPKPFSEYPGSGMHTHLSLFEGDRNAFYESGAEYQLSKVGRSFIAGLLRHAAEISAVTNQWVNSYKRIWGGTERTAGAGGEAPSYICWGHNNRSALVRVPMYKPGKTGSARVEVRSIDSGANPYLTYAVLLAAGLKGIEEGYELPPGAEDDVWALSDAERRALGIEPLPQNLGEALALMERSDLVAETLGEHVFDFFLRNKRQEWEEYRSQVTAFELRKSLPVL

SEQ ID NO: 32507 - protein, 378 aa, Streptomyces coelicolor A3(2)
MATDYYAVLGVRRDASQDEIKKAFRRLARELHPDVNPDPKTQERFKEINAAYEVLSDPQKKQVYDLGGDPLSQAAGGGAGGFGAGGFGNFSDIMDAFFGTASQRGPRSRTRRGQDAMIRIEVELDEAAFGTTKDIQVDTAVVCNTCNGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHSTFQRRGDDLHCTVTIPMTAAALGTKVPLETLDGMEEVDIRPGTQSGQSIPKHGRGVTHLRGGGRGDLIVHVEVTTPGKLDPEQERLLRELAKLRGEERPTGQFQPGQQGLFSRLKDAFNGR

SEQ ID NO: 32508 - protein, 297 aa, Streptomyces coelicolor A3(2)
MDLTGRRAVVTGGASGLGAKTVRALAAAGAEVTIATRHPQSAEPLVQEAAAAGAGRVHAEALDLSDVASVDSFARAWRGPLDILVANAGIMALPTRTLTPYGWEMQLATNYLGHFALATGLHAALRDAGSARIVVVSSGAHLGTPFEFEDPHFARRPYDPWAAYGQSKTADVLFTVGARRWAADGITANALNPGYILTRLQRHVDDETMRAFGVMDDQGNVKPLPYYKTPEQGAATSVLLAASPLLNGVTGRYFEDNQEARTVEDGDDQPGGVAAHALDPEAADRLWEYGADTLSAG

SEQ ID NO: 32509 - protein, 167 aa, Fragaria x ananassa
GTMGGACGYGNLYSQGYGVNTAALSTALFNNGLSCGACFEIKCGDDPRWCTAGKPSIFVTATNFCPPNFAQPSDNGGWCNPPRTHLDLRHAHVLKIAEYKAGIVPVSYRRVPCVKKGGIRFTINGHKYFNLVLITNVAGAGDIVSVSVKGTNTGWMPMSRNWGQNWQ

SEQ ID NO: 32510 - protein, 208 aa, Arabidopsis thaliana
MSASRFIKCVTVGDGAVGKTCMLISYTSNTFPTFNKLYDLVTEYQDYVPTVFDNFSANVVVDGNTVNLGLWDTAGQEDYNRLRPLSYRGADVFILAFSLISKASYENVAKKWIPELRHYAPGVPIILVGTKLDLRDDKQFFIDHPGAVPITTNQGEELKKLIGSPIYIECSSKTQQNVKAVFDAAIKVVLQPPKQKKKKKNKNRCVFL

SEQ ID NO: 32511 - protein, 125 aa, Betula pendula
LKQEPGTSEETEQFACTRYKAEYPIFQKIRCNGPDTAPLYKFLKASKTGFLGSRIKWNFSKVAFPCNQFLKQEPGTSEETEQFACTRYKAEYPIFQKIRCNGPDTAPLYKFLKASKTGFLGSRIK

SEQ ID NO: 32512 - protein, 358 aa, Betula pendula
IGSEVIGGVGGTCVIRGCVPKKILVYGATFRGELEDARNYGWELNEKIDFNWKKLLHKKTEEIVRLNGIYKRLLTNSGVKMHEGEGKIVGPNEVEVTQLDGTKLSYTAKHILIATGSRAQRPPIPGQELGITSDEALSLEELPKRVVIVGGGYIAVEFASIWNGMGVTVDLCFRKELPLRGFDDEMRAVVARNLEARGVNLHPRTSLSEIIKTGDGIKVNTDHGEELIVDVVMFATGRAPNTKRLNLEAVGVELDKTGAVKVDEYSRTNIPSIWAVGDVTNRLNLTPVALMEGTCFAKTVFGGEPSKPDHRDVPCAVFSIPALSVVGLSEEQAIEQANGDILVFTSTFNPMKNTISGR

SEQ ID NO: 32513 - protein, 185 aa, Betula pendula
KECRHCKSEESNLCELLRINTDRGVMLSDGKSRFSIKGKPIFHFVGTSTFSEYTVVHRGCAVKINPLAPLDKVCILSCGISTGLGATLNVAKPKKGSSVAVFGLGAVGLAAAEGARIAGASRIIGVDLHPDRIKEARKFGVTELVNPKDHKKPIQEVIADMTDGGVDRSVECTGNVDCMISAFEC

SEQ ID NO: 32514 - protein, 475 aa, Oenothera elata subsp. hookeri
MSPQTETKASVGFKAGVKDYKLTYYTPEYETKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFLAMDTL

SEQ ID NO: 32515 - protein, 158 aa, Oenothera elata subsp. hookeri
MDNTFSIVANILLRIIPTTSGEKEAFTYYRDGMSAQSEGNYAEALQNYYEAMRLEIDPYDRSYVLYNIGLIHTSNGEHTKALEYYFRALERNPFLPQAFNNMAVICHYRGEQAIRQGDSEIAEAWFDQAAEYWKQAIALTPGNYIEAQNWLKITRRFE

SEQ ID NO: 32516 - protein, 448 aa, Streptomyces coelicolor A3(2)
MATDDAMPAKPMPRFPDGFLWGVSTSAHQIEGAAGLRGPSVWDAFTAEPGRVRDGSTAAVACDHYHRYREDVALLAGLGVDAYRFSVSWPRVDSPGGLDFYDRLVDELCAAGVRPVPTLFHWDLPAGLDWLERDTAARFAEYVSLVAERLGDRVGKWITLNEPAEHTLLGHALGVHAPGRELLFDALPVAHHQLLAHGLAVRALRAAGATDVGIANSHGPTWPASDDPADREAADFYDLLLNRMFADPLLTGRYPEGVGALMPGSAERVEADLEVIAEPLDWYGVNYYAPTRVGAPQGAEIEFGGVTLPAELPFSVRRIEGRPVTDFGWPVVPEGLTELLTGFRDRYGDRLPPVVITENGCSYEGLDDHDRIAYLDGHVRALHRAIEAGVDVRGYFVWSLLDNFEWAEGYARRFGLVHVDFTTLARTPKASYGWFRDLLDGQRRVPVG

SEQ ID NO: 32517 - protein, 426 aa, Schizosaccharomyces pombe
MSNGEFIDQYLLPESGAILQDYLDDYFYTSWYTGNRNLIQLDHYGFPTASNFELNPKSTDNCGTVDFQGIPWGNKAIGKRKNFRLYRLHTYSLSCNHSDWSPEELSLDTVQVAAEDSFYEFQRFLKNPNCLRNHHHLCKSVKVVGEHSVIYVSNNSIRMENTLHDNSVQIIDLKNNILQKKAISCLDTTNAVGCLGTLYGQYCIFNFKNGSFSTRKLSDDSINHIQLFSEKKFILGCNDGAVYVEDVQRTSPILVYRCSNAVNCVQLFDETPLALVCTDSKDAMLIDIRSNSVSAKLPHSDSVLTGSWHPNGNILATGGQDTTAKVWDIRALGKSFRNLGSQMSAVTNLCFSPLGESLAVTEQADFVQLFDTKLFNTSQVIDFFGEIAGTAYSSSGDSLFIGVDDPMLGGILEFRRPLQHPLSFIF

SEQ ID NO: 32518 - protein, 1421 aa, Polyangium cellulosum
MADRPIERAAEDPIAIVGASCRLPGGVIDLSGFWTLLEGSRDTVGRVPAERWDAAAWFDPDPDAPGKTPVTRASFLSDVACFDASFFGISPREALRMDPAHRLLLEVCWEALENAAIAPSALVGTETGVFIGIGPSEYEAALPQATASAEIDAHGGLGTMPSVGAGRISYALGLRGPCVAVDTAYSSSLVAVHLACQSLRSGECSTALAGGVSLMLSPSTLVWLSKTRALARDGRCKAFSAEADGFGRGEGCAVVVLKRLSGARADGDRILAVIRGSAINHDGASSGLTVPNGSSQEIVLKRALADAGCAASSVGYVEAHGTGTTLGDPIEIQALNAVYGLGRDVATPLLIGSVKTNLGHPEYASGITGLLKVVLSLQHGQIPAHLHAQALNPRISWGDLRLTVTRARTPWPDWNTPRRAGVSSFGMSGTNAHVVLEEAPAATCTPPAPERPAELLVLSARTASALDAQAARLRDHLETYPSQCLGDVAFSLATTRSAMEHRLAVAATSREGLRAALDAAAQGQTSPGAVRSIADSSRGKLAFLFTGQGAQTLGMGRGLYDVWSAFREAFDLCVRLFNQELDRPLREVMWAEPASVDAALLDQTAFTQPALFTFEYALAALWRSWGVEPELVAGHSIGELVAACVAGVFSLEDAVFLVAARGRLMQALPAGGAMVSIEAPEADVAAAVAPHAASVSIAAVNAPDQVVIAGAGQPVHAIAAAMAARGARTKALHVSHAFHSPLMAPMLEAFGRVAESVSYRRPSIVLVSNLSGKACTDEVSSPGYWVRHAREVVRFADGVKALHAAGAGTFVEVGPKSTLLGLVPACMPDARPALLASSRAGRDEPATVLEALGGLWAVGGLVSWAGLFPSGGRRVPLPTYPWQRERYWIDTKADDAARGDRRAPGAGHDEVEEGGAVRGGDRRSARLDHPPPESGRREKVEAAGDRPFRLEIDEPGVLDHLVLRVTERRAPGLGEVEIAVDAAGLSFNDVQLALGMVPDDLPGKPNPPLLLGGECAGRIVAVGEGVNGLVVGQPVIALSAGAFATHVTTSAALVLPRPQALSAIEAAAMPVAYLTAWYALDRIARLQPGERVLIHAATGGVGLAAVQWAQHVGAEVHATAGTPEKRAYLESLGVRYVSDSRSDRFVADVRAWTGGEGVDVVLNSLSGELIDKSFNLLRSHGRFVELGKRDCYADNQLGLRPFLRNLSFSLVDLRGMMLERPARVRALLEELLGLIAAGVFTPPPIATLPIARVADAFRSMAQAQHLGKLVLTLGDPEVQIRIPTHAGAGPSTGDRDLLDRLASAAPAARAAALEAFLRTQVSQVLRTPEIKVGAEALFTRLGMDSLMAVELRNRIEASLKLKLSTTFLSTSPNIALLAQNLLDALATALSLERVAAENLRAGVQNDFVSSGADQDWEIIAL

SEQ ID NO: 32519 - protein, 2439 aa, Polyangium cellulosum
MATTNAGKLEHALLLMDKLAKKNASLEQERTEPIAIVGIGCRFPGGADTPEAFWELLDSGRDAVQPLDRRWALVGVHPSEEVPRWAGLLTEAVDGFDAAFFGTSPREARSLDPQQRLLLEVTWEGLEDAGIAPQSLDGSRTGVFLGACSSDYSHTVAQQRREEQDAYDITGNTLSVAAGRLSYTLGLQGPCLTVDTACSSSLVAIHLACRSLRARESDLALAGGVNMLLSSKTMIMLGRIQALSPDGHCRTFDASANGFVRGEGCGMVVLKRLSDAQRHGDRIWALIRGSAMNQDGRSTGLMAPNVLAQEALLREALQSARVDAGAIGYVETHGTGTSLGDPIEVEALRAVLGPARADGSRCVLGAVKTNLGHLEGAAGVAGLIKAALALHHELIPRNLHFHTLNPRIRIEGTALALATEPVPWPRAGRPRFAGVSAFGLSGTNVHVVLEEAPATVLAPATPGRSAELLVLSAKSAAALDAQAARLSAHIAAYPEQGLGDVAFSLVSTRSPMEHRLAVAATSREALRSALEVAAQGQTPAGAARGRAASSPGKLAFLFAGQGAQVPGMGRGLWEAWPAFRETFDRCVTLFDRELHQPLCEVMWAEPGSSRSSLLDQTAFTQPALFALEYALAALFRSWGVEPELVAGHSLGELVAACVAGVFSLEDAVRLVVARGRLMQALPAGGAMVSIAAPEADVAAAVAPHAALVSIAAVNGPEQVVIAGAEKFVQQIAAAFAARGARTKPLHVSHAFHSPLMDPMLEAFRRVTESVTYRRPSIALVSNLSGKPCTDEVSAPGYWVRHAREAVRFADGVKALHAAGAGLFVEVGPKPTLLGLVPACLPDARPVLLPASRAGRDEAASALEALGGFWVVGGSVTWSGVFPSGGRRVPLPTYPWQRERYWIEAPVDREADGTGRARAGGHPLLGEVFSVSTHAGLRLWETTLDRKRLPWLGEHRAQGEVVFPGAGYLEMALSSGAEILGDGPIQVTDVVLIETLTFAGDTAVPVQVVTTEERPGRLRFQVASREPGERRAPFRIHARGVLRRIGRVETPARSNLAALRARLHAAVPAAAIYGALAEMGLQYGPALRGLAELWRGEGEALGRVRLPEAAGSATAYQLHPVLLDACVQMIVGAFADRDEATPWAPVEVGSVRLFQRSPGELWCHARVVSDGQQASSRWSADFELMDGTGAVVAEISRLVVERLASGVRRRDADDWFLELDWEPAALGGPKITAGRWLLLGEGGGLGRSLCSALKAAGHVVVHAAGDDTSTAGMRALLANAFDGQAPTAVVHLSSLDGGGQLGPGLGAQGALDAPRSPDVDADALESALMRGCDSVLSLVQALVGMDLRNAPRLWLLTRGAQAAAAGDVSVVQAPLLGLGRTIALEHAELRCISVDLDPAEPEGEADALLAELLADDAEEEVALRGGDRLVARLVHRLPDAQRREKVEPAGDRPFRLEIDEPGALDQLVLRATGRRAPGPGEVEISVEAAGLDSIDIQLALGVAPNDLPGEEIEPLVLGSECAGRIVAVGEGVNGLVVGQPVIALAAGVFATHVTTSATLVLPRPLGLSATEAAAMPLAYLTAWYALDKVAHLQAGERVLIHAEAGGVGLCAVRWAQRVGAEVYATADTPENRAYLESLGVRYVSDSRSGRFVTDVHAWTDGEGVDVVLDSLSGERIDKSLMVLRACGRLVKLGRRDDCADTQPGLPPLLRNFSFSQVDLRGMMLDQPARIRALLDELFGLVAAGAISPLGSGLRVGGSLTPPPVETFPISRAAEAFRRMAQGQHLGKLVLTLDDPEVRIRAPAESSVAVRADGTYLVTGGLGGLGLRVAGWLAERGAGQLVLVGRSGAASAEQRAAVAALEAHGARVTVAKADVADRSQIERVLREVTASGMPLRGVVHAAGLVDDGLLMQQTPARFRTVMGPKVQGALHLHTLTREAPLSFFVLYASAAGLFGSPGQGNYAAANAFLDALSHHRRAQGLPALSIDWGMFTEVGMAVAQENRGARQISRGMRGITPDEGLSALARLLEGDRVQTGVIPITPRQWVEFYPATAASRRLSRLVTTQRAVADRTAGDRDLLEQLASAEPSARAGLLQDVVRVQVSHVLRLPEDKIEVDAPLSSMGMDSLMSLELRNRIEAALGVAAPAALGWTYPTVAAITRWLLDDALVVRLGGGSDTDESTASAGSFVHVLRFRPVVKPRARLFCFHGSGGSPEGFRSWSEKSEWSDLEIVAMWHDRSLASEDAPGKKYVQEAASLIQHYADAPFALVGFSLGVRFVMGTAVELASRSGAPAPLAVFTLGGSLISSSEITPEMETDIIAKLFFRNAAGFVRSTQQVQADARADKVITDTMVAPAPGDSKEPPVKIAVPIVAIAGSDDVIVPPSDVQDLQSRTTERFYMHLLPGDHEFLVDRGREIMHIVDSHLNPLLAARTTSSGPAFEAK

SEQ ID NO: 32520 - protein, 474 aa, Arabidopsis thaliana
MDLVSSLPDDVRCHILSFLTTKESALTSVLSKKWRNLFTLVPNLDLDDSEYLHPEETKWEREEILDSFLDFVERVLSLQGNGPIRRFSLRCESGVPPARLNRWLCKVLQRGVADLELIIDFEDGYLLPRELFVSETLVNLRLKSEFGCIHWWPGAEGTFLPRLQSLDISSAMVFCDDKLQKLLPCFPVIEELRLVGMEWIDSHVTVSCATLTNQLLLSSTGSRTSKNPKSVSFDTPNLLSLAYSDLVAEDYPLVNMKSLFKARIILGVDDDQIARMRAPTNYLSEDDVVRRFGNVVKLMKGIQNVQQLHLHSDTLEVLSMCCESMPVFNNVKTLGIKSDYDRGWQAVPALLRNCPHLETLTFEGLVHHVTDKCGDACDCIFRKDKGRSLKSCPVKVVEIKEFRVTMKEMHLIEHFLDNFPCLKEMKIYREEYDPSPFGNDPQVDDLILDMIEEYKDIYSCNVQLLEPCDKWDEQ

SEQ ID NO: 32521 - protein, 377 aa, Arabidopsis thaliana
MWQMNLSSDETMETGSYPERPGEPDCSYYIRTGLCRFGSTCRFNHPRDRELVIATARMRGEYPERIGQPECEYYLKTGTCKFGVTCKFHHPRNKAGIAGRVSLNMLGYPLRSNEVDCAYFLRTGHCKFGGTCKFNHPQPQPTNMMVPTSGQQSYPWSRASFIASPRWQDPSSYASLIMPQGVVPVQGWNPYSGQLGSVSPSGTGNDQNYRNLQQNETIESGSQSQGSFSGYNPGSSVPLGGYYALPRENVFPERPGQPECQFYMKTGDCKFGTVCKFHHPRDRQAPPPDCLLSSIGLPLRPGEPLCVFYTRYGICKFGPSCKFDHPMRVFTYDNTASETDEVVETSTGKSRRLSVSETRQAATTSSGKDTTIDNTQQ

SEQ ID NO: 32522 - protein, 445 aa, Arabidopsis thaliana
MNSPLSSKNLRIFSKSVACKCLVLVGIALFYRALLLSYSPRNALSNSLLFRDRHMSDSSSTGGIRTDKFLEVPQIVWGLNNQKIAFARACLTARMMNRTLLMPSLSASLFYKEVDKLRPIPFDKVFQFERFNSLCSGFVRLSRFSDVKNRAQVFDLEKGSGRRWTVERDLEHLKQSARNESIDEFEVIRLIGKNPFLWHDHWPVEDYAKVFECMVVVDEISREADKVVMKIREAGEAERAKLASKTEILGPVPFVAVHMRIEIDWMIHCKKLEQRKKISEICSSKREILDRVGNISGLKTPTVLYLAVADTLLEEKEEDSSVLSGWRDGLIPFEKKKLGVKEEIYGKYSYLIQSAIDYEVCLRADVFVGNSFSTFSSLIVLERTQKARRLGFMSSCKDGGNKWRSYAYNLAGESNGVPRRWMTNMTHSSLQAISYGSNSVSCSSG

SEQ ID NO: 32523 - protein, 470 aa, Selenomonas ruminantium
MLKKTKIVCTQGPSTEKPGVIDALIANGMNCARFNFSHGDHEEHLGRINMVREAAKKAGKVISLILDTKGPEMRLGEFKDGKVMLEKGNKFTLTYDDEPGDETHVSVNHKGLYTEVKPGDTLLLSDGLVALKVDEIKGKDIVTTIQNSGKMSTRKRVAAPGVPLGLPPISEQDAKDIIFGCEQDMDFVAASFIQRPDDVIAIRKLIEEHNGHMEILPKIENLEGVKNFDAILEVSDGIMVARGDLGVEVPAEDVPLIQKEIIRKCNAAGKPVIVATQMLDSMERNPRPTRAEVSDVGNAILDGTDAIMLSGETASGDYPVEAVATMNRIAQRMESSLEYKELYVERGLQHMESRTRAIAHATVQMAYELDAPAIITPTESGYTTKVVSKYRPKAAIVAYTPSEKVLRQLNLRWGVYPVLGTQWSDVDEMISNATAAAVKEDLVQRGDLTIITSGVKMESRTRAIAHATDI

SEQ ID NO: 32524 - protein, 135 aa, Arabidopsis thaliana
MDITVRISGLKSSNLIRITPRFSSSSRFRCSNNEPPRKGNESNGGGGDKASTDWDKAWKNFKKQSKKSLFSQFNVDKYVTWNPPRSEFDLSEEVDPIKRTERSNLMLWTSPRFTLVGAIVIVSFLLLYTILAPVK

SEQ ID NO: 32525 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEINSANGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKS

SEQ ID NO: 32526 - protein, 399 aa, Saccharomyces cerevisiae
SFVKDFKPQALGDTNLFKPIKIGNNELLHRAVIPPLTRMRALHPGNIPNRDWAVEYYTQRAQRPGTMIITEGAFISPQAGGYDNAPGVWSEEQMVEWTKIFNAIHEKKSFVWVQLWVLGWAAFPDNLARDGLRYDSASDNVFMDAEQEAKAKKANNPQHSLTKDEIKQYIKEYVQAAKNSIAAGADGVEINSAHGYLLNQFLDPHSNTRTDEYGGSIENRARFTLEVVDALVEAIGHEKVGLRLSPYGVFNSMSGGAETGIVAQYAYVAGELEKRAKAGKRLAFVHLVEPRVTNPFLTEGEGEYEGGSNDFVYSIWKGPVIRAGNFALHPEVVREEVKDKRTLIGYGRFFISNPDLVDRLEKGLPLNKYDRDTFYQMSAHGYIDYPTYEEALKLGWDKS

SEQ ID NO: 32527 - protein, 420 aa, Bacillus subtilis
MKKVMLATALFLGLTPAGANAADLGHQTLGSNDGWGAYSTGTTGGSKASSSNVYTVSNRNQLVSALGKETNTTPKIIYIKGTIDMNVDDNLKPLGLNDYKDPEYDLDKYLKAYDPSTWGKKEPSGTQEEARARSQKNQKARVMVDIPANTTIVGSGTNAKVVGGNFQIKSDNVIIRNIEFQDAYDYFPQWDPTDGSSGNWNSQYDNITINGGTHIWIDHCTFNDGSRPDSTSPKYYGRKYQHHDGQTDASNGANYITMSYNYYHDHDKSSIFGSSDSKTSDDGKLKITLHHNRYKNIVQKAPRVRFGQVHVYNNYYEGSTSSSSYPFSYAWGIGKSSKIYAQNNVIDVPGLSAAKTISVFSGGTALYDSGTLLNGTQINASAANGLSSSVGWTPSLHGSIDASANVKSNVINQAGAGKLN

SEQ ID NO: 32528 - protein, 239 aa, Cynara cardunculus
GSAVVALTNDRDTSYFGEIGIGTPPQKFTVIFDTGSSVLWVPSSKCINSKACRAHSMYESSDSSTYKENGTFGAIIYGTGSITGFFSQDSVTIGDLVVKEQDFIEATDEADNVFLHRLFDGILGLSFQTISVPVWYNMLNQGLVKERRFSFWLNRNVDEEEGGELVFGGLDPNHFRGDHTYVPVTYQYYWQFGIGDVLIGDKSTGFCAPGCQAFADSGTSLLSGPTAIVTQINHAIGAN

SEQ ID NO: 32529 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPL

SEQ ID NO: 32530 - protein, 191 aa, Bacillus megaterium
PSPSTEQSAKKVRKKAENAHNTPLLVLYGSNMGTAEGTARDLADIAMSKGFAPQVATLDSHAGNLPREGAVLIVTASYNGHPPDNAKQFVDWLDQASADEVKGVRYSVFGCGDKNWATTYQKVPAFIDETLAAKGAENIADRGEADASDDFEGTYEEWREHMWSDVAAYFNLDIENSEDNKSTLSLQFVDS

SEQ ID NO: 32531 - protein, 458 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGI

SEQ ID NO: 32532 - protein, 304 aa, Nostoc sp. PCC 7119
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVATY

SEQ ID NO: 32533 - protein, 379 aa, Zea mays
MATAGKVIKCRGCRDVGGRQTAVHRGGGGSAAAGHGGAYQDPLHRALPHRRLLLGGQGANPGVPEDLRTRSGRIVESVGEGVTDVAPGDHVLPVFTGECKECAHCKSEESNMCDLLRINVDRGVMIGDGKSRFTISGQPIFHFVGTSTFSEYTVIHVGCLAKINPEAPLDKVCILSCGISTGLGATLNVAKPAKGSTVAIFGLGAVGLAAMEGARLAGASRIIGVDINPAKYEQAKKFGCTEFVNPKDHDKPVQEVLIELTNGGVDRSVECTGNVNAMISAFECVHDGWGVAVLVGVPHKDDQFKTHPMNFLSEKTLKGTFFGNYKPRTDLPNVVEMYMKKELELEKFITHSVPFSEINTAFDLMLKGESLRCIMRMED

SEQ ID NO: 32534 - protein, 122 aa, Arabidopsis thaliana
MNPRREPRGGRSSLFDGIEEGGIRAASSYSHEINEHENERALEGLQDRVILLKRLSGDINEEVDTHNRMLDRMGNDMDSSRGFLSGTMDRFKTVFETKSSRRMLTLVASFVGLFLVIYYLTR

SEQ ID NO: 32535 - protein, 385 aa, Pseudomonas putida
MAIVIVGAGTAGVNAAFWLRQYGYKGGIRLLSRESVTPYQRPPLSKAFLTSETAESAIPLKPESFYTNNNISISLNTQIVSIDVGRKVVAAKDGEEYAYEKLILATGASARRLTCEGSELSGVCYLRSMEDAKNLRRKLVESASVVVLGGGVIGLEVASAAVGIGRRVTVIEAAPRVMARVVTPAAANLVRARLEAEGVGFKLNAKLTSIKGRNGHVNQCVLESGEKIQADLIIVGIGAIPELELATEAALEVSNGVVVDDQMRTSDTSIYAIGDCALARNLFFGTMVRLETIHNAVTQAQIVASSICGTSTPAPTPPRFWSDLKGMTLQGLGALKDYDKLVVAINNETVELEVLAYKQERLIATETINLPKRQGALGGSIKLPD

SEQ ID NO: 32536 - protein, 502 aa, Capsicum annuum
MEIQFTNLVAFLLFLSSIILLLKKWKTQKLNLPPGPWKLPFIGSLHHLAVAGPLPHHGLKNLAKLYGPLMHLRLGEIPTVIISSPRMAKEVLKTHDLAFATRPKLVVADIVHYDSTDIAFSPYGEYWRQIRKICILELLSAKMVKFFSSIRQDELSMMVSSIRTMPNFPVNLTDKIFWFTSSVTCRSALGKICRDQDKLIIFMREIISLTGGFSIADFFPTWKMLHDVGGSKTRLLKAHRKIDEILEHVVNEHKQNRADGQKGNGEFGGEDLIDVLLRVRESGEVQISITDDNIKSILVDMFSAGSETSSTTIIWALAEMMKKPSVLAKAQAEVRQVLKEKKGFQQIDLDELKYLKLVIKETLRMHPPIPLLVPRECMKDTKIDGYNIPFKTRVIVNAWAIGRDPESWDDPESFSPERFENSSVDFLGSHHQFIPFGAGRRICPGMLFGLANVGQPLAQLLYHFDRKLPNGQSHENLDMTESPGISATRKDDLVLIATPYDP

SEQ ID NO: 32537 - protein, 351 aa, Schizosaccharomyces pombe
MSSLSPELYGCLGNSGLKVSKLILGCMSYGKKEYWEDWVLEDEEEVFKIMKAAYDAGIRTFDTANCYSAGVSEELVGKFIRKYEIPRSSIVILSKCFFPVRKDLIKIFGDLSSRGVHFLDSPELANQCGLSRKHIFDAVEDSVKRLGTYIDVLQIHRYDPHVSAEEVMRALNDVVESGKVRYIGASTMRCYQFIELQNTAEKHGWHKFISMQNYHNLLYREEEREMIPYCQKTGVGLIPWSPLARGLLTRSIDANEETIRSKTDLYTRALEFGAGYKAILSRVEELAKKYNVSMATLATAWSLHKGDYPIVGISKVERLKDALAAVELKLSEEDIKYLEEPYCPVPIQGEI

SEQ ID NO: 32538 - protein, 419 aa, Galdieria sulphuraria
MTVAFVGSTNFSANLFGSKNKHGLQSKSFLGVSVSSEHPISRVQFTPAGGKSRIVCLAWGVKGGVEKFADSLIETARSIASPGKGILAVDESTKTIGKRLASIGVENTEENRQAYRELLFTCEGLGQYISGAILFEETLYQNARNGKSFVDCLRGVGVIPGIKVDKGLSPLPGGEAIETWCTGLDGLSERAAAYYKQGARFAKWRAVLQISPETPTELCVQENARGLARYAKTVQEQGLVPIIEPEILMDGDHDIERTAQVQEHVLATVYKECDSNGVLLEGSLLKPNMTVPGADCKRQVSAEDIARYTIRTMERRVPSAVPGIMFLSGGMSEEEASVYLNVMNKIQRRGPWSLSFSYGRALQQSCLKSWKGKQENVKAAQEALLARARANSKANLGKYVPGSEPTLDKTGTFEKAYVY

SEQ ID NO: 32539 - protein, 421 aa, Streptomyces coelicolor A3(2)
MVDADQTFVIVGGGLAGAKAAETLRTEGFTGRVILVCDERDHPYERPPLSKGYLLGKEERDSVFVHEPAWYARHDIELHLGQTVVAIDRAAKTVHYGDDGTHVSYDKLLIATGAEPRRLDVPGTGLAGVHHLRRLAHAERLKGVLATLGRDNGHLVIAGAGWIGLEVAAAAREYGAEVTVIEPAPTPLHGVLGPELGAVFAELHESRGVRFRFGVKLTEIVGQDGVVLAARTDDGEEHPAHDVLAAIGAAPRTALAQAAGLEIADRAHGGGIVVDDHLRTSDPDIFAAGDVASFHHALFDTSLRVEHWANALNGGPAAARAMLGRGLAHDRVPYFFTDQYDLGMEYSGWAPAGSYDQVVIRGDAAKREFIAFWVKEGRVLAGMNVNVWDVTEPIQQLIRSKTRVDTEDLANPHVSLESLVA

SEQ ID NO: 32540 - protein, 410 aa, Streptomyces coelicolor A3(2)
MTSKTRVVVIGAGLAGVTLARRLGELGTPALTLGDEEHRPYNRVLLAEVLAGRYGPEVIALPAPAGLLRGRVTGIDRAGRTVRCADGSVIAYDTLVLATGSNAVLPPLRGLFTPDHELPEGVHAFRTMDDCLGLSKAVRPGVRAVVIGGGLLGVSAARALAVRGAQVVLAQQSERLMERQLDPAASALVRRHLEGLGVEVHTECRVRDVRSVGGAVRSVEMGDGYALGADLVVLACGVRPRAGLAREAGLAVGKGVLVDDELRTSDPHIRAIGDCAQHADHVYGLAAPALEQAGVLAELLAEGGTATRHYTGTRALTRLTLTGADSPFAPLDLAAFGETDPRPGDDVVQLADATRGTYRKVVVRDDRLVGGVLVGELGTVGALARAWEGAEPLPSDGGPLLHLLTQDGGS

SEQ ID NO: 32541 - protein, 310 aa, Streptomyces coelicolor A3(2)
MTGWSTGDIPDLDGRVAVVTGANGGLGYVIARELARKGATVVLACRSEERGSAAVRRLMGEVPAAAVEPARLDLGDLASVREFAYGLPYERVDLLVNNAGVMALPHGTTVDGFETQFGVNHLGHFALTGLLLPSLLAAPGARIVTVSSVLHALARVDPRDLNSVRRYGRWTAYARSKSANLLFTHELARRLAGREGASDVRAVAAHPGYAETGLHGAGPRAEGRRLAERLARLGSRVVAQSPEAGALPVLYAATAPGVPSDSFTGPSFAMWRGTPAPSWRASWTIDDAMGERLWAASERLTGVIYEALLP

SEQ ID NO: 32542 - protein, 1077 aa, Pichia anomala
MKVEEHIGGVPPLPGKTDGVKQYSDMKNMVIVGLGMTGIAFLEKMLNNDTAQEYFYTVIGEEPYLAYNRVGLTEYFEHKNFDKLLLSPKTFYEERNKNRWNFKVDEAVVEVDRDHKVAKTSKGNSYEYDTLVFATGSNGVLPLQLLPDPVNGKSKQDYRNYREMGCFVYRTIDDLNSMLSFSEELSIPKDSTKRAIVVGGGLLGLEAGKALLDMKTFDNVTVVHRSKWLLSQQMDEKGGALLTEKVRDLGVTARTGTTVDELLFDNNGKLKAVKYNDGEIEECQLLCYTIGIQPRDEVAAESGLVCSKRGGVAINNFMQTSDPNIYAIGECASWNDKTFGLIAPGITMADILSFNLIQSKFHSPKEFSEPDIGTRLKLMGVEVASFGDYFADKNGPKWLPKGYTLKKVRSLVYEDPIEGIYIKLILTQDGKYLLGGILVGNTKQFTKFTSIAKQRKPLPCPASEFILGKGGDDDEDADMLSDDTQVCSCQNISKGTLVENIRNGKCSSLGELKSVTKAGTSCGGCEPTMKAIFESEMKKMGKQLSNALCAHFKQSRADLFSIIMVKQYKSFKEIMQNVGLKPEAAGCEICKPTTIGSIFSTLYNRHILDSDVHGLQETNDRYLGNIQRNGTYSVIPRMSAGEITPEKLIAIGNIAQKYDLYTKITGAQRVDLFGALKQDLPKIWEELYEHGFESGQAYGKSLRNVKSCVASTWCRYGKRYKGIRSPHKMKGGVSGCVTHCAEFHSKDFGLCAVQNGFNVYVGGNGGMKPAHAQLLKSDVPPDQVIPLLDRYLMFYFRTADRLQRTARWLENLEGGIEYLRDVVVFDKLGICKELEDQMNELVGHYFDEWRESVIRKEDQIFKQFANTDKSQETVEIIRERGQRRPADWPEKETVEKKDFKNIKWSSTSWRSVCPSTELPEKEAGSSTTILISDTQIALFRLNGKLYASQNMCGHKRAFVLSQGIISTDENDNVYISCPLHKRNYVIDADKPNAGACKNDDSLSVALFDIKEEDGMILVKLPPEDELDEVLGTTKWKVKKSETVSEGIATFKKLDAKFNIKVPVRTPVPSVGGSELDW

SEQ ID NO: 32543 - protein, 399 aa, Coccidioides posadasii
MRNSILLAATVLLGCTSAKVHKLKLKKLPLTEQLEYGDIETHVRALGQKYFGSLPSSQQQTVLSDEYSTTGGHNVLVDNFLNAQYFSEISIGNPPQNFKVVLDTGSSNLWVPSSECGSIACYLHNKYDSSASSTYKKNGTEFAIRYGSGSLSGFVSQDTLRIGDLTIEGQDFAEATNEPGLAFAFGRFDGILGLGYDTISVNKIVPPFYNMINEGLIDEPVFGFYLGDTNKEGDDSYATFGGVDSSLFSGEMIKIPLRRKAYWEVDFDAIAFGNERAELEDTGIILDTGTSLIALPSTLAELLNREIGAKKSWNGQYTVDCNKRPSLPDLTFTLSGHNFTIGPYDYILEVQGSCISSFMGMDFPEPVGPLAILGDAFLRRFYTMYDLGNNLVGLAKAGN

SEQ ID NO: 32544 - protein, 323 aa, Penicillium janthinellum
AASGVATNTPTANDEEYITPVTIGGTTLNLNFDTGSADLWVFSTELPASQQSGHSVYNPSATGKELSGYTWSISYGDGSSASGNVFTDSVTVGGVTAHGQAVQAAQQISAQFQQDTNNDGLLGLAFSSINTVQPQSQTTFFDTVKSSLAQPLFAVALKHQQPGVYDFGFIDSSKYTGSLTYTGVDNSQGFWSFNVDSYTAGSQSGDGFSGIADTGTTLLLLBDSVVSQYYSQVSGAQQDSNAGGYVFDCSTNLPDFSVSISGYTATVPGSLINYGPSGDGSTCLGGIQSNSGIGFSIFGDIFLKSQYVVFDSDGPQLGFAPQA

SEQ ID NO: 32545 - protein, 132 aa, Nicotiana glauca
FLGLCLAIFVMISSDVFARELAETSTTAKEDSKKSDNKNEVHEDQLGGGYPGGGYPGGGYPGGGYPGGGYPGRGYPGGGRGRGYPGGGRGGGGRGGYCRYGCCGRRNYYGCSRCCYYKGEAMDKVTEGKPQH

SEQ ID NO: 32546 - protein, 177 aa, Silene latifolia subsp. alba
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 32547 - protein, 476 aa, Streptomyces coelicolor A3(2)
MRRSKIVCTLGPAVDSHEQLVTLIEAGMNVARFNFSHGTHAEHQGRYDRVRAAAKETGRAIGVLADLQGPKIRLETFAEGPVELVRGDEFTITAEDVPGDRTICGTTYKGLPGDVTKGDQVLINDGNVELKVTEVEGPRVKTIVIEGGVISDHKGINLPGAAVNVPALSEKDVEDLRFALRMGCDLVALSFVRDAKDVADVHRVMDEEGRRVPVIAKVEKPQAVDNMEDVVMAFDGVMVARGDLAVEYPLEKVPMVQKRLIELCRRNAKPVIVATQMMESMITNSRPTRAEASDVANAILDGADAVMLSAESSVGAYPIETVKTMSKIVTAAEQELLSKGLQPLVPGKKPRTQGGSVARAAAEIADFLGGKGLVAFTQSGDTARRLSRYRAAQPILAFTTDESTRNQLALSWGVEPHVVPFVNTTDEMVDLVDQETARLGRFSDGDTVVITAGSPPGVSGTTNMVRVLHLGETRRG

SEQ ID NO: 32548 - protein, 174 aa, Triticum aestivum
MAPAVMASSATTVAPFQGLKSTAGLPVSRRSRGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 32549 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 32550 - protein, 177 aa, Lemna gibba
MASSMMASTAAVARAGPAQTNMVAPFNACRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 32551 - protein, 177 aa, Lemna gibba
MASSMMASTAAVARAGPAQSSMVAPFNACRSSVAFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 32552 - protein, 475 aa, Pisum sativum
MSPQTETKAKVGFKAGVKDYKLTYYTPDYQTKDTDILAAFRVTPQPGVPPEEAGAAVAAESSTGTWTTVWTDGLTSLDRYKGRCYEIEPVPGEDNQFIAYVAYPLDLFEEGSVTNMFTSIVGNVFGFKALRALRLEDLRIPYAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMLKRAVFARELGVPIVMHDYLTGGFTANTTLSHYCRDNGLLLHIHRAMHAVIDRQKNHGMHFRVLAKALRLSGGDHIHAGTVVGKLEGEREITLGFVDLLRDDYIKKDRSRGIYFTQDWVSLPGVIPVASGGIHVWHMPALTEIFGDDSVLQFGGGTLGHPWGNAPGAVANRVALEACVQARNEGRDLAREGNAIIREACKWSPELAAACEVWKEIKFEFPAMDTL

SEQ ID NO: 32553 - protein, 471 aa, Arabidopsis thaliana
MASLLIFPHLHHFDSSLDRREVLVVRHSQASRRFLTPKASINGSGITNGAAAETTSKPSRKGRKKKQTSTVIEKDNTETDPELNPELADYDDGIEFPYDDPPLVCCFGAVQKEFVPVVRVHDNPMHPDMYSQWKMLQWDPPEFGRAPGGPPSNVAISHVRLGGRAAFMGKVGEDDFGDELVLMMNQERVQTRAVKFDENSKTACTRVKIKFKDGKMMAETVKEPPEDSLFASELNLAVLKEARIFHFNSEVLTSPTMQSTLFTAIQWSKKFGGLIFFDLNLPLPLWRSRNETRKLIKKAWNEANIIEVSQQELEFLLDEDYYERRRNYTPQYFAEDFDQTKNRRDYYHYTPEEIKSLWHDKLKLLVVTDGTLRLHYYTPTFDGVVIGTEDVLITPFTCDRTGSGDAVVAGIMRKLTTCPEMFEDQDVMERQLRFAVAAGIIAQWTIGAVRGFPTESATQNLKEQVYVPSMW

SEQ ID NO: 32554 - protein, 434 aa, Arabidopsis thaliana
MSEIVRVQEIVSKLWNLNIASKKSPNLVTIISNVGYNPSFETNGSFKDFVSRLLARRDSYRIRRFSLKLRSLEFDSAKYHLVNECLRNVLNRGVLDLELDINVNEVYKLPFEVFTCKKVVKLKLGSDFVIDNIPKNALLPALKTLFLDKVRFIDKSGGCAFTRLVSACPVLEDLVIYRNNREDWEWSRIVSSKILKKLTIRREDWEDLDGSSYESISFDTPSLEYFEYFDVLRDGYPVVDLKSLVEAKLELPLFMVGDTYDVKNLIKGLENVQILSLGVVDTMQVFCFFEEAVPVFENLFHLSLSTEVDFCWNVLPILLEKSPNLKTLTIQALHYTTNHYGDENTVCDCLEVYSFLSSCHIEVLKITQFKGDIGEMVQIKHILEKLPSLELLEIHGQVKGDDKKLQIMLDLLMFERASSECKVEVKFPVCFASA

SEQ ID NO: 32555 - protein, 269 aa, Klebsiella pneumoniae
MERYETLFAQLKNRQEAAFVPFVTLGDPGPEQSLKIIDALIEGGADALELGIPFSDPLADGPTIQGAALRAFAAGVTPAQCFEMLAAIRQKHPTIPIGLLMYANLVFSPGIDAFYAQCARVGVDSVLVADVPVEESAPFRQAAMRHNIAPIFICPPNADDDLLRQIASYGRGYTYLLSRAGVTGAENRAALPLHHLVEKLAEYHAAPPLQGFGISAPEQVSAAIDAGAAGAISGSAIVKIIERHLDEPQTMLDELKAFVQSLKAATKTA

SEQ ID NO: 32556 - protein, 267 aa, Pseudomonas aeruginosa
MSRLQTRFAQLKQENRAALVTFVTAGDPDYASSLEILKGLPGAGADVIELGMPFTDPMADGPAIQLANIRALEGGQTLARTLQMVREFRSGDSETPLVLMGYFNPIHHYGVERFIAEAKEVGVDGLIVVDLPPEHNEDLCHPAQAAGLDFIRLTTPTTGDQRLPTVLEGSSGFVYYVSVAGVTGANAATLEHVEEAVARLRRHTDLPIGIGFGIRSAEHAAVARLADGVVVGSALIDRIAKARDNAQAVKDVLALCGELAEGVRNAR

SEQ ID NO: 32557 - protein, 144 aa, Citrus sinensis
MAEHYQPLQQTQLQSRQPRSHQVVKAATAVTAGGSLLVLSGLTMAGTVIALTIATPLLVICSPVLVPAVITVSLLIMGFLASGGFGVAAISVLSWIYRYVTGGHPPGADQLEQARMKLAGKAREMRDRAEQFGQQQITGSQQGS

SEQ ID NO: 32558 - protein, 250 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLADREANETITVVVRQLNAIADKVQNWSKIVIAYEPVWAIGTGKTGTPEEAQEVHAEIRKWATNKLGASVAEGLRVIYGGSVTGGNCKEFLKFHDIDGFLVGGASLKPEFPTNIVNVHSL

SEQ ID NO: 32559 - protein, 146 aa, Phaseolus vulgaris
  misc_feature (146)..(146): Xaa can be any naturally occurring amino acid
MSSTEVATTTKKGGRGKPKTTKSVSRSSKAGLQFPVGRIARYLKAGRYAQRVGSGSPVYLSAVLEYLAAEVLELAGIAARDNKKSRIIPRHIQLAVRNDEELSKLMGSVTIASGGVLPKNSSKICCPRKTGKGEGEVWIYLVKGFX

SEQ ID NO: 32560 - protein, 440 aa, Arabidopsis thaliana
MERDEEASGPMMEMCTNGGEETSNRRPIISGEPLDIEAYAALYKGRTKIMRLLFIANHCGGNHALQFDALRMAYDEIKKGENTQLFREVVNKIGNRLGEKYGMDLAWCEAVDRRAEQKKVKLENELSSYRTNLIKESIRMGYNDFGDFYYACGMLGDAFKNYIRTRDYCTTTKHIIHMCMNAILVSIEMGQFTHVTSYVNKAEQNPETLEPMVNAKLRCASGLAHLELKKYKLAARKFLDVNPELGNSYNEVIAPQDIATYGGLCALASFDRSELKAFIDNINFRNFLELVPDVRELINDFYSSRYASCLEYLASLKSNLLLDIHLHDHVDTLYDQIRKKALIQYTLPFVSVDLSRMADAFKTSVSGLEKELEALITDNQIQARIDSHNKILYARHADQRNATFQKVLQMGNEFDRDVRAMLLRANLLKHEYHARSARKL

SEQ ID NO: 32561 - protein, 486 aa, Lactobacillus plantarum
MYKPTYPKTFPKDFLWGGATAANQVEGAWNEAGKGLTTAEVVKKTTDRKHMSMDDVTISSIQTALDDQTDTMYPKRRGVDFYHHYKEDIKLFAEMGFKVYRFSIAWSRLFPKGDELKPNSDGLAFYDRVIDELRRYHIQPLVTLSHYEMPIGLTLKQNGWASRATIADFNRFTEVVFKHFKGRVPYYLTFNEINTGTWGFHATGAVDTENSAHDQMQLRYQALHHQFIASALATKQLHAIDPDAKIGSMLARMQTYPATPNPADVQAAQVEDDKNLFFTDVQARGEYPEFMNRFFAENDIQLQMAPDDQTILAKYPVDFISFSYYMTTVTQADAPEQVNGNMATGGRNPYLEESDWGWQIDPVGLRVTLNEMWDRYRKPLFVVENGLGALDQLTTDQQVHDTYRIDYLRKHIAQMKAAVQDGVQLMGYTMWGPIDLISFSTSEMSKRYGFIYVDQDDAGKGSLKRYKKDSFYWYQKVIKSNGEDLA

SEQ ID NO: 32562 - protein, 213 aa, Candida tropicalis
ISLLNILVAGRDTTAGLLSFVFFELARTPRVANKLREEIEDKFGLGQDARVEEISFESLKSCEYLKAVLNECLRLYPSVPQNFRVATRNTTLPRGGGKDGLSPVLVRKGQTVMYSVYAAHRNKQIYGEDALEFRPERWFEPETKKLGWAFLPFNGGPRICLGQQFALTEASYVTVRLLQEFSHLTMDPNTEYSPKKMSHLTMSLFDGANIQMY

SEQ ID NO: 32563 - protein, 468 aa, Pseudomonas syringae pv. tabaci
MSKSVQLIKDHDVKWIDLRFTDTKGTQHHVTMPARDALEDDFFEVGKMFDGSSISGWKGIEASDMILLPDDETAVLDPFTEEPTLILVCDIIEPSTMQGYDRDPRAIARRAEEYLKSTGIGDTVFAGPEPEFFIFDEVKFKSDISGSMFKIFSEQGSWMSDQDVEGGNKGHRPGVKGGYFPVPPFDHDHEIRTAMCNALEEMGQTVEVHHHEVATAGQNEIGVKFNTLVKKADEVQTLKYVVHNVADAYGRTATFMSKPLYGDNGSGMHVHMSIAKDGKNTFAGEGYAGLSDLALYFIGGIIKHGKALNGFTNPSTNSYKRLVPGFEAPVMLAYSARNRSASIRIPYVNSPRGRRIEARFPDPSANPYLAFAALLMAGLDGIQNKIHPGDAADKNLYDLPPEEAKEIPQVCGSLKEALEELDKGRAFLTKGGVFSDDFIDAYIALKSEEEIRVRTFVHPLEYELYYSC

SEQ ID NO: 32564 - protein, 501 aa, Streptomyces coelicolor A3(2)
MTDTTPDAAPRATTFTTRSPATGEPLAEHPVDGPEEVARAVARARRAQEGWAALPAARRRERLLRWKRLLARELGTVARTVAEETGKPAGDAGLEVVLTLEHLGWAARNADRVLRRRRVRTGLFTVHQRASLVHRPLGVVGVIGPWNYPCYTPMGSVGYALAAGNAVVLKPSELTPATGLLLAALFDEAVPAHAGLFTAVTGAAATGEALVRSGVDKLAFTGSPGTARKVMAVCAETLTPFLAECGGKDAVIVTADADLDAAADAIVWGAFGNAGQTCAGVERVYAVREVHEALCERVVRRAGVLRPGAGGDAHYGPMTLPGQLETVERHVTEAVSSGARALLGGPESVRAPYVAPVVLTGAPADSAAMTEETFGPVVAVDAVADVDEAVARANDSRYALGAAVFCGSRRTGAAIAARLHAGAVSVNSVLGFAAVPALPFGGSRDSGFGRIHGAEGLRAFTAVQSTTVQRFAPPIALTSFEVPAAARERAVRLARSLHLRH

SEQ ID NO: 32565 - protein, 511 aa, Streptomyces coelicolor A3(2)
MSTPEPVLAGPGILLVLDGWGSADAADDNALSLARTPVLDELVAQHPSTLAEASGEAVGLLPGTVGNSEIGHMVIGAGRPLPYDSLLVQQAIDSGALRSHPRLDAVLNEVAATSGALHLIGLCSDGQIHAHVEHLSELLAAAATHQVERVFIHAITDGRDVADHTGEAYLTRVAELAAAAGTGQIATVIGRGYAMDKAGDLDLTERAVALVADGRGSPADSAHSAVHSSERGDEWVPASVLTEAGDARVADGDAVLWFNFRSDRIQQFADRLHEHLTASGRTVNMVSLAQYDTRTAIPALVKRADASGGLADELQEAGLRSVRIAETEKFEHVTYYINGRDATVRDGEEHVRITGEGKADYVAHPHMNLDRVTDAVVEAAGRVDVDLVIANLANIDVVGHTGNLAATVTACEATDAAVDQILQAARNSGRWVVAVGDHGNAERMTKQAPDGSVRPYGGHTTNPVPLVIVPNRTDTPAPTLPGTATLADVAPTILHLLGHKPGPAMTGRPLL

SEQ ID NO: 32566 - protein, 468 aa, Azospirillum brasilense
MSDISKVFDLIKEHDVKYVDLRFTDPRGKLHHTAQHVSTIDEDVFEDGIMFDGSSIAGWKAINESDMILQLDPTTAVMDPFSAQPTLNILCDVYEPSTGQPYARCPRGIAKAAEKYMASAGIADTAYFGPEAEFFVFDDVKFKVEMNKVSYEFDSEEGPYTSDKDYEDGNLGHRPGVKGGYFPVAPVDSGSDLRAEMLSVLAEMGVPVEKHHHEVAASQHELGIKFDTLVRTGDNMQYYKYVVHNVAHAYGKTATFMPKPVFGDNGSGMHMHQSIWKEGQPLFAGNQYADLSELALYYIGGIIKHAKALNAFTNPTTNSYKRLVPGYEAPVLLAYSARNRSASCRIPYVASPKGKRVEVRFPDPSANPYLAFAALLMAGLDGIQNKIHPGEAMDKNLYDLPAEELAKVPTVCGSREALDSLKADSAFLQKGDVFTKDMIESYIDLRTEELLAFETMPHPIEYKMYYSV

SEQ ID NO: 32567 - protein, 468 aa, Vibrio alginolyticus
MSVEKVLSLIQENEVKFVDLRFTDTKGKEQHISIPAHQIDADFFEEGKMFDGSSVAGWKGINESDMVMMPDASSAVLDPFTEDATLNIRCDILEPATMQGYDRDPRSIAKRAEDFMRSTGVADTVLIGPEPEFFLFDDVKFATDMSGSFFKIDDVEAAWNTGSDYEEGNKGHRPGVKGGYFPVAPVDSSQDIRSAMCLVMEEMGLVVEAHHHEATAGQNEIATRFNTLTTKADEIQIYKYVVHNVAHAFGKTATFMPKPLVGDNGSGMHVHQSLAKDGVNLFAGDKYGGLSEMALYYIGGIIKHARAINAFANPSTNSYKRLVPGFEAPVMLAYSARNRSASIRIPVVPSPKARRIEVRFGDPAANPYLCFASMLMAGLDGIKNKIHPGEAMDKDLYDLPAEESAEIPTVAYSLKDALAELDADREFLTAGGVFSDDFIDSYIELKSQDVERVNMTTHPVEFELYYSV

SEQ ID NO: 32568 - protein, 468 aa, Acidithiobacillus ferrooxidans
MGYSPSDVVKLIQEKDIKFIDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPEFFVFDSVTWNIDMSGCAYKVDAEEAAWNSGKEYESGNMGHRLGVKGGYFPVPPVDSAQDLRSAMCLAMEEMGLKVEVHHHEVATAGQHEIGVGFNTLTPRRMRCKILKYVVHNVAAVRQTATFMPKPVVGDNGSGMHVHQSLGKDGKNIFAGDLYGGLSEIALYYIGGIIKHAKAVNALTNPSTNSYKRLVPHFEAPVLLAYSAKNRSASIRIPYVNSPKARRIEVRFPDSTANPYLAFSAMLMAGLDGIQNKIHPATAMDKNLYDLPAEEQANIPGVAASLEEALRALEADHDFLMKGGVFSESWLEGYLDVKWAEVQTLRVTTHPVEFQMYYSL

SEQ ID NO: 32569 - protein, 403 aa, Tolypothrix sp. PCC 7601
MAKSKTFYICNDCGAESSQWFGKCPACGTYNSLEEQISIQSSVDIPSRGGVSGWQSASTNGKSHNKPAKPRSSLTFDQISDRQIARWESGYGELDRVLGGGVVPGSMVLIGGDPGIGKSTLLLQVSNQLAQRYRILYVTGEESGQQVKLRASRLGVAKGVNVVGDENTVVEAVTPVPIDPQSEVIPVAIDSNSINPDNIGADLYILPETDLEEILREIDSLKPNVAVIDSIQTVFFPALTSAPGSVAQVRECTAALMKVAKHEDVTMLIVGHVTKEGAIAGPKVLEHLVDTVLYFEGDRFASHRLLRTVKNRFGATHEIGIFEMVSHGLREVPNPSELFLGNRDDPAPGTAIVVACEGTRPIVVELQALVSPTSYPSPRRAATGIDYNRLVQILAVLEKRVGI

SEQ ID NO: 32570 - protein, 178 aa, Helicobacter pylori
MLTIKDIHALEVMDSRGNPTIQASVILSDNTKASAIVPSGASTGKREALELRDNDKTRFLGKGVLRACENVNSVIKHHLIGLEATNQAFVDERLRALDGTPNYANLGANAVLGVSMALARASAKALNLPLYRYLGGANALTLPVPMLNIINGGTHANNSIDFQEYMIMPLGFESFKEA

SEQ ID NO: 32571 - protein, 377 aa, Escherichia coli
MSNGIVIIGSGFAARQLVKNIRKQDATIPLTLIAADSMDEYNKPDLSHVISQGQRADDLTRQTAGEFAEQFNLHLFPQTWVTDIDAEARVVKSQNNQWQYDKLVLATGASAFVPPVPGRELMLTLNSQQEYRACETQLRDARRVLIVGGGLIGSELAMDFCRAGKAVTLIDNAASILASLMPPEVSSRLQHRLTEMGVHLLLKSQLQGLEKTDSGIQATLDRQRNIEVDAVIAATGLRPETALARRAGLTINRGVCVDSYLQTNNTDIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLPM

SEQ ID NO: 32572 - protein, 184 aa, Nicotiana glauca x Nicotiana langsdorffii
TSSSPDHRQSLQRTLWTFIITFLKSGVLGDGQGGSGITPMISIIRELIYRSTLPNTKVPKVILISAFKNTADLAMLDLLLPVSSTPADISNLDLQIEAYITRENGQEHNTESPHHKQLTQTIVFKHNPNDSAISVALGPSSWLWLGAIICSSFVVFLHLLGIVTRYSICPIGRDGRLYHYSGKI

SEQ ID NO: 32573 - protein, 362 aa, Capsicum annuum
MATAVTAAVSLPSSKSTSFPTRTSIISPEKINFNKVPLYYRNVSGGSKLVTIRAQVTTEAPAKVEKISKKQDEGVVVNKFRPKEPYIGRCLLNTKITGDDAPGETWHMVFSTEGEIPYREGQSIGVIADGVDANGKPHKLRLYSIASSALGDFGDSKTVSLCVKRLVYTNDKGEEVKGVCSNFLCDLKPGADVKITGPVGKEMLMPKDPNATVIMLGTGTGIAPFRSFLWKMFFEKHDDYKFNGLAWLFLGVPTSSSLLYKEEFEKMKEKAPENFRLDFAVSREQTNEKGEKMYIQTRMAQYAEELWTLLKKDNTFVYMCGLKGMEQGIDDIMSSLAAKEGIDWADYKKQLKKAEQWNVEVY

SEQ ID NO: 32574 - protein, 304 aa, Clostridium sticklandii
MIYENIMQTIGKTPIVKLKNLTDENMAELYVKLEFFNPGGSVKDRAALNMIENMEKEGKLKLGDIIVEPTSGNTGIGIAMVGSAKGYKVILCMPETMSIERRKILKAYGAELVLTEGAKGMKGAIAKAEEMAQEDGYIILRQFDNSYNVDAHYKNTAKEIISDLPDLDALVVGVGTGGTLTGVAKAFKESSINAEIVAVEPVDSAVLSGNAPGPHKLQGIGAGFVPSILDTEYISKIEQIQTQEAFNASRLMASKEGILLGISGGAALEAAIRTAKRLGKGKKVCLLLPDNGERYLSTALYGDE

SEQ ID NO: 32575 - protein, 422 aa, Streptomyces coelicolor A3(2)
MTSQPTLTKPEEGPAGPSGPDTGLQAGLKNRHLSMIAIGGVIGAGLFVGSSSGIATAGPGILLSYALVGTLVVLVMRMLGEMSAANPTSGSFSAHADRALGPWAGFSIGWLYWFFWVVVLAVEATAGAKILEGWIPAVPQWGWALIVMVVLTATNLASVGSYGEFEFWFAGIKVVAIAAFIVVGGLAVFGVLPGVDSDRAGLGNLTEHGGFLPHGAGAVLTGVLLVVFSFMGSEIPTLAAGESEDPQRAVTKATNSIIWRIAVFYLGSIFVVVALLPWDSQSIVDQGSYVAALDSLGIPNAGEIMNFIVLTSVLSCLNSGLYTASRMAFSLGRRGDAPKAFARTTRRGVPQAAILSSVVFGFVAVFFNYKFPDTVFLFLLNSSGAVASSSGWPSASRSCGCGRSSRPRRRRSWSCGCGCTRI

SEQ ID NO: 32576 - protein, 461 aa, Streptomyces coelicolor A3(2)
MSNSTTAKAPRQPADASLSHGLKQRHLSMIALGGVIGAGLFVGSGAGIAAAGPSIVVAYTVSGLLVMLVMRMLGEMSAAYPSSGSFSAHAERAIGPWAGFTAGWAFWVLLCTAVGLEGIGAAQIVHGWLPGTPEWAWVALFMVVFCGTNLAAVKNFGEFEFWFAALKVGAISLFLVLGVLAICGVLPGTDSPGTSHLGDFLPHGGNGLIIGLLASVFAYGGLETVTIAAAESENPVRGVASAVRTAMWRIALFYIGSMAVIVTLVPWDSPEVVEKGPYVAALDELGIPGAGQLMNIVVLVALLSAMNANIYGASRIGYSLVERGQGPKVLGRVSGGVPRVAVLVSSLFGFGCVLLSYWRPDDVFSWLLNMIGAVILVVWIFIAAAQLRLRRRLEREAPEKLVVRMWAFPWLTWVALAGMAAVFVLMAREPDTRVQLYSTGGMTLVLAAVGYARQRRGAARD

SEQ ID NO: 32577 - protein, 137 aa, Catharanthus roseus
MASADVEFRCFVGGLAWATTDQSLSEAFSQYGEVLESKIINDRETGRSRGFGFVTFGDEKSMKDAIEGMNGQTLDGRNVTVNEAQSRGSGGGGGGGGFRGPRREGGGCYGGGGRRNGGYGGNGGGYGGGRRDGGRRW

SEQ ID NO: 32578 - protein, 164 aa, Catharanthus roseus
MASADVEYRCFVGGLAWATTDQSLSEAFSQYGEILESKIINDRETGRSRGFGFVTFKDEQSMRDAIEGMNGQTLDGRNITVNEAQSRGSGGNGGGGFRGPRRDGGGGGGYGGGRRDGGYGGNGGYGGGRREGGYGGGDRGYGGGGGGGSRYSRGGGASDGNWRN

SEQ ID NO: 32579 - protein, 160 aa, Catharanthus roseus
MASADVEFRCFVGGLAWATTDQSLSEAFSQYGEVLESKVINDRETGRSRGFGFVTFGDEKSMKDAIVGMNGQTLDGRNITVNEAQSRGSGGGGGGGGFRGPRREGGGGYGGGGRRDGGYGGNGGGYGGGRRDGGYGGGDRGYGGGDRYSRGGGSDGNWRN

SEQ ID NO: 32580 - protein, 205 aa, Gossypioides kirkii
CKGYTPLFPRILGHEASGIVESVGEGVNDLKPGDHVLPIFTGECKECRYCLSEESNNMCELLRINCDRGVMLADGKTRFSINGKPIYHFVGTSTFSQYTVVHVGQVAKISPTAPLDKVCPISCGICTGFGATVNVAKPKKGQTVAIFGLGAVGLAAAEGARVCGASRIIAVDLNPRRFEEAKRFGITEFVNPKDYDKPVQEVIVE

SEQ ID NO: 32581 - protein, 370 aa, Aspergillus niger
MPSAKPLFCLATLAGAALAAPAPSRVSDFTKRSTCTFTDAATASESKTSCSDIVLKDITVPAGETLNLKDLNDGTTVTFEGTTTWEYEEWDGPLLRISGKDITVTQSSDAVLDGNGAKWWDGEGTNGGKTKPKFFYAHDLDDSKISGLYIKNTPVQAISVESDNLVIEDVTIDNSDGDSEGGHNTDGFDISESTYITITGATVKNQDDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCSDWTMSGIDITGGETSSDCENVPSGASCDQ

SEQ ID NO: 32582 - protein, 362 aa, Aspergillus niger
MHFLQNAVVAATMGAALAAAAPLEKRSCTFTSASAAKSGKSSCSTITLDNIAVPAGETLDLTGLKKGTTVIFEGETTFGYKEWKGPLISMSGTDITVKQASGAKINCDGARWWDGKGSNGGKTKPKFFQAHKLDQSSITGLKVYNTPVQGFSILADHLTITDVTIDNSAGTSKGHNTDAFDIGQSTYITIDGATVYNQDDCLAINSGEHITFTNGYCDGGHGLSIGSIGGRSDNTVNDVTISNSKVLNSQNGVRIKTIYGKTGTVENVKFEDITLSDISKYGIVVEQDYENGSPTGTPTNGVKVEDITFKKVTGSVKSSGTDIYILCGSGSCSNWTWSGVDVTGGKKSSKCKNVPSGASCSD

SEQ ID NO: 32583 - protein, 382 aa, Arabidopsis thaliana
MSCFGCFGGSERSRHSPNPYDDDTYSHDSGETSNPGGDDEEGEEEEEVEELSRSKRSEEILKCKLQNGLVCRQFPVKETNKLTRGEDEDGNKTINEFVRERKIGSGSYGKVVLYRSTVDDKHYAIKAFHKSHLSRLRVAPSETAMGDVLREVMIMKTLEHPNIVNLIEVIDDPEFDDFYMVLEYVDGKWAYDDSGPPGALGEITARKYLRDVVAGLMYLHAHNVIHGDIKPDNLLVTSTGRVKIGDFSVSQDDDDQLRRSPGTPVFTAPECCLGITYSGRSADTWAVGVTLYCMILGQYPFLGDTLQDTYDKIVHNPLIIPEGLNPRLRDLIEGLLCKDPNQRMTLKAVAEHPWITGEDGAISEYCCWCKRKAEEEEDQNHS

SEQ ID NO: 32584 - protein, 508 aa, Schizosaccharomyces pombe
MFILTETAAGYAIFKAKDKLLKKRDALIEDLKSPEGASNLLKLQSFAKFESTVDALDNVSALVEGKVSSKLSSLLEGLSDSKSSTLVVADPKLGNAINKLPGLEFEIISDSSVQDLYRGIREHLSSLISGLAPSDLNAMSLGLSHSLSRHKLKFSPDKVDTMIVQAIALLDDLDKELNTYAMRVREWYGWHFPEMGKIIQDNLAYARVIKAMGMRTKCSETDFSDILPEEIEATLKSAAEISMGTEITEEDLDNIVMLADQVLELASYRAQLSEYLRNRMQAIAPNLTALVGELVGARLIAHAGSLMNLAKQPASTIQILGAEKALFRALKTKHSTPKYGLIYHASLVGQANSKNKGKIARVLATKAALSLRVDALSDKDTTNGNIGLENRIRVENRLRSLEGGKLLPLPTAPVQQSKVQINGTSAYSTATDAVTKDAEESQEDVEMDIVIEKKKKKSSKLKEADGESSKKEKKEKKDKKHKKSKRKSEESEDGESPKKKKKSKKSKD

SEQ ID NO: 32585 - protein, 181 aa, Paenibacillus polymyxa
MSIYDYSAIAMNGKEIVLSDYKDKVVLIVNTASQCGFTFQYQDLQRLYDQFKDRGLVILGFPCNQFADQEPDSNESVQTFCTLNYGVAFPMFQKVNVRDEQAHPLFTYLASSLPFEGFDETHSVAKILIPLIHERHPEYLPGDSIKWNFTKFLIDRNGKVIKRFEATTDPLDMEEYIEALL

SEQ ID NO: 32586 - protein, 509 aa, Bacillus subtilis
MDYEKERTERAERIQKGGAEKYHRSNQEKGKLFVRERLALLFDDDIELEDAFFAECMSDGLPADGVVTAIGKIGGQTVCAMANDSTVKAGSWGAKTVEKIIRIQETAEKLNCPLIYLVDSAGARITDQVNVFPGRRGAGRIFYNQVKLSGRIPQICLLFGPSAAGGAYIPAFCDIVVMVDGNASMYLGSPRMAEMVIGEKVSLEEMGGARMHCSVSGCGDILAETEQEAIHLARSYLSYFPANYKERAPVQEKRPPKPFEIPLSDVIPQNQNAPFNMFELIDRVIDEGSFFEIKALFAPEIITGLARIHGQPVGIIANQPKVKGGVLFHDSADKAAKFITLCDAFHIPLLFLADIPGFMIGTKVEQAGIIRHGAKMISAMSEATVPKLSVIVRKAYGAGLYAMAGPAFEPDCCIALPTAQIAVMGPEAAVNAVYAKKISELPKEERAQFISSKREEYKEDINIYRLASEMIIDAVIPANSLRGELHKRLMAYMTKEITFTNRKHPVYPV

SEQ ID NO: 32587 - protein, 364 aa, Cupriavidus necator
MSRCGRRAELLHAAGTGSGSASFPMSAAPSSSPDAPATPGLPSSPLDPQVAALLELIARAKRPPIHAMEPEDAKIAYEKSAPILDINPPPVYMAEDLLAPARDGHAIPLRLYTPREASWTEPLPLLVYFHGGGFTVGSVDSHDPLCRLLCGQADCMVLSVDYRLGPQWRFPTAANDAFDVLHWVFAEAGRLGADPARIAVGGDSAGGTLAAACAVEARNAGLAPVLQLLIYPGTCARQDTPSHRALADGYLLTADMIRWFFAQYLDQEASRDDWRFAPLDGGGAGAEVRGTCPAWIAVAGYDPLHDEGVAYAEKLRAAGVAATLADYPGMIHDFFKLGRFVPAVAQAHAEAVAALRAAFGTPHN

SEQ ID NO: 32588 - protein, 325 aa, Pseudomonas aeruginosa
MAKRIQFAACGGPEVLEYRDYQPAEPGPREVRVRNRAIGLNFIDTYYRSGLYPAPGLPSGLGSEGAGEVEAVGSEVTRFKVGDRVAYATGPLGAYSELHVLAEEKLVHLPDGIDFEQAAAVMLKGLTTQYLLRQTYELRGGETILFHAAAGGVGLFACQWAKALGVQLIGTVSSPEKARLARQHGAWETIDYSHENVARRVLELTDGKKCPVVYDSVGKDTWETSLDCVAPRGLLVSFGNASGPVTGVNLGILSQKGSLYVTRPTLGSYADTPEKLQAMADELFGLIERGDIRIEINQRFALAEAARAHTELAARRTTGSTVLLP

SEQ ID NO: 32589 - protein, 335 aa, Saccharomyces cerevisiae
MVNEKVNPFDLASVSPLVLGGAILNQQYTDEPESIPLEDIIKYAFSHGINAIDTSPYYGPSEVLYGRALSNLRNEFPRDTYFICTKVGRIGAEEFNYSRDFVRFSVHRSCERLHTTYLDLVYLHDVEFVKFPDILEALKELRTLKNKGVIKNFGISGYPIDFITWLAEYCSTEESDIGSLDAVLSYCNLNLQNNKLLNFRERLLRNAKLKMVCNASILSMSLLRSQETRQFHPCSHELRECASQAAKYCQEQNVDLADLATRYAISEWVGKGPVVLGVSSMEELKLALDNYEIVKSNGNRLSSKDGQLVEYIQKNIFKEHFNEEWSSGIPHPEMI

SEQ ID NO: 32590 - protein, 281 aa, Arabidopsis thaliana
MAADNAYLMQFVDETSFYNRIVLSHLLPANLWEPLPHFLQTWLRNYLAGTLLYFISGFLWCFYIYYLKINVYLPKDAIPTIKAMRLQMFVAMKAMPWYTLLPTVSESMIERGWTKCFASIGEFGWILYFVYIAIYLVFVEFGIYWMHRELHDIKPLYKYLHATHHIYNKQNTLSPFAGLAFHPVDGILQAVPHVIALFIVPIHFTTHIGLLFMEAIWTANIHDCIHGNIWPVMGAGYHTIHHTTYKHNYGHYTIWMDWMFGSLRDPLLEEDDNKDSFKKAE

SEQ ID NO: 32591 - protein, 233 aa, Legionella pneumophila
MKMKLVTAAVMGLAMSTAMAATDATSLATDKDKLSYSIGADLGKNFKNQGIDVSPEALAKGMQDAMSGAQLALTEQQMKDVLNKFQKDLMAKRTAEFNKKADENKVKGEAFLTENKNKPGVVVLPSGLQYKVINAGNGVKPGKSDTVTVEYTGRLIDGTVFDSTEKTGKPATFQVSQVIPGWTEALQLMPAGSTWEIYVPAGLAYGPRSVGGPIGPNETLIFKIHLISVKKSS

SEQ ID NO: 32592 - protein, 233 aa, Legionella pneumophila
MKMKLVTAAVMGLAMSTAMAATDATSLATDKDKLSYSIGADLGKNFKNQGIDVSPEAMAKGMQDAMSGAQLALTEQQMKDVLNKFQKDLMAKRTAEFNKKADENKVKGEAFLTENKNKPGVVVLPSGLQYKVINAGNGVKPGKSDTVTVEYTGRLIDGTVFDSTEKTGKPATFQVSQVIPGWTEALQLMPAGSTWEIYVPSGLAYGPRSVGGPIGPNETLIFKIHLISVKKSS

SEQ ID NO: 32593 - protein, 495 aa, Aspergillus niger
MKRSALLASFLPLALGCDSAETHSCASAFSVSSAAAASFCATFTASTVTATTGVPDVFLSNCDYKTKHLSSACSCLGTADGSAPASTPAAPAVSSSSKVGKAPAVAATRTSAIPTTFHTTAVRVPLSTSAAAAVTSQAVLPAQSSVAGNGGTTCTVTEYASISSAVASCSNILLSNINAPASSTIDLTGLQTGAAVIFAGETTFGDTYDSDFDPIVISGTDVTITGEEGHVINGNGEAYWDGEGSNGGQDKPDHFIVVKDMYNSKIENLNILNWPVHCFEIENTEYLTISGLILNNTAGDAANSKSDGDPAAHNTDGFDIKQSDFLTLSNSWVHNQDDCVAVTSGSSIVVDNLYCYGGHGLSIGSIGGKSNNTVDGVTFSNSQVINSENGCRIKSNADTTGEVYNVKYENITLSGISDYGIDIQQDYENGGATGDPTNGVKIENISFVNVKGTMSDGKDYYILCGDGSCSNFVFTDVDITGGSDDSCNYPSSGCP

SEQ ID NO: 32594 - protein, 361 aa, Arabidopsis lyrata subsp. petraea
CKAAVAWEAGKPLVMEEVEVAPPQKHEVRIKILFTSLCHTDVYFWEAKGQTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNFLNERTLKGTFFGNYKPKTDIPGVVEKYMNKELELEKFITHTLPFSEINKAFDYMLKGES

SEQ ID NO: 32595 - protein, 226 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQA

SEQ ID NO: 32596 - protein, 238 aa, Arabidopsis lyrata subsp. lyrata
CKAAVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPR

SEQ ID NO: 32597 - protein, 357 aa, Arabidopsis lyrata subsp. lyrata
AVAWEAGKPLVMEEVEVAPPQKHEVRIKILFTSLCHTDVYFWEAKGHTPLFPRIFGHEAGGIVESVGEGVTDLQPGDHVLPIFTGECGDCPHCHSEESNMCDLLRINTERGGMIHDGESRFSINGKPIHHFLGTSTFSEYTVVHSGQVAKINPDAPLDKVCIVSCGLSTGLGATLNVAKPKKGQSVAIFGLGAVGLAAAEGARIAGASRIIGVDLNSQRFDQAKEFGVTEFVNPRDHDKPVQQVIAEMTNGGVDRSVECTGSVQAMIQAFECVHDGWGVAVLVGVPSKDDAFKTHPMNLLNERTLKGTFFGNYKPKTDIPGVVEKYMNKELELEKFITHTLPFSEINKAFDYMLKGE

SEQ ID NO: 32598 - protein, 481 aa, Campylobacter jejuni subsp. jejuni NCTC 11168
MGNARGFLDFKRMDFKKIAPKERILNYKEFTIPLDKKEQEVQGGRCMDCGVAFCHTGVMSEGKDVGCPLNNLIPEWNDLVYRSLWKEAYERLDLTNPFPEFTGRVCPAPCEDSCVCAINGVSVSIKNNELSIIENAFKENLVRVNKPKQYNGKKIAVIGSGPAGLACANTLNSLGYKVSVFERSDKIGGLLMYGIPDMKLDKSIVQRRVDLLKKSGIEFKVNENIDSKDKVSKLLKEFDALVLCTGASKPIDLDIEGRKLKGVEFALDFLTQNTKTLLKTGKGADMAKGKNVLVIGSGDTSVDCIAVATRQGAKSIVRFERSPKRPLQRSQNNPWPLKADIFTTDYGLEEAIAVYGKDPREYQKMTKKFLGKTHVEGVEANDLKREFKEGKAINVEISNSKKTYKADLVLLAMGFSGCEEAISKNFGVKLDEKNNISTENFQTTHKKIFACGDARKGQSLVVWAIKDGIECALSLHQNLAK

SEQ ID NO: 32599 - protein, 400 aa, Campylobacter jejuni subsp. jejuni NCTC 11168
MFDEIRFNTIERLPNYVFAEVNAIKMAARRAGEDIIDFSMGNPNGKTPQHIIDKLCESANKDKTSGYSTSMGIYKLRLAICNWYKRKYNVNLDPENEVVATMGSKEGFVNLARAIINPGDVAIVPTPAYPIHTQAFIIAGGNVAKMPLAYNEKFELDENQFFENLHKTLNESIPCPKYVVVNFPHNPTTVTCEKSFYERLIATAKKERFYIISDIAYADLTYDDYKTPSILEIEGAKDVAVETYTLSKSYNMAGWRVGFVVGNKRLVSALKKIKSWFDYGMYTPIQVAATIALDGDQTCVDEIRATYDKRMHILLEAFENAGWKLQKPRASMFVWAKLPESKRHLKSLEFSKQLLQRASVAVSPGVGFGEAGDEYVRIALIENENRIRQAARNIKKYLKE

SEQ ID NO: 32600 - protein, 456 aa, Campylobacter jejuni subsp. jejuni NCTC 11168
MKAIIDNIKILEQNAINKGLDELILMENAGLNLAKLIKKEAKKIRIQRKIRKVKILFLLGGGNNASDGLVALRNLKHAKAYKIGFKENTLFKKQEQILQNYAFKFCKKEPNFKKFHIIIDCILGTGSNRCLDEKTSLIIQKVNQSKALKIACDIPTNLGFYPCFKADITFCMGALKEILLEDFAKEFVGRIKIANLGIRSKKFYPNSQAFLLEKKDLKTIDRKINANKGNFGHIYIVANASAGTLAGLGALNFGAGLVSLVAQKSFSPLLMLKEKIENNASAIALGMGLENLDFLKDEILQNTPLILDANCFLSEALLWYLNRKDVVITPHPKEFIKLYKMCFDENLDIETLQKNRFFYARKFSQNYDCVLVLKGANPIIVQKEKLFVVNLGNQALAKGGSGDVLSGMIAAHLGFGFSALEAAKNATLAHGLVAKKYKFNKNSFDALKLIKGLKCL

SEQ ID NO: 32601 - protein, 395 aa, Campylobacter jejuni subsp. jejuni NCTC 11168
MKMDYKEQSHIIPTYKRFDIVLEKGQGVYLFDDKAKKYLDFSSGIGVCALGYNHAKFNAKIKAQVDKLLHTSNLYYNENIAAAAKNLAKASALERVFFTNSGTESIEGAMKTARKYAFNKGVKGGQFIAFKHSFHGRTLGALSLTANEKYQKPFKPLISGVKFAKYNDISSVEKLVNEKTCAIILESVQGEGGINPANKDFYKALRKLCDEKDILLIADEIQCGMGRSGKFFAYEHAQILPDIMTSAKALGCGLSVGAFVINQKVASNSLEAGDHGSTYGGNPLVCAGVNAVFEIFKEEKILENVNKLTPYLEQSLDELINEFDFCKKRKGLGFMQGLSLDKSVKVAKVIQKCQENALLLISCGENDLRFLPPLILQKEHIDEMSEKLRKALKSF

SEQ ID NO: 32602 - protein, 457 aa, Campylobacter jejuni subsp. jejuni NCTC 11168
MMTSKTSLALLCDFYEFTMSQGYFKNNKKDQICYFDIFFRKIPDSGSFAIFAGLEDILDFVENLSFDAEDIEFLRKQGIFDTEFLDFLANFKFKGEIYAMREGEVIFPNEPLLCIKATTIEAQLLETFLLLSLNHQSLIATKTNRIVRAAKDSKILEFGSRRAQGSEAALKGARAAFIGGCIGSACTLAGKIYNIPINGTMAHSWVQMFENELEAFKAYVKIYPKNPVFLIDTYDCLNSGLKNAIKVFKEFGIQEGGVRIDSGNLLELSLKIRQELDQAGLQKCKIIVSNALDEWSIKKLKEQNAPIDIFGVGERLITASSDPIFSCVYKLAALEDQGIKPKIKISENNEKSTLPHFKKLFRVYDKNTQKILFDELYVFDENPNQDENLERKELLELVYKEKRLLKKSSLNTIQDYTKEQISKLDESFLDLDRFVKFEVKLSPKLQNITEDLLKTRF

SEQ ID NO: 32603 - protein, 427 aa, Campylobacter jejuni subsp. jejuni NCTC 11168
MQNQILKNLDLKHIWHPCTQMKDHETLPLIPIKKAKGVWLYDFDDKAYMDCVSSWWVNLFGHCNEKIANAIKKQVDELEHVILAGFTHEPIIKLSARLCEKVGRNFNKCFYADNGSSAIEVALKMSFHYHLNKGVKKSKFLSLSNSYHGETLGALSVGDVALYKDTYKALLLECLSTPVPQGKDYTKELEILKDILEKNASEICAFILEPLVQCAGNMHMYEARFIDEAIKLCHKFGVQVIFDEIAVGFGRTGTLFALHQCKQSPDFICLSKGITGGFMPLSVVLTRDEIYNAFYDTYESQKAFLHSHSYTGNTLACAAANAVLDIFEDENILVKNQILSEFIKKEFSRLEKFDFLGNFRTCGMISAFDILSTKYKRVGLFVFQKALEKGLLLRPLANTIYFMPPYIITKEQIVYVLESLEQIFKEF

SEQ ID NO: 32604 - protein, 357 aa, Campylobacter jejuni subsp. jejuni NCTC 11168
MPNLEEFRNKIDAVDDKILDLLNERMTYVKSIGELKQSSGGSIYRPERERAIINRLKNANLGLLDQNAIEAIYQEIFAVSRNLEMPQTIAYLGPEGTYTHQAARSRFGAMSRYIALANIEDVFKELSNKEAKYGVVPIENNTEGAVGITLDCLGKYNELKIFGEIYMDIHHSFVGINENLKEIKRIYSHPQGYNQCRKFLESHELSAIEFVPSKSTANAAYLASQDKYAAAICSRIAAKLYNVPVLFDKIEDNAANKTRFLILSDIKNPKMPNCKTSILAHTAHKPGGLSFLLEQFKKENINLTKLESRPVKSKEFLHSFYIDFEGHIDDENVKKALKDIQEIVWLGSYLSGEKDEI

SEQ ID NO: 32605 - protein, 311 aa, Campylobacter jejuni subsp. jejuni NCTC 11168
MKIVCLDAATLGDYDLSVFEKFGSLQIYTTTNKEQTIERLKDANVAMTNKVVIDKDVIDACKNLKLILETATGVNNIDIEYAKEKGIIVKNAAGYSTMSVVQHTFAFMFAFLNQVLYYDKWSKEGKWCESPIFTDYSRILNTLSGKKHGIIGLGTIGKEVAKISKAFGAEIYYYSTSGANKNADFVHLELKDLLKTCDIISIHAPLNEKTKNLLAFEELKLLKDNAILINVGRGGIVNENDLAKIIDEKNIRVGLDVLEIEPMMKNHPLLSIKNKENLIITPHVAWASKEALNALMDIVYNNLKEWIENGK

SEQ ID NO: 32606 - protein, 480 aa, Campylobacter jejuni subsp. jejuni NCTC 11168
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVVNIDNQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGIDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQIAYYLQ

SEQ ID NO: 32607 - protein, 492 aa, Campylobacter jejuni subsp. jejuni NCTC 11168
MKQKCVLIITDGIGYNKNSKFNAFEAAKKPSYEKLFKEVPNSLLKTSGLAVGLPEGQMGNSEVGHMCIGSGRIIYQNLVRINKAIENKELEKNENLKKLLAKCKRVHIIGLYSDGGVHSMDTHFKAMLEICAKNGNEVFAHAITDGRDVSPKSGLNFIKDLKEFCENLGVHFATLCGRFYAMDRDKRWDRVKEYYECLLGKAYKVPNLLEYLQKSYDENVTDEFIKAAQNENYKGMREEDGIIFINFRNDRMKQLVEVLNSKDFKEFEREKIFENLLTMSVYDDKFKLPVLFEKEKIENTLAQVISKAGLSQLHTAETEKYAHVTFFFNGGKEELLENETRVLIPSPKVKTYDEKPQMSAFEVCDAVKKGIEKGEDFIVVNFANGDMVGHTGDFNATIKAVEAVDTCLGEILECAKKHDYAFIITSDHGNCEAMQDEKGNLLTNHTTFDVFVFVQARGVSKIKDNMGLSNIAASVLKILDLEIPKEMNEALF

SEQ ID NO: 32608 - protein, 215 aa, Campylobacter jejuni subsp. jejuni NCTC 11168
MYVAPSLLSANFLKLEEEVKAIEAAGADLLHIDVMDGHFVPNLTFGPCVIEKISTISKLPLDVHLMVKDVSKFVDLFISLKPKFISFHMESEVHPIRLCEYIRSQGIHPAIVLNPHTPIDSIKHMLEFVDMVLLMSVNPGFGGQKFLPLIHEKIKELRQMIDKKNAKVFIEVDGGVNGLNASDLEESGADILVAGSYIFSSNDYKTAISSLKLEF

SEQ ID NO: 32609 - protein, 253 aa, Campylobacter jejuni subsp. jejuni NCTC 11168
MSILKIENLQKYYGSHHALKDINLEVKAKEVVVILGPSGCGKSTLLRCINGLEEIASGNIYIDNEKIDKDFKEWPRMRQKVGMVFQSYELFEHLSVEENILLGPMKVQKRKKDEVLKEAKIWLEKVGLLHKIHAYPRELSGGQKQRIAIVRSLCMNPELMLFDEVTAALDPEIVREVLEVMLNLAKEGMTMLIVTHEMGFAKAVADKIIFMDEGKIIEENDPKSFFKNPKSERAKKFLNLFDYHNIDKNNIGL

SEQ ID NO: 32610 - protein, 393 aa, Campylobacter jejuni subsp. jejuni NCTC 11168
MQEQGKTRVLASIEINFTADYMDYTAEWARRYEGEIIQSDRANEHIYLYKSAIGVIGGILPWNFPFFLIARKMAPALLTGNTIVIKPSSETPNNAFEFAKLVSQSSLPKGVFNLVAGKGSVVGYELSSNENIGMVSLTGSVEAGTRVMEAAAKNIIKVSLELGGKAPAIVCKDADIDLAVEAIKASRICNNGQVCNCAERAYVHTSVYDEFVDKFVKAMSKVSVGNTLKGDFDMGPLVNQAGVDNALAMLQRATAKGAIVECGGKITDTSGYYFPASVLTNVKHEDEIMQKEIFAPILPIAKFDTLDEVIDMANDCEYGLTSSIYTQNLDIAMRASREIKFGETYINRENFEAMQGFHAGFRKSGIGGADGKHGLEEYLATHVVYLQYNTNKQ

SEQ ID NO: 32611 - protein, 156 aa, Campylobacter jejuni subsp. jejuni NCTC 11168
MENEKNYRPNVAAIVLSSSYPFECKIFIARRSDMDNIWQFPQGGIDKGESVKNALFRELKEEIGTDEVEIIAEYPEWLSYDFPSKIVKKMYPYDGQIQKYFLVRLKHGATININTKHPEFDDYQFVSVKQIFEMINHFKKNIYVRVIKYFEEKGYI

SEQ ID NO: 32612 - protein, 192 aa, Campylobacter jejuni subsp. jejuni NCTC 11168 [sequence omitted]

SEQ ID NO: 32613 - protein, 476 aa, Campylobacter jejuni subsp. jejuni NCTC 11168
MGKFVNNIDDFFKFCKQNEVLFVDFRFTDMIGTWHHITYNLHAINEETFQTGIPFDGSSIHGWQPIEKSDMILKPDAQSAFLDPFTADPTIIVFCDVYDIYKGQMYEKCPRSIAKKAIEHLKNSGIADTAYFGPENEFFVFDSVKIVDTTHCSKYEVDTEEGEWNDDREFTDSYNTGHRPRNKGGYFPVQPIDSLVDIRSEMVQTLEKVGLKTFVHHHEVAQGQAEIGVNFGTLVEAADNVQIYKYVVKMVAHLNGKTATFMPKPLYGDNGNGMHVHMSLWKNGVNLFYDKDGYSGLSQTAINYIGGILKNARSVAAFTNPSSNSYKRIVPGFEAPCILTYSCQNRSASCRVPYGIGKNSARIEIRFPDSTANPYLAFVSLLMAGLDGIKNKTIPVGPMDENLFDLTLDEIREKGIEQLPHTLRGSLEALIRHNSYLKPVMSDIFIDDYQHLKFETQVWPVEARPTAYEFKTCYSC

SEQ ID NO: 32614 - protein, 329 aa, Campylobacter jejuni subsp. jejuni NCTC 11168
MAYLKIKNFKKAYGDKIIFEDINFSAKKGEFITLLGPSGCGKSTLLRCIAGLSQINGGKISLNDKDLTKLSPQKRNIGMVFQNYALFPNLNVFENVAFGLKIKKMDKKDIEKRVKKMLKLVELEEYAKTYPHKLSGGQMQRVALARSLVIKPDLLLLDEPLSALDAKIRKYLRVQIKEIQKELELTTIFVTHDQEEALELSDTIILMNEGKIIQNSNANNLYLLPESHFVASFIGNYNILSPKELDSLGLKHDFKKDIALRPETIEISNEGLEAKIKEKSLLGNIIRYRVRVQEIEFKVDTLNFSTHSTYEAGDKIALKFNLSLAKELK

SEQ ID NO: 32615 - protein, 424 aa, Campylobacter jejuni subsp. jejuni NCTC 11168
MTNKKAFKETCKFIAGGVNSPVRAFANVQSEPKFISHGKGAYIFDIDGNSYIDYVQSWGPLLFGHCDKDIQKACQKALHKGSSFGAPTLLETELAKLVLSDFPHLEKIRFVSSGTEATMSAIRLARGFTKKDKILKFEGCYHGHSDSLLVSAGSGAATFNSPSSLGVLEDVAKHTLVAKYNDINSVKELFEKNKDIACVIIEPIAGNMGLVPAKQDFLEELAKICKNNQTLLIFDEVMSGYRASYLGSYGINHIQADIITFGKVIGGGLPAAAFASRAEIMDILSPLGGVYQAGTLSGNPLAMAAGIASLTKAKKKTKLYDKLGKLAKKLTQGMKKLADEKGLPLQACHVGSMFGYFFTKDPVSNYQDALKSDLALFSKFHKNMLENGIYLAPSQFETGFICSKMDDKIIDTTLEAVRESFKRI

SEQ ID NO: 32616 - protein, 242 aa, Campylobacter jejuni subsp. jejuni NCTC 11168
MIEVKNLQKKYGELEVLKNINTTISKGDVIAIIGPSGGGKSTFLRCINRLELADSGEILINKQNILDKEIDINKIRQKVSMVFQHFNLFANKNVMENLCLTPIKTGILSQEEAIKKAKLLLAKVGLADKENIMPHKLSGGQKQRIAIARSLMMNPDVILFDEPTSALDPEMIGEVLSIMKDVAKEGLTMLVVTHEMGFARNVANRIFFMDKGKIAVDASPKEVFENPSNERLREFLNKVLNH

SEQ ID NO: 32617 - protein, 299 aa, Campylobacter jejuni subsp. jejuni NCTC 11168
MKVHEKVSELIGNTPIIHLKKFGINVFAKCEFLNPSHSIKDRAAFEMIKDALDSKKINQDTTIVEATSGNTGISLAMICADLGLKFIAVMPESMSLERRKMITLFGARLELTPANLGMKGAVDKANEILLNTPNSFMVSQFENISNKNAHRKNTALEILRDLDNELDIFVAGFGTGGTISGVGEILKEKLEKVHIVGVEPLNSPLLSKGEAGSHKIQGIGANFIPAILNKEVIDEVITVSNEDAINTAKELAKSGLMVGISSGANVFAASMLAKKFPDKRILTMLNDTAERYLSTDLFA

SEQ ID NO: 32618 - protein, 1170 aa, Campylobacter jejuni subsp. jejuni NCTC 11168
MQKKSFLKIYGLIPFLLIAFINAFVDLGHKIIIQNTIYKAYEGSEQLFLNAIVNALILLPFILMLSPSGFLADKYPKNIVMKISAIFNVILTLIICICYYSGAFWMAFIFTFIMGAQAAIYSPSKYGFIKELVGKDFLAMGNGVINAVSIVAILAGMALFSLSFESLYSSMYNQTDEILKEVAPLGIVLILFSCIEVFFAWRLPKLKQTNKDLVFNKKDYIRGKLLINNLKLVFKNKTIWLCIIGISFFWAISQLYLVSFPVFAKNELFIENTFYVQISLAFSGIGVILGSLVAGKFSKNYIELGFIPLGALGMFLMAFLMPYFISLLSYSFLFFFFGFCGALFIIPLNTLIQFHAKENELGQILAGNNFFQNIAMLGFLLLATLFVKFEINVIYLFYFIALVTFIGSFYILLKLPFSLVRILLSIAFLQRYRLLVEGFENIPEKGGALLLGNHISFIDWAVVQMAIPRKIYFVMERSIYSKWYIKIFLDKFGIIPVSSTGSKTSLELIAKHIKEGNLVCLFPEGTLSRHGQLNEFKAGFELACECLSEDDGKIIPFYIRGLWGSAFSRSDEEFSARNRTLNKRKIAIAFGKAMPLHSKKDEVKAKVFELSFMAWKSQCEAMHTIARAWIDTAKKNLNQIAIIDTLAGDISYRKMLTLSLFLNFFIKRKSKELNINLQRGSYAPKEEAIGILLPASFASSLTNLSVLIAEKIAVNLNFTAGEKALKAAIKNAQISQIYTSKTFLEKLANKGINLNFDTNIHLIYFEDIVEDFKMQKTKIFSMMLAVSIIPSFILKSIFTPSKNNLAIAAILFSSGSEGSPKGVMLNNRNILSNIAQISDVLCTRNNDVILSSLPPFHAFGLTVTTFLPLLEGIKSITFSDPTDALGVAKAVAKNNVTIMCGTSTFLGIYARNKKLDALMFESLRIVVSGAEKLKNEVRTTFEMKFKKSIFEGYGATETTPVASVNLPNHFDVDYWLIHRANKEGSVGMPLPGTAVRIVDPNNYENLKTNEDGLILIGGHQVMVGYLNDKEKTDEVVKEIDGIRWYNTGDKGHLDEDGFLYIVDRYSRFAKIGGEMISLGAIEEEIAKFIDTEVVKFCATSLEDEKKEEQIVLLIECNNEIFEGVCEAIKNSNIPTLFKPRYYFQIEKIPLLGSGKVDLKKVKELAKNLAI

SEQ ID NO: 32619 - protein, 510 aa, Campylobacter jejuni subsp. jejuni NCTC 11168
MRALLSVSDKEGIVEFGKELENLGFEILSTGGTFKLLKENGIKVIEVSDFTKSPELFEGRVKTLHPKIHGGILHKRSDENHIKQAKENEILGIDLVCVNLYPFKKTTIMSDDFDEIIENIDIGGPAMIRSAAKNYKDVMVLCDPLDYEKVIETLKKGQNDENFRLNLMIKAYEHTANYDAYIANYMNERFNGGFGASKFIVGQKVFDTKYGENPHQKGALYEFDAFFSANFKALKGEASFNNLTDINAALNLASSFDKAPAIAIVKHGNPCGFAIKENLVQSYIHALKCDSVSAYGGVVAINGTLDEALANKINEIYVEVIIAANVDEKALAVFEGKKRIKIFTQESPFLIRSFDKYDFKHIDGGFVYQNSDEVGEDELKNAKLMSQREASKEELKDLEIAMKIAAFTKSNNVVYVKNGAMVAIGMGMTSRIDAAKAAIAKAKEMGLDLQGCVLASEAFFPFRDSIDEASKVGVKAIVEPGGSIRDDEVVKAADEYGMALYFTGVRHFLH

SEQ ID NO: 32620 - protein, 485 aa, Campylobacter jejuni subsp. jejuni NCTC 11168
MKIVKRALTFEDVLLRPGYSEVLPKEVKIHTKLTKNITLNMPLISAAMDTVTEHRAAIMMARLGGLGVIHKNMDIASQVREVKRVKKSESGVIIDPIFVSPKASVAEALEIMAEYRISGVPVVDEDKKLIGILTNRDLRFESDFSNLVENVMTKMPLITAPKGCTLDDAEKIFSTNKVEKLPIVDEQGRLEGLITIKDLKKRKEYPDANKDNFGRLRVGAAIGVGQMDRVDALVEAGVDVVVLDSAHGHSKGIIDTVKAIKAKYPNLDLIAGNIATAAAAKALCEAGVDAVKVGIGPGSICTTRIVSGVGVPQISAIDECVEEANKFGVPVIADGGIKYSGDIAKALAVGASSVMIGSLLAGTDESPGELFTYQGRQYKSYRGMGSLGAMQKGSSDRYFQQGTAQDKLVPEGIEGRVPYVGSIRSVVHQLLGGLRSSMGYVGAKDIEDFQKRAEFVEITTAGLKESHVHDVTITHEAPNYKVNHQ

SEQ ID NO: 32621 - protein, 330 aa, Campylobacter jejuni subsp. jejuni NCTC 11168
MNLPILDLQAYEKDKSTFLKNLREIASKIGFFYLINTSIDKNLNEKLFKLGKEFFNLSRSSKELISMVHSPQFRGYTSEGFEYTAGSKDYREQLDIGTERDALNWNLNSPLWQRLEGPNLWPSEIPELKKTFLTWHKQTKKACLKLLKAFAQALDLPNNAFDKLYGENSYEHCKIIHYPKSSKNITQGVGSHKDGGLITFVFQEKQSGFEAFIDGKWLSIPPLENSVVVNIGEFLELATNGYLKATIHRVNLSPKERFSIAYFLGVQLDKDIPIFKLNPELAKESKGVDTDPKNPLLRNVASNYFKRMIRSHPDVASIYHSDLIEKFSFA

SEQ ID NO: 32622 - protein, 446 aa, Campylobacter jejuni subsp. jejuni NCTC 11168
MAKNKALFECQACGNQQSKWLGKCPDCGAWDSFVELKAEQIKVLKELAQVSMKTSEAVCIEDVELEHFTRYSTDDNELDLVLGGGLVEGSLVLIGGSPGVGKSTLLLKIASNLAKQGKKVLYVSGEESKAQIKLRADRLEANTPNLFLLTELCLENILEELHKKDYSILIVDSIQTLYSNKITSAAGSITQVREITFELMRVSKAYNISTFIIGHITKEGAIAGPRVLEHMVDVVLYFEGDATKEIRLLRGFKNRFGGTNEVGIFEMTAKGLISAKDLANRFFTRGKAISGSALGVVMEGSRALVLEVQALVCESSYPKRSATGYEKNRLDMLLALLERKLEIPLGHYDVFVNISGGVKVSETAADLAVVAAIISSFKNRPLSKDSIFIGELSLNGEIREVFSLDTRLKEAKMQKFKNAIVPSKPLEDIGLKCFVAKELSQVLEWM

SEQ ID NO: 32623 - protein, 439 aa, Campylobacter jejuni subsp. jejuni NCTC 11168
MSFFKLKENNTSFKTEVIAGLTTFLAMVYIIPVNSSIVGNTGMPIEALITATALITIVASAFNAFFANTPVAMSVGMGLNAYFTFAVCLGQNIAWQSALGAVFISSIIFLILSFTHFRLWVIRNIPKDLRLAICAGIGCFIAFLGLSQMGVIMHNKDTLVSIGNFKSPHVLFGIFTLALIIFFWAIKLRGAFILGVLASSIIAWIFHLDNASFPVQIFSWPNFSMENGLGAIFLQLDIKSALNITMIPIILTFFITQLFDSIGTITGVGERGKIFDDPKNGEKKLSKTLMADATGSALGAMTGTSTVTAFVESTTGVESGGRTGLTALVVAICFAFTLFLLPLFKAIPANAIYPVLVMVGILMFMEVKNIDFKDSAIAVASFFTIIMMPFTYSITTGFAFGFLSYLLVRIFKREWDKINLGIIVLSLLSLGNFLLMALQ

SEQ ID NO: 32624 - protein, 348 aa, Campylobacter jejuni subsp. jejuni NCTC 11168
MEKYRELRKTDRVLSYGARGTTTNFELEKLICTLEGGYRAQLFPTGLAALAMVLLNYASKDAHFLITDAIYGPVRTICELFLDKIGVEIDFLKADASDIEEKIKPNTKLILCESPGSILYEIIDLPKLCKIAHAYNIPVAIDNTYSSGYFLNPLELGVDISVIAATKYLSGHSDVTMGIVVINEKEWKNFDKLPEALGFTTSPDDAYLVLRGMRTLDVRMKAHEKSADEIVEFLQSRKEIKTIFYPKLKSHPNHEIFMRDHKGANGMITIEFAEGYNKDDAIKFVDKLEYFSIGASWGGYESLATVTTPPRTATDLSARGLFVRFHIGLEDTKDLIADLTQAFDSIKK

SEQ ID NO: 32625 - protein, 223 aa, Campylobacter jejuni subsp. jejuni NCTC 11168
MIFAANLKCNHTRASFKIYAKILNKTMGVKCDDIIVFPPSIAFLENENNFIQGAQNFYPCVNGAFTGELGKEHLDEFGIKCVLIGHSERRALGDEEFIKAKFDFAKEHGYKIVFCIGENLDTKNSGKTLEFLKKQLEIIDLNYEKLIIAYEPIYSIGTGVSAQSTDIAKVLEFLASLTKVPLLYGGSVNENNIKEILSVNHCGGVLIGSAALKVENFIKLIKG

SEQ ID NO: 32626 - protein, 400 aa, Campylobacter jejuni subsp. jejuni NCTC 11168
MSDIISIKDIDLAKKKVFIRCDFNVPQDDFLNITDDRRIRSAIPTIRYCLDNGCSVILASHLGRPKEISSKYSLEPVAKRLARLLDKEIVMAKDVIGEDAKTKAMNLKAGEILLLENLRFEKGETKNDENLAKELASMVQVYINDAFGVCHRAHSSVEAITKFFDEKHKGAGFLLQKEIDFASNLIKHPARPFVAVVGGSKVSGKLQALTNLLPKVDKLIIGGGMAFTFLKALGYDIGNSLLEEELLEEANKILTKGKNLGVKIYLPVDVVAAPACSQDVPMKFVPAQEIPNGWMGLDIGPASVRLFKEVISDAQTIWWNGPMGVFEIDKFSKGSIKMSHYISEGHATSVVGGGDTADVVARAGDADEMTFISTGGGASLELIEGKELPGVKALRSKENE

SEQ ID NO: 32627 - protein, 1162 aa, Campylobacter jejuni subsp. jejuni NCTC 11168
MIQKALALAEELQGQIEANISNSEKEFHAKMQKLLNNPKNKVMLIELLDRSFRCKDKNASFELIEYTLSKYGIADFFSTFEKFLLFSFLNFGKFAPNLSVPFFVKHLREDTKAMVLDANPSVLEPHIKKRKEQDKITLNVNLIGEEVLGEAESKYRMQKYEEALKSSYITYISIKITTIFSQINIIDFNYSKEEVVKRLDYLYALALEEEKKQGVSKFINLDMEEFRDLELTVAAFMESVAKFDIKAGIVLQAYIPDSYKYLKKLFAFSKERVLKGMKSIKIRFVKGANMESEETIASQRGWELPTFYKKIDTDSNYNKMLDFILEGDNYKYINIGIASHNIFEIAYAYTRISEVGALDSFTFEMLEGMSLQCSYELSKMHDLILYTPVCDEAHFNNAIAYLVRRLDENTSEDNFMRYFFNLKVGDKNWNIQKELFLKSLEGIKTLDNTTHRKQDRNKESNIISSYEGKKFSNESDTDFILAQNRVWAKEIKTKYENLKDYDVYPVIGELDFKAENLNVLEVKDKIEDRVIGKAYLAGEKEIKQALEVAKNSKFTQKSHDEIYQILAKSAKLMRERRGDLIGLAALEVGKTFLEIDPEVSEAIDFIEFYPHSLEELKKQNPKVTFTPKGIGVTIAPWNFPIGISVGTIAAPLAAGNVVIYKPSSLSTLTGYMLCKCFWDSGIPKDALIFLPSKGSDISKYLLIDEAIKFSILTGGEDTAYAMLKANPTLLLSAETGGKNATIVSKFADRDSAIKNIIHSAFSNSGQKCSATSLLVLEEEVYHDEEFKKTLVDAASSMAVGNPFEFKNKLGTLADKPSSKVQKALDELQPYEEWALKPKFLEDNPYLMTPGIKYGTKKGDFTHMNELFVPILSVMKAKDLKEAIDIVNSTGYGLTAGFESLDEREWEYFHTHIEAGNIYINKPTTGAIVLRQPFGGIKKSAIGLGRKVGIYNYITQFLEIKQEDFDDHLIEDKFSKKLAQIDLKEAQDFINNLIKMSQSYAYHYKNEFSVSKDYVNIRGEDNLFSYTKIKNMVLRLCGNESLKDVLGVVLGANIANIDLSISYDEQDVSMIERIVQSIGAKVLFLKENKENFIKSIKEYERVRYLAKPDVNDEIYKEAAKLAKIIIREKPLLNGRFELLNYFNEKALSISFHRYGNLGIRAIS

SEQ ID NO: 32628 - protein, 406 aa, Campylobacter jejuni subsp. jejuni NCTC 11168
MLNNTLFFKQSEIHTISSYANRINDEVKSGDIGYYHLIDTSLNLIDESLQFIQDKEYVKNIVLVGMGGSSCGVKALRDMLFNEKSNQRELFILDNTSSHSFNKTLEKIKLEESLFLIISKTGSTIEVVSLFKLLIEHFKLDMQELKKYFVFITDKDSKLHQEGENLGIKCFFIPANVGGRFSILSAVGIVPLCFCGYNAKALLEGAKACFEDFFTHKKDEILQKAYHYCTHKNANINVLFSYSDAFKGFNEWYIQLIAESLGKKQGYKRIGLTPIALIGARDQHSFLQLIMDGPKNKTVTFLKIKDAQKAPIIPDIHFKFLDSLSNKVNLHELLNAQCDATMHALIAENLSVDVIELEKLDAWHAGYLMYYYELFTSTCGVMLGINTYDQPGVEVGKLILKNILNS

SEQ ID NO: 32629 - protein, 358 aa, Campylobacter jejuni subsp. jejuni NCTC 11168
MQYKILENNRIASKGYAMLSKDAKFTPFEFSRHAIGDNDILIKILYAGICHSDIHTARSEWGEATYPCVPGHEIAGEVIAVGKNVSKFKVGDYAGVGCMVNSCGECDACKRSQEQFCENGKTIFTYNSCDVFHGNENTYGGYSNNIVVSEKFAVCVPKDAPMEKVAPLLCAGITTYSPLKFSNIKEGSSVAVAGFGGLGMMAVKYAVKMGAKVSVFARNENKKADALAMGVSSFYTSCDKNAVKERFDLIISTIPTPYNPAIYLDLLKFGGEMAIVGLPPHEVAPSISVITFVHKAGKKVYGSLIGGIAETQEMLDFSLKHGIYPETELITPQEIDKAYENLTSGKAKFRYVIDMTKE

SEQ ID NO: 32630 - protein, 240 aa, Campylobacter jejuni subsp. jejuni NCTC 11168
MVIKAQNIITKFGEKIVHDGVSFEIKKNEIFGILGGSGSGKSVLLKQMLMLEHFDDGEYEILGYKLKNINEEDALALRKKWGVVFQFAALFSFFNVYENIAIPLKEYTHLDENSIQELVLMKLKMVGLNESVLKQFPSELSGGMQKRVAIARALALDSKLLFLDEPTSGLDPHSSREFDDLVLELKKSFDLNIILVTHDKESMKNLLDRFIILENKKVGFCGTYEELRLQNERLFKRFME

SEQ ID NO: 32631 - protein, 414 aa, Campylobacter jejuni subsp. jejuni NCTC 11168 [sequence omitted]

SEQ ID NO: 32632 - protein, 423 aa, Campylobacter jejuni subsp. jejuni NCTC 11168
MNFNKETLALHGAYNFDTQRSISVPIYQNTAYNFENLDQAAARFNLQELGNIYSRLSNPTSDVLGQRLANVEGGAFGIPVASGMAACFYALINLASSGDNVAYSNKIYGGTQTLISHTLKNFGIEAREFDIDDLDSLEKVIDQNTKAIFFESLSNPQIAIADIEKINQIAKKHKIVSICDNTVATPFLLQPFKHGVDVIVHSLSKYVSGQGTALGGALIERKDLNDLLKNNDRYKAFNTPDPSYHGLNLNTLDLPIFSIRVIITWLRDLGASLAPQNAWLLLQGLETLAVRIEKHSQNAEKVANFLNSHPDIKGVNYPTLASNAYHNLFKKYFDKNFASGLLSFEAKDYEHARRICDKTQLFLLAANLGDSKSLIIHPASTTHSQLSEEELQKAGITKATIRLSIGLENSDDLIADLKQAIES

SEQ ID NO: 32633 - protein, 443 aa, Pichia anomala
NSLYTALKDLFESMIEHESKTGVVSPSHLVETLKKENELFRSTMHQDAHEFLNFLLNEVIDTINNLHHCRKNALHDLFEGLLTNQTKCLTCENVSSRDETFLDLSIDLTDNETLETCLKQFSASEMLNGSNKFYCDNCHSLQEAEKKMGLRKLPKILALHLKRFKYSEEQQRNVKLFQKIKYPLYFKLESDIPAEKKEDGLKFYQLYGVVVHIGGGPHHGHYVALVKTIQHGWLLFDDETVEKIDEKFVLRFTGDSPDLATAYVLFYQEISEEKYEQVINKPVEEEVKPSEKDEIQEKVIRVNSNNNSISSSQPSTISSDTNKPIRPPPVSVVEPQDKNRLRTPSLSSIARLKSKSSQNTVTTTSTPASSISAPQAPLAKNVNDANTIDTPTPTPSNPQPITPTNNNPQSTSTSSSFWRRKEKEAKEAKVGSVEDKREGEKEE

SEQ ID NO: 32634 - protein, 303 aa, Methylobacillus flagellatus
MKLAIIGLGKMGGNMARRLLKHGIEVVGFDFNQDAVNQISLTNGMIPASSVEDAVSKLSGEPRKIVWIMLPSGDITENQIKDLVPLLSKGDIIVDGGNSNYKHSQRRGAWLAEHGIEFIDCGTSGGIWGLDNGYCLMYGGSKDAADAVVPIMQALAHADRGWAHVGPVGSGHFTKMIHNGIEYGMMQAFAEGLDLLKGKEEFNLDLAQITELWRHGSVVRSWLLDLTAEALAHDQELSAIAPYVADSGEGRWTVVEAVDQGVAAPVLTLALQMRFASQEDTGYSYKLLSMMRNAFGGHAVKTK

SEQ ID NO: 32635 - protein, 379 aa, Oryza sativa
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 32636 - protein, 500 aa, Medicago sativa
FLHLRPTPSAKSKALRHLPNPPSPKPRLPFIGHLHLLKDKLLHYALIDLSKKHGPLFSLSFGSMPTVVASTPELFKLFLQTHEATSFNTRFQTSATRRLTYDNSVAMVPFGPYWRFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRRGIVRRRENGEVVEGEASGVFLDTLLEFAEDETMEIKITKEQIKGLVVDLFSAGTDSTAVATEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 32637 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMAPFGPYWKFVRKLIMNDLLNATTVNKLRPLRTQQIRKFLRVMAQGAEAQKPLDLTEELLKWTNSTTSMMMLGEAEEIRDIAREVLKIFGEYSLTDFIRPLKHLKVGKYEKRIDDILNKFDPVVERVIKKRREIVRRRKNGEVVEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDSKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 32638 - protein, 500 aa, Medicago sativa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKLLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVIEGEVSGVFLDTLLEFAEDETTEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 32639 - protein, 500 aa, Vicia villosa
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSLVAMVPFGPYWKFVRKLIMNDLLNATTVNKLRPLRTQQIRKFLRVMAQGAEAQKPLDLTEELLKWTNSTISMMMLGEAEEIRDIAREVLKIYGEYSLTDFIWPLKHLKVGKYEKRIDDILNKFDPVVERVIKKRREIVRRRKNGEVVEGEVSGVFLDTLLEFAEDETTEIKITKDHIKGLVVDFFSAGIDSTAVATEWALAELINNPKVLEKAREEVYSVVGKDRLVDEVDTQNLPYIRAIVKETFRMHPPLPVVKRKCTEECEINGYVIPEGALILFNVWQVGRDPKYWDRPSEFRPERFLETGAEGEARPLDLRGQHFQLLPFGSGRGMCPGVNLATSGMATLLASLIQCFDLQVLGPQGQILKGGDAKVSMEERAGLTVPRAHSLVCVPLARIG

SEQ ID NO: 32640 - protein, 500 aa, Lens culinaris
FLHLRPTPTAKSKALRHLPNPPSPKPRLPFIGHPHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPRVLQKAREEVYSVVGKDILVDEVDTQNLPYIRAIVKETFRMHPPLPVVKRKCTEECEINGHVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 32641 - protein, 500 aa, Lens culinaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMVLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCTEECEINGCVTPEGALILFNVWQVGRDPKYWDRPSEFRPERFLETGAEGEARPLDLRGRHFQLLPFGSGRRMCPGVNLATSGMATLLASLIQCFDLQVLGPQGQILKGGDAKVSMEERAGLTVPRAHSLVCVPLARIG

SEQ ID NO: 32642 - protein, 500 aa, Lupinus albus
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVARVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEVVEGEVSGVLLDTLLEFAEDETMEIKITKDHIKGLVVDFFSAGTDSTAVATEWALAELINNPKVLERAREEVYSVVGKDRLVDEVDTQNLPYIRAIVKETFRMHPPLPVVKRKCTEECEINGYVIPEGALILFNVWQVGRDPKYWDRPSEFRPERFLETEAEGEARPLDLRGQHFQLLPFGSGRRMCPGVILATSGMATLLASLIQCFDLQVLGPQGQILKGGDAKVSMEERAGLTVPRAHSLVCVPLARIG

SEQ ID NO: 32643 - protein, 499 aa, Trifolium repens
SHLRPTPSAISKALRHLPNPPSPRPRLPFIGHLHLLKDKLLHYAPIDLSKKHGPLFSLSFGSMPTVVASTPELFKLFLQTHEATSFNTRFQTSAIRHLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVVTEWALAELINNPRVLQKAREEVYSVVGKDRLVDEVDTQNLPYIRAIVKETFRMHPPLPVVKRKCTEECEINGYVIPEGALVLFNVWQVGRDPKYWDRPSESRPERFLETGAEGEAGPLDLRGQHFQLLPFGSGRRMCPGVSLATSGMATLLASLIQCFDLQVLGPQGQILKGDDAKVSMEERAGLTVPRAHSLVCVPLARIG

SEQ ID NO: 32644 - protein, 500 aa, Trifolium repens
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDNSVAMVPFGPYWKFVRKLIMNDLLNATTVNKLRPLRTQQIRKFLRVMAQSAEAQKPLDVTEELLKWTNSTISMMMLGEAEEIRDIAREVLKIFGEYSLTDFIWPLKYLKVGKYEKRIDDILNKFDPVVERVIKKRREIVRRRKNGEVVEGEASGVFLDTLLEFAEDETMEIKITKEQIKGLVVDFFSAGTDSTAVATEWALAELINNPKVLQKAREEAYSVVGKDRLVDEVDTQNLPYIRAIVKETFRMHPPLPVVKRKCTEECGINGYVIPEGALVLFNVWQVGRDPKYWDRPSEFRPERFLETGAEGEAGPLDLRGQHFQLLPFGSGRRMCPGVNLATSGMATLLASLIQCFDLQVLGPQGQILKGDDAKVSMEERAGLTVPRAHSLVCVPLARIG

SEQ ID NO: 32645 - protein, 499 aa, Beta vulgaris
LHLRPTPTAKSKALRHLPNPPSPKPRLPFIGHLHLLKDKLLHYALIDLSKKHGPLFSHYFGSMPTVVASTPELFKLFLQTNEATSFNTRFQTSAIRRLTYDSSVAMVPFGPYWKFVRKLIMNDLLNATTVNKLRPLRTQQIRKFLRAMAQGAEARKPLDLTEELLKWANSTISMMMLGEAEEIRDIAREVLKIFGEYSLTDFIWPLKHLKVGKYEKRIDDILNKFDPVVERVIKKRREIVRRRKNGEVVEGEVSGVFLDTLLEFAEDETMEIKITKDHTKGLVVDFFSAGTDSTAVATEWALAELINNPKVLEKAREEVYSVVGKDRLVDEVDTQNLPYIRAIVKETFRMHPPLPVVKRKCTEECEINGYVIPEGALIPFNVWQVGRDPKYWDRPSEFRPERFLETGAEGEARPLDLRGQHFQLLPFGSGRRMCPGVNLATSGTATLLASLIQCFDLQVLGPQGQILKGGDAKVSMEERAGLTVPRAHSLVCVPLARIG

SEQ ID NO: 32646 - protein, 500 aa, Beta vulgaris
FLHLRPTPTAKSKALRHLPNPPSPKPRLPFIGHLHLLKDKLLHYALIDLSKKHGPLFSLYFGSMPTVVASTPELFKLFLQTHEATSFNTRFQTSAIRRLTYDSSVAMVPFGPYWKFVRKLIMNDLLNATTVNKLRPLRTQQIRKFLRVMAQGAEAQKPLDLTEELLKWTNSTISMMMLGEAEEIRDIAREVLKIFGEYSLTDFIWPLKHLKVGKYEKRIDDILNKFDPVVERVIKKRREIVRRRKNGEDVEGEVSGVFLDTLLEFAEDETMEIKITKDHIKGLVVDFFSAGTDSTAVATEWALAELINNPKVLEKAREEVYSVVGKDRLVDEVDTQNLPYIRAIVKETFRMHPPLPVVKRKCIEECEINGYVIPEGALILFNVWQVGRDPKYWDRPSEFRPERFLETGAEGEARLLDLRGQHFQLLPFGSGRRMCPGVNLATSGMATLLASLIQCFDLQVLGPQGQILKGGDAKVSMEERAGLTVPRAHSLVCVPLARIG

SEQ ID NO: 32647 - protein, 267 aa, Salmonella typhimurium
MAEPLTVSPELTANYAYFFDLDGTLAEIKPHPDQVVVPHKILQLLDRLAAHNAGALALISGRSMTELDALAKPFRFPLAGVHGAERRDINGKTHIVRLPEAVVREVEALLRSTLVALPGTELESKGMAFALHYRQAPEHEAALLALAQHVTQHWPQLALQLGKCVVEIKPKGTNKGEAIAAFMQEAPFAGRIPVFVGDDLTDEAGFGVVNHAGGISVKVGVGATQAAWRLESVPDVWRWLEQINYPQQEQQVMNNRRDGYESFSRSI

SEQ ID NO: 32648 - protein, 468 aa, Ticodendron incognitum
  misc_feature (237)..(237): Xaa can be any naturally occurring amino acid
  misc_feature (303)..(303): Xaa can be any naturally occurring amino acid
KASVGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCTEAIYKAQAETGEIKGHYLNATXGTCEEMIKRAVFARELGVPIVMHDYLTGGFTANTSLAHYCRDNGLLLHIHRAMHAVIDRQKNHGIXFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32649 - protein, 171 aa, Mycobacterium leprae
MRIAQHISDLIGGTPLVRLNSVVPAGTGVVAAKVEYFNSGGSSKDRIAAKMIDAAEASGQLKPGGTIVEPTSGNTGVGLALVAQHRGYKCVFVCPDKVSEDKRECAVGLRSRGSRMSDGRAARRSGQLLQRFRPVGRQDRRCLETRPVRQPSRTGQPLRDHWPGDLGRHRR

SEQ ID NO: 32650 - protein, 352 aa, Mycobacterium leprae
MVVVPAQHEPIAALRALRVGEEIDDDVALVATTSGTTGVPKGALLTAAALTASASATHDRLGGPGSWLLALPPYHIGGLQVLVRSVLAGSVPIELDISAGFDLAKLPDAVGRLGTGRRYTSLVATQLAKALTDSTATAVLAELDAVLVGGGPAPRPILDAATSAGIMVVGTYGMSETAGGCVYDGVPLDGVCIRVLVNGHVAIGGATLAKGYRNPIVPDPFAESGWFHTDDLGTVDGSGVLTVLGRADDAISTGGLTVLPGPVEAALCTHPAVSDCAVFGLTDDRLGQRVVAAVVLTDGYATPTLSMLRAHVTRRLDAMAAPRELHIVDTLPRRGIGKVDRTALVRRFAKSG

SEQ ID NO: 32651 - protein, 106 aa, Arabidopsis thaliana
MAKMVILRCVRRGLLLPVFNNLVSLSFGSTNKRGWKLLPLLIEQSPKLETLIIQSYTGDVTMPPFQVKMLHVHGYGGNAEEVERLHKFIGESECGEVVLGCGSCGG

SEQ ID NO: 32652 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCRYYTKSFRGSVDPFHVDAVDTTGAGDSFVGALLCKIVDDRAVLEDEARLREVLRLANACGAITTTKKGAIPALPTESEVQSLLKGN

SEQ ID NO: 32653 - protein, 259 aa, Arabidopsis thaliana
MAMPQANPQPSPFGNPFSGPGSGLIRSGLGAYGEKIFGSSSEYVQSNISRYFSDPQYYFQVNDQYVRNKLKIVLLPFLHRGHWTRISEPVGGRLSYKPPIYDINAPDLYIPLMAFGTYVVLAGLSLGLYGKFTPEALNWLFVKGMVGWFLQVMLLKITLLSLGSGEAPLLDIVAYAGYTFTGLCLAVLGKIIWGYSYYVLIPWTCLCTGVFLVKTMKRVLFAESRSYDSSRHHYLLIFVALAQFPLLIWLGNISVNWLF

SEQ ID NO: 32654 - protein, 444 aa, Lupinus luteus
MATIATIKARQIFDSRGNPTVEVDLTLSDGTFARAAVPSGASTGIYEALELRDGGSDYLGKGVSKAVDNVNTIIAPALIGKDPTEQTAIDNFIVQELDGTVNEWGWGKQKLGANAILAVSLAVCKAGASALKIPLYKHIANLAGNKNLVLPVPAFNVINGGSHAGNKLAMQEFMILPVGASTFKEALKIGVEVYHNLKSVIKKKYGQDAVNVGDEGGFAPNIQENKEGLELLKSAIAKAGYTDKVVIGMDVAASEFYTSDKKYVLNFKEDNNDGSQKISGEELKELYKSFVAEYPIASIEDPFDQDDWEHYGKITTEIGTEVQIVGDDLLVTNPKRVQKAIDSKSCNALLLKVNQIGSVTESIEAVKMSKKAGWGVMTSHRSGETEDTFIADLAVGLSTGQIKTGAPCRSERLAKYNQLLRIEEELGDEAVYAGVNYRNPVEPY

SEQ ID NO: 32655 - protein, 281 aa, Bacillus halodurans
MWENKFQKEGLTFDDVLLVPAKSEVLPRDVSVKTKLTETLQLNIPIISAGMDTVTEAKMAIAIAREGGLGIIHKNMSVEEQAEQVDRVKRSESGVITNPFFLTPDRQVFDAEHLMGKYRISGVPIVDEDQKLVGILTNRDLRFIEDYSTLIDDVMTKENLVTAPVGTTLKEAEEILQKHKIEKLPLVDESGTLKGLITIKDIEKVIEFPNSAKDSQGRLIVGAAVGVSADTDVRVAALVEAGVDVIVIDTAHGHSKGVLEKVKAIREQYPDLTIIAGNVAT

SEQ ID NO: 32656 - protein, 227 aa, Bacillus halodurans
MTSKSKGGRAMSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSS

SEQ ID NO: 32657 - protein, 475 aa, Morella cerifera
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTSYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMLKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 32658 - protein, 475 aa, Magnolia grandiflora
MSPQTETKASVGFKAGVKEYKLTYYTPEYETKDTDILAAFRVTPQPGVPPEEAGAAVAAESSTGTWTTVWTDGLTNLDRYKGRCYHIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAIFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLASQGNEIIREASKWSPELAAACEVWKEIKFEFKAVDTL

SEQ ID NO: 32659 - protein, 475 aa, Liquidambar styraciflua
MSPQTETKASVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32660 - protein, 341 aa, Arabidopsis thaliana
MTSLPYADADCSLRALAGRAEGFGRFAVGGLHGDLYVVTSLADLEIGYVWILDDGPGTLREGGRRKEPLWIVFAVSGTINLNSYLSVSSYKTIDGRGQRIKLTGKGIRLKECEHIIICNLEFEGGRGHDVDGIQIKPKSRHIWIDRCSLRDYDDGLIDITRQSTDITVSRCYFAQHDKTMLIGADPSHVEDRCIRVTIHHCFFDGTRQRQPRLRFGKVHLYNNYTRNWGIYAVCASVEAQVFSQCNIYEAGVKKKTFEYYSEKAADKEEARTGLVRSENDLFLNGAQPSLMTGASEECVFHPSEHYPTWTVEPPSETLKQIMQICTGWQSLSRPSDHGVPK

SEQ ID NO: 32661 - protein, 488 aa, Arabidopsis thaliana
MEKSWFNFMFSKGELEYRGELSKAMDSFAPGEKTTISQDRFIYDMDKNFYGWDERSSYSSSYSNNVDLLVSSKDIRNFISDDTFFVRDSNKNSYSIFFDKKKKIFEIDNDFSDLEKFFYSYCSSSYLNNRSKGDNDLHYDPYIKDTKYNCTNHINSCIDSYFRSYICIDNNFLIDSNNFNESYIYNFICSESGKIRESKNYKIRTNRNRSNLISSKDFDITQNYNQLWIQCDNCYGLMYKKVKMNVCEQCGHYLKMSSSERIELSIDPGTWNPMDEDMVSADPIKFHSKEEPYKNRIDSAQKTTGLTDAVQTGTGQLNGIPVALGVMDFRFMGGSMGSVVGEKITRLIEYATNQCLPLILVCSSGGARMQEGSLSLMQMAKISSVLCDYQSSKKLFYISILTSPTTGGVTASFGMLGDIIIAEPYAYIAFAGKRVIEQTLKKAVPEGSQAAESLLRKGLLDAIVPRNLLKGVLSELFQLHAFFPLNTN

SEQ ID NO: 32662 - protein, 332 aa, Schizosaccharomyces pombe
MRVVLFSSQSYDRGPFEEANKTFNHEIIYHNFSLNKDTVSLAGKAQVVCVFVNDQVDADTLKALAENGVKLVALRCGGYNNVNLKAASEYKITVVHVPSYSPFAVSEFTVGLLLSLNRKIHRAYVRVREDDFNIVGLLGCDIHGKTVGVIGTGKIGSNVAKCFKMGFGCDVLAYDINPDKKLENYGVQFVEQNEVLKKADFLCLHCPLTPSTTHIVNSDSLALMKKGVTIVNTSRGGLIDTKALVDAIDSGQVGGCAIDVYEGERNLFYKDLSNEVIKDSTFQRLVNFPNVLVTSHQAFFTTEALCSIAHTTLKSASDFYTNSLDESVIANK

SEQ ID NO: 32663 - protein, 332 aa, Schizosaccharomyces pombe
MRIAFFSAQPYEKEPFEKVNENYKHEIDYHESILNKKTAVLAEKAPVVCVFVNDKVDADTLKVLAKNGTKLIALRCAGFNNVDLKAAADNGITVVRVPAYSPYAVAEYTIGLLLSLNRKIHRAYVRVREDDFNLNGLLGHDLHGKTIGLLGTGRIGGLVAKCLKLGFGCEVLAHDIKPNKELEKFGIQFVEQQEVLAKADFLCLHCPLTPDTEHLVDEKLLASMKKGVKIINTSRGGLVDTKALVKAIESGQVGGCAMDVYEGERRLFYRDLSNEVIKDTTFQQLANFPNVLVTSHQAFFTAEALSAIAHTTLKNVSDFASQNNDPSVIVKN

SEQ ID NO: 32664 - protein, 360 aa, Penicillium citrinum
MTDPNPVTLPTPFSTIPRTPLLLGPSPIHPLPRTTADLAKNNPHPLVTIYAKRDDLNSGYAYGGNKTRKLEYLLADAQAQGCTTLVSIGGVQSNHTRQVAAVAARSGLKARLVQEHWVDWTDPGYESTGNIQLSRLMGADVRLDPSGFGIEHKNTVQRVVEEARGDGEKPYYIPAGASDHPLGGLGFARWAFEVREQEGEMGVFFDTVLVCAVTGSTFAGMIAGFKLLERLYPADAKRRVVGIDASATVEATRAQVLRIAKNTAAKIGLSEDDITEDDVMLDDRYHAGIYGVPDRQTWDAIEYAAKMEAFITDPVYEGKSFAGMMDMIRRGEIKGGNILYAHLGGQLALNAYSELGRTNE

SEQ ID NO: 32665 - protein, 127 aa, Citrus unshiu
MGSKLFLLLGLLMAIALLISSEVAARDLAETSIDHNEKADKATETHEIEDGRGGYNRGGRGGYNGGGRGGYGGGGGYGGGGGYGGGGGHGGGHCRYGCCGHGYHGGCRCCTYAGEAVDTEPETEPQN

SEQ ID NO: 32666 - protein, 167 aa, Citrus unshiu
MASADVEFRCFVGGLAWATTDSSLHEAFSAYGDILESKIINDRETGRSRGFGFVTFRDEKSMRDAIEGMNGQNLDGRNITVNEAQSRGSGGGGGGGYGSRGGGGYGGGGRRESGGGGGYGGSRGYGGGGGGYGGRREGGYSRDGGYGGDGGSRYSRSGASDGGSWRN

SEQ ID NO: 32667 - protein, 316 aa, Clostridium acetobutylicum ATCC 824
MNNVLCIGELLIDFICSDIDTTLSKGENFKKKAGGAPANVTAAISKLGGSASFLGKVGNDPFGHFLKETLDEVKVDTSMLIMDNNSSTTLAFVSLQANGERDFVFNRGADGLLRYDEINLDKVYSNKIIHFGSATALLGGEMTDTYLKIMEEAKKRGIIISFDPNYRDNLWENRTEEFIAISRKCIELADFVKLSDEELKIISGEKNIKNGVKLLASNNKVIAVTLGKEGTMISNGEEVEIIESIKIKSIDSTGAGDAFVGAFLYKLSEALEARDILSDFNKIKENVRFANKVGAIVCTKLGAISSLPSLSEVEGD

SEQ ID NO: 32668 - protein, 254 aa, Arabidopsis thaliana
MARKFFVGGNWKCNGTAEEVKKIVNTLNEAQVPSQDVVEVVVSPPYVFLPLVKSTLRSDFFVAAQNCWVKKGGAFTGEVSAEMLVNLDIPWVILGHSERRAILNESSEFVGDKVAYALAQGLKVIACVGETLEEREAGSTMDVVAAQTKAIADRVTNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 32669 - protein, 466 aa, Zygogynum sp. Qiu 90024
VGFKAGVKDYKLTYYTPDYQTKDTDILAAFRVTPQPGVPPEEAGAAVAAESSTGTWTTVWTDGLTSLDRYKGRCYHIEPVTGEEDQYIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFVFCAEALFKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHVHAGTVVGKLEGERDITLGFVDLLRDDYIQKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAASEVWKEIKFEFKAVDTLD

SEQ ID NO: 32670 - protein, 438 aa, Schizosaccharomyces pombe
MSAESLLHNTFSTEQIEVLENEYAAHNYHPLPVCFSKAKGAKVWDPEGREYLDFLSAYSAVNQGHCHPKIIEALVEQAQRVTLSSRAFYNDKFGPFAKYITEYFGYEMVIPMNTGAEAVETACKLARLWGYKAKKIPTDEAIILSCVDNFHGRTMGIISMSTDPDARDNYGPYLPNVGPKISGADRVLRYNNIEDLKYYLDTFGPKVAAFLVEPIQGEAGVMVPDDGYLEEAYKLCKAHNVLFIADEVQTGVARTGKMLCIEHSNVKPDVVILGKAISGGVYPVSAVLSSREIMLNFEPGTHGSTYGGNPLGAAVSIAALEVVKEEKLTERAAVLGEKFRTALIECKSPIVQKVRGRGLLNAVVIDESKTNGRTAWDLCLIMRSRGVLAKPTHGNIIRFSPPLVITEEDLMKGIEVIKKSLNDLPTIDMTPYAEKPIH

SEQ ID NO: 32671 - protein, 303 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQTILKLPGFSDNIFTHILAGLGAGFFAVCIGSPVDVMKSRMMGDSAYKSTFDCFIKTLKNDGLLAFYKGFIPNFGRLGSWNVIMFLTLEQVKKFFIKEVPN

SEQ ID NO: 32672 - protein, 268 aa, Symplocarpus foetidus
MGDHGPRTEISFAGSSRAAFAACFAELCTIPLDTAKVRLQLQKKAVTGDVVALPKYRGMLGTVATIAREEGLSALWKGIVPGLHRQCLFGGLRIGLYEPVKSFYVGDNFVGDIPLSKKILAGLTTGALAIIVANPTDLVKVRLQSEGKLPPGVPRRYSGALNAYSTIVKKEGLGALWTGLGPNIARNAIINAAELASYDQVKQMKSRMMGDSAYKSTFDCFIKTLKNDGPLAFYKGFIPNFGRLGSWNVIMFLTLEQVKKFFIKEVPN

SEQ ID NO: 32673 - protein, 402 aa, Streptomyces coelicolor A3(2)
MSNEELTERWQGTLMNNYGTPRLPLVRGEGARLWDADGKEYLDFVGGIAVNALGHAHPAVVDAVSRQIASLGHVSNLFIAEPPVALAERLLQHFGRDGKVYFCNSGAEANEGAFKIGRLTGRPHMVATRGGFHGRTMGALALTGQPGKQEPFLPLPGDVTHVPYGDPQALAAAVTEETALVIIEPIQGENGVVVPPPGYLKAARAITAATGALLVLDEVQTGVGRTGHWFEYQAHEGVLPDVVTLAKGLGGGLPLGATVAFGRAADLLQPGHHGTTFGGNPVACAAGLAVLDTIADEGLLDNVKRQSETLRGGVEALGHPLVAHVRGAGLLLGIVLTEPLAAQVQQAAQDAGILVNAPAPDVVRLMPALNLGDDVVEAFLGALPGILDQAAETAHGDGRSGE

SEQ ID NO: 32674 - protein, 436 aa, Thermus nonproteolyticus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGRGYPESPFQDPPPAPILSRDLEAIARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAH

SEQ ID NO: 32675 - protein, 318 aa, Prunus persica
METFPVVDLSQITGEKREAAMEKMNDACENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQLEVITNGKYKSVMHRVIAQPDGTRMSIASFYNPGDDAFICPAPALLEKETENISAYPKFVFDDYMKLYSGLKFHAKEPRFEAMKAMESTVNLDPVATV

SEQ ID NO: 32676 - protein, 367 aa, Lentinula edodes
MDDRTTAFIVGSSYQPLDIIGEGAYGVVCSAVHIQSQRKVAIKRITPFDHSMFCLRTLREIKLLRHFQHENIIGILDILKPNLGPDGSLDGMTEVYLVQELMETDLHRVIKTQELSDDHCQYFIYQTLRALKALHSADVLHRDLKPSNLLLNANCDLKLCDFGLARSASPLPDHPVDASTFMTEYVATRWYRAPEVMLTFKQYTKAIDKWSLGCVLAEMLSGKPLFPGRDYHHQLSLILDVLGTPTLDDFYAISSSRSREYIRALPFRKKKVFGKPVHEGGVKGFEGKNPLAIDLMEKCLSFNPKRRIDVEGALAHPYLAPYHDPSDEPGAERIDSEFWSFDTFNNGKGLSKEELKVLIYEEVMRGA

SEQ ID NO: 32677 - protein, 130 aa, Vitis riparia
MAYQQDPCANPTRQTGKTGGQTDQYGNPVHQTEALGAYGAGTGTGMHGGEHQQQPHQQPGVLHRSGSSSSEDDGQGGRRKKGMKEKIKERIPGMGRKDEQKQTSATSTPGQGQQQKGMMEKIKEKLPGAH

SEQ ID NO: 32678 - protein, 389 aa, Candida tropicalis
MQLIFFLVGLVVPFISALVLNAGSNFDDDNDRSGIISLDFQVHQVPSNRKRGFYRTQDLINQQIYYTADIFVGSNKQKQSVLVDTGSSDLWIIDSNSCSSITEQCKESGVYNPRTSKSSVNLTTPFSISYLDQSSAEGHWFLDKVKIAGATIKNQQFANAHTITQGIGGDIVCGGTLGLGFKGNEVADTEYDNVPITLKKQGFIKKSAYSIYLNSVSAQKGSILFGGIDHAKYTGELIAQPIAVEDYLALVLGSVKVNDEIFNVHQPALLDTGSSWTYLPQEIADTIADNLNATWISSEDNEYYSVRCDNVIGNITYTFDAGASITVQFADLVFRDTDGNCHLGIGRAPYFILGDNFLRSAYAVFNLDDKTISLAQIKYTNKCKIRAIM

SEQ ID NO: 32679 - protein, 394 aa, Candida tropicalis
MFLSQLVVFLVFGLLVTASPTTSPPGFISLDFVIIKTQKNIVPNENIIVSKRQPVPVTLIKEQIAYAAEITIGSNNQKQTVIIDTGSSDLWVVDKNATCVRRFEQQVQDFCKANGTYDPITSSSAKKLGTVFDISYGDKTNSSGNWYKDTIKIGGITITNQQFANVKSTSVAQGVMGIGFKTNEASNVTYDNVPITLKKQGIISKSAYSLYLNSSDSTTGEIIFGGVDNAKYTGKLIDLPVTSNRELRIYLNSLTIGVTNISASMDVLLDSGTTFSYLQQDVLQHVVDKFNGQLIHDALGNPLHLVDCDLPGNIDFEFSNSSKISVPSSEFAVKLYTINGELYPKCQLSILTSSANILGNNFLRSAYIVYDLEDKKISLAQVKYTSKSNILPLT

SEQ ID NO: 32680 - protein, 198 aa, Oryza sativa (japonica cultivar-group)
GQTPVFPRIFGHEAGGIVESVGEGVTDLAPGDHVLPVFTGECKECADCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGTDLNANRFEEARKFGCTEFVNPKDHDKPVQQ

SEQ ID NO: 32681 - protein, 198 aa, Oryza rufipogon
GQTPVFPRIFGREAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 32682 - protein, 198 aa, Oryza meridionalis
GQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 32683 - protein, 198 aa, Oryza officinalis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIGLNANRFEEARKFGCTEFVNPKDHDKPVQQ

SEQ ID NO: 32684 - protein, 198 aa, Oryza rhizomatis
GQTPVFPRIFGHEAGGIVESVGEGVTDLAPGDHVLPVFTGECKECPHCKSAESNMCDLLRINTDRGVMIGDGRSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 32685 - protein, 198 aa, Oryza latifolia
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVSLAAAEGARIAGASRIIGIDLNANRFEEARKFGCTEFVNPKDHDKPVQQ

SEQ ID NO: 32686 - protein, 198 aa, Oryza australiensis
GQTPMFPRIFGHEAGGIVESVGEGVTDLAPGDHVLPVFTGECKECPHCKSPESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNANRFEEARKFGCTEFVNPKDHDKPVQQ

SEQ ID NO: 32687 - protein, 198 aa, Oryza ridleyi
GQTPVFPRIFGHEAGGIVESVGDGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 32688 - protein, 198 aa, Oryza longiglumis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 32689 - protein, 198 aa, Oryza schlechteri
GQTPVFPRIFGHEAGGIVESVGEGVTDLALGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNANRFEEARKFGCTEFVNPKDHDKPVQQ

SEQ ID NO: 32690 - protein, 198 aa, Porteresia coarctata
GQTPVFPRTFGHEAGGIVESVGEGVTDLTPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 32691 - protein, 198 aa, Oryza longiglumis
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 32692 - protein, 198 aa, Oryza meyeriana
GQTPMFPRIFGHEAGGIVESVGEGVTDLSPGDHVLPVFTGECKDCPHCKSAESNMCDLLRINTDRGVMIGDGKSRFSINGKPIYHFVGTSTFSEYTVMHVGCVAKINPKAPLDKVCVLSCGISTGLGATINVARPPKGSTVAIFGLGAVGLAAAEGARIAGASRIIGVDLNANRFEEARKFGCTEFVNPKDHDKPVQQ

SEQ ID NO: 32693 - protein, 198 aa, Oryza granulata
GQTPMFPRIFGHEAGGIVESVGEGVTDLSPGDHVLPVFTGECKECPHCKSAESNMCDLLRINTDRGVMIGDGKSRFSINGKPIYHFVGTSTFSEYTVMHVGCVAKINPKAPLDKVCVLSCGISTGLGATINVARPPKGSTVAIFGLGAVGLAAAEGARIAGASRIIGVDLNANRFEEARKFGCTEFVNPKDHDKPVQQ

SEQ ID NO: 32694 - protein, 198 aa, Oryza brachyantha
GQTPVFPRIFGHEAGGIVESVGEGVTDLAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARISGASRIIGVDLNPNRFEEARKFGCTEFVNPKDHDKPVQQ

SEQ ID NO: 32695 - protein, 198 aa, Rhynchoryza subulata
GQTPMFPRIFGHEAGGIVESVGEGVTDLAPGDHVLPVFTGECKECPHCKSAESNMCDLLRINTDRGVMIGDGKSRFSINGKPIYHFVGTSTFSEYTVMHIGCVAKINPEAPLDKVCVLSCGISTGLGATINVAKPPKGSTVAIFGLGAVGLAAAEGARIAGASRIIGVDLNPNRFEEARKFGCTEFVNPKDHDKPVQQ

SEQ ID NO: 32696 - protein, 198 aa, Leersia perrieri
GQTPVFPRIFGHEAGGIVESVGEGVTDLAPGDHVLPVFTGECKECPHCKSPDSNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGARIAGASRIIGIDLNPNRFEEARKFGCTEFINPKDHDKPIQQ

SEQ ID NO: 32697 - protein, 198 aa, Zizaniopsis villanensis
GQTPVFPRIFGHEAGGIVESVGEGVTDLAPGDHVLPVFTGECKECPHCKSPDSNMCDLLRINTDRGVMIGDGKSRFSINGKPIYHFVGTSTFSEYTVMHVGCVAKINPEAPLDKVCVLSCGISTGLGATINVAKPPKGSTVAIFGLGAVGLAAAEGVRIAGASRIIGIDLNPNRFEEARKFGCTEFINPKDHDKPIQQ

SEQ ID NO: 32698 - protein, 214 aa, Paeonia sinjiangensis
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARMAGASRIIGVDLNPKRFDEARKFGVTEFVNPKDYNKPVQEVIAEMTGGGVDRSVECTGSIMAMMSAFECVHD

SEQ ID NO: 32699 - protein, 214 aa, Paeonia sinjiangensis
IVESVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 32700 - protein, 214 aa, Paeonia sinjiangensis
IVEGVGEGVTDVKPGDHVLPIFTGECKECRHCKSEESNMCDLLRINTDRGVMLNDGKSRFSINGQPIFHFVGTSTFSEYTVLHVGCLAKINPEAPLDKVCVLSCGISTGLGATLNVAKPNKGSTVAIFGLGAVGLAAAEGARIAGASRIIGVDLNPERFDEARKFGVTEFVNPKDYNKPAQEVIAEMTGGGVDRSVECTGSIMAMMSAFECVHD

SEQ ID NO: 32701 - protein, 214 aa, Paeonia arietina
IVESVGEGVTDVKPGDHVLPIFTGECKECRHYKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 32702 - protein, 214 aa, Paeonia humilis
IVESVGEGVTDVKPGDHVLPIFTGECKECRHYKSEESNLCDLLRINTDRGVMLNDGKSRFFINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 32703 - protein, 214 aa, Paeonia humilis
IVESVGEGVTDVKPGDHVLPIFTGECKECRHCKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 32704 - protein, 214 aa, Paeonia humilis
IVESVGEGVTDVKPGDHVLPIFTGECKECRHYKSEESNLCDLLRINTDRGVMLNDGKSRFSINGQPIFHFVGTSTFSEYTVLHVGCLAKINTEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSIECTGSIMAMMSAFECVHD

SEQ ID NO: 32705 - protein, 214 aa, Paeonia officinalis
IVESVGEGVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTGGGVDRSVECTGSIMAMMSAFECVHD

SEQ ID NO: 32706 - protein, 214 aa, Paeonia parnassica
IVESVGEGVTDVKPGDHVLPIFTGECKECRHCKSEESNLCDLLRINTDRGVMLNDGKSRFSINGQPIFHFVGTSTFSEYTVLHVGCLAKINPEAPLDKVCVLSCGISTGLGATLNVAKPKKGSTVAIFGLGAVGLAAAEGARIAGASRIIGVDLNPKRFDEARKFGVTEFVNPKDYNKPVQEVIAEMTDGGVDRSVECTGSIMAMMSAFECVHD

SEQ ID NO: 32707 - protein, 489 aa, Gibberella pulicaris
MSAKSILEADGKAILNYHLTRAPVIKASPLPAPTTHNPPSRLASLHFPEDANVADILNQAEVTYPWLLQPDAKFVAKPDQLIKRRGKSGLLALNKSWPEAKAWVAERAGKEQQVEHTTGVLRQFLVEPFVPHPQDTEYYININSVRDATGILFTHEGGVDVGDVDAKAEKLLIPVDLAEYPSNEEIAATLLKKVPQGVHNVLVDFITRLYAVYVDCQFTYLEINPLVVIPNEDKTSAEVHFLDLAAKLDQTADFECGVKWAIARSPAALGLTNIAPSADGKISIDAGPPMEFPAPFGRELTKEEAYIADLDAKTGASLKLTVLNAKGRIWTLVAGGGASVVYADAIASAGFADELANYGEYSGAPTESQTYHYARTVLDLLLRAPKTDEGKVLFIGGGIANFTNVASTFKGVIRALRDFAPKLVEHKTAIWVRRAGPNYQEGLKNMKAATQELGLDAKIFGPEMHVSGIVPLALVPGKWEESKAQEFQG

SEQ ID NO: 32708 - protein, 143 aa, Oryza sativa
  misc_feature (3)..(3): Xaa can be any naturally occurring amino acid
QKXMVPLFRRIAQCIKSSHFQVAERALFIWNNDNVISLIAQNRQMIMPIIVPALEHNSQNHWNQAVLNLTDNVKKMFSEMDDVLFSACLVKYKEDEERQASLESKRRLTWEKLESAASFQPVTGHTAVLVGCQPSANLIATLI

SEQ ID NO: 32709 - protein, 422 aa, Streptomyces coelicolor A3(2)
MASTTTSGTPAQTGRAVGGTWTVILCWITVLLEGYDLVVLGAIIPTLLKTHHLGMTAGDATTIATLSLVGVAIGAVCVGPLADRLGRRRLLIGSVVLFSVLTVVVPLANSVAMFAALRLLAGLGLGACMPVSLTMMAEHMPASRRARASTLTMTGYHTGAVITSLLALQVTDNWEILFYLLGVVGLVIAAIQWFKLPESAAFERARRDGAQRVPFTELLKPAYLRAGIGIWVASFMGLLLVYGLNTWLPKLMNDAGYPVPTAVTQLLVLNIGGVVGLVLGGYVADRRGIKGTTMVWFAVSVLMLGCLSVKMASDLLLNVVVFFTGVFVFSAMVLVYAYVTHFYPASVRGTALGSASGIGRIGSIVGPSITGALVASGVGHPWGFYFFAAVAVLGFLAVLTLPRGGAEPAGAAAAAPPAAPAG

SEQ ID NO: 32710 - protein, 484 aa, Streptomyces coelicolor A3(2)
MTLLDSAVWGGKFSSDGWQGSPTEQPVTEPATGDRLGTVGLASAEDVNRAAARAAEAQRTWAATSPQRRAAVLRRAGELFTEHAAEIEDWLVREAGSVRSKAAFEAGLAIGECFECAGLPTHPQGEVLTSEDARWSLARRRPAGVVSVIAPFNFPLILGLRSVAPALALGNSVLLKPDPRTAVSGGVVIARIFEEAGLPAGVLHLLPGDGSVGRAVVEAPEVRVISFTGSTPVGRAIGEQAGRLLKRAHLELGGNNALVVLPGADVAKAASAGAFGSYLHQGQICMTTGRHIVHESLVEEYTAALAAKAEALPVGDPAREDVALGPIIDRRQLERVHGIVTDSVAAGAKVAAGGEIDGAGYRATVLTGLTTDMPAWREEIFGPVAPVISFATTEEAARIVNDCEYGLSVGILGDVGTAMKLADRIDSGKVHINEQTVSDEPNAPFGGVKASGTGSRFGGAAANVEAFTETQWLTVRPDIADYPF

SEQ ID NO: 32711 - protein, 481 aa, Sordaria macrospora
MSAKSILEADGKAILNYHLTRAPVIKPSTLPNPTKHNPPPRLASLHFAEDADVNGVLSQAEVTYPWLLQDGARFVAKPDQLIKRRGKSGLLALNKTWPEAKAWIAERAGKAQKVEHTEGVLRQFLVEPFVPHPQETEYYINGDWILFYHEGGVDVGDVDAKAEKILIPVDLSQYPSNEELASTLLKHVPKGIHNVLVDFIARLYAVYVDCQFTYLEINPLVVIPNEDATSAEVHFLDLAAKLDQTADFECGNKWAIARSPAALGIVAQSSNGGVNIDAGPPIEFPAPFGRELTKEEAYIAELDAKTGASLKLTVLNPNGRIWTLVAGGGASVVYADAIASAGFADELANYGEYSGAPTESQTYHYARTVLDLMLRAPVSEQGKVLFIGGGIANFTNVASTFKGVIKALREYGKALIEHNTQIWVRRAGPNYQEGLKNLKAATQELGLNAKIFGPEMHVSGIVPLALVPGKWEESGAVEFQA

SEQ ID NO: 32712 - protein, 355 aa, Schizosaccharomyces pombe
MPIDTPLIPHKPISRYRSGRLEGLESESSSESDYEEVSDSHDQENSISSSRHVITPVFEKEGISETKTSSNFQNINPVQTIDNSASEYETDASSAEGGSNSAASSSEEEDSSDSEYEMELRRRTLLLPPKFTSKVIKNRAKANEEDTEVLKKVTSQKILEETIKRELLLKETKNNNELLNDIDDTDGIDPQSEYELWKLRHLLRKKRDKEKSLELEREKMAIEERRLMNSEEREAQDLKDAEASRRGKKKSSMQFLQKYYHKGAFYQNEDIVSKRDYSEATEGEVLNKDLLPKPMQIRGDLFAKAGQTRWTHLANEDTTKEGSAWYDPKNPILQKNLHRLGGLHSDSPLSKRKRT

SEQ ID NO: 32713 - protein, 352 aa, Schizosaccharomyces pombe
MLSREEQNRCFVPVRRILDNEDLKLFKEGDAYKLIDSFICDLDEAVKDKPISASIPQSSSIEHVLNILDRVGEIKQENPAIDNMGSRFGNPAFQSFYDQVYIETPKLHQVFGIEHNAAMEAGRYFYESFGNRKRIDYGSGHELYFMSWLLILKQLGIFTKNDYPALVVRVFVKYVELMRSLQIFYTLEPAGSHGVWGLDDFHFLPFLFGAAQLVNHKYLRPKHVRDPEILEMCRADYMYLGYVYFLNKLKPSVSLRFHSPMIDDISAVKTWSKVNEGMIKMYRAEVLGKLPIMQHYLFGHLIPASPGMSPAPQDGDDSEVTHVHSHYADCCGIKIPSAISAAKNNGSRIPFD

SEQ ID NO: 32714 - protein, 249 aa, Schizosaccharomyces pombe
MARKFFVGGNFKMNGSLESMKTIIEGLNTTKLNVGDVETVIFPQNMYLITTRQQVKKDIGVGAQNVFDKKNGAYTGENSAQSLIDAGITYTLTGHSERRTIFKESDEFVADKTKFALEQGLTVVACIGETLAEREANETINVVVRQLNAIADKVQNWSKIVIAYEPVWAIGTGKTATPEQAQEVHAEIRKWATNKLGASVAEGLRVIYGGSVNGGNCKEFLKFHDIDGFLVGGASLKPEFHNIVNVHSL

SEQ ID NO: 32715 - protein, 335 aa, Schizosaccharomyces pombe
MQQTYKPNTSALKDGAPKATVDQKQLLPCKYRVGRVLGGGTYATVREAVHIETNKMYAAKIMNKKMMEKKQDFVKNEIAILKRVSYEHPNILHLVDFFETVNNLYLITELATGGELFDRICAKGSFYEADAAALMRTTTSAVKYLHDNGIVHRDLKPENLLYRSKDPNSDLLIADFGLSHFYEDSQYYMLMTACGTPEYMAPEVFRRTGYGKPVDMWAIGVITYFLLSGYTPFARPSQVEVIEAILANEYTFNDPCWSGISETAKDFIKKCLENDPSKRLTAADALKHPFLSEKRPATSNLLPNVRENFNARKTFRTAYNAVRAFNTWKKLENKH

SEQ ID NO: 32716 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIQGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 32717 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDTNEMCAFVRQTIADLSSKEVSEATRIQYGGSVKPNNIKEYMAQTDIDGALVGGA

SEQ ID NO: 32718 - protein, 134 aa, Staphylococcus aureus
HETDEEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 32719 - protein, 134 aa, Staphylococcus aureus
HETDEEINKKAHAIFKHGMTPIICVGETDEERESGKANDVVGEQVKKAVAGLSVDQLKSVVIAYEPIWAIGTGKSSTSEDANEMCAFVRQTIADLSSKEVSEATRIQYGGSVKPNNIKEYMAQTDIDGALVGGA

SEQ ID NO: 32720 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEVTRIQYGGSVKPNNIKEYMAQTDIDGALVGGA

SEQ ID NO: 32721 - protein, 134 aa, Staphylococcus aureus
HETDKEINKKAHAIFKHGMTPIICVGETDEERESGKANDVVGEQVKKAVAGLSENQLKSVVIAYEPIWAIGTGKSSTSEDANEMCAFVRQTIADLSSKEVSEATRIQYGGSVKPNNIKEYMAQTDIDGALVGGA

SEQ ID NO: 32722 - protein, 134 aa, Staphylococcus aureus
HETDEEINKKAHAIFKYGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 32723 - protein, 134 aa, Staphylococcus aureus
HETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGA

SEQ ID NO: 32724 - protein, 134 aa, Staphylococcus aureus
HETDEEINKKAHAIFKHGMTPIICVGETDEERESGKANDVVGEQVKKAVAGLSEEQLKSVVIAYEPIWAIGTGKSSTSEDANEMCAFVRQTIAGLSSKEVSEATRIQYGGSVKPNNIKEYMAQTDIDGALVGGA

SEQ ID NO: 32725 - protein, 134 aa, Staphylococcus aureus
HETDEEINKKAHAIFKHGMTPIICVGETDEERESGKANDVVGEQVKKAVAGLSEDQLKSVIIAYEPIWAIGTGKSSTSEDANEMCAFVRQTIADLSSKEVSEATRIQYGGSVKPNNIKEYMAQTDIDGALVGGA

SEQ ID NO: 32726 - protein, 197 aa, Oryza rufipogon
GQTPVFPRILGHEAGGIVESVGEDVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVH

SEQ ID NO: 32727 - protein, 197 aa, Oryza nivara
GQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCIFSCGFSTGFGATVNVAKPKKGQTVAIFGLGAVGLAAMEGARLSGASRIIGVDLNPAKFEQAKKFGCTDFVNPKDHSKPVH

SEQ ID NO: 32728 - protein, 197 aa, Oryza meridionalis
GQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVH

SEQ ID NO: 32729 - protein, 197 aa, Oryza eichingeri
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32730 - protein, 197 aa, Oryza punctata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAALEGARLSGASRIIGVDLNPAKFEQAKKFGCTDFVNPKDHSKPVH

SEQ ID NO: 32731 - protein, 197 aa, Oryza minuta
GQTPVFPRILGHEAGGIVESVGEGVTELAPGDHVLPVLTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32732 - protein, 197 aa, Oryza officinalis
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATVNVAKPKKGQTVAIFGLGAVGLAAMEGARLSGASRIIGVDLNPAKFEQAKKFGCTDFVNPKDHSKPVH

SEQ ID NO: 32733 - protein, 197 aa, Oryza rhizomatis
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGIFTGLGATLNVAKPKKGQTVAIFGLGAVGLAAMEGARLSGASRIIGVDLNPAKFEQAKKFGCTDFVNPKDHSKPVH

SEQ ID NO: 32734 - protein, 197 aa, Oryza grandiglumis
GQTPVFPRILGHEAGGIVESVGEGVTELAPGDHVLPVFTGECKECAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32735 - protein, 197 aa, Oryza latifolia
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGRLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32736 - protein, 197 aa, Oryza grandiglumis
GQTPVFPRILGHEAGGIVESVGEGVTELAPGDHVLPVFTGECKECAHCKSEESNMCDLLRINVDRGVMIGDGQSRFTINGKPIFHFVGTSTFGEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32737 - protein, 197 aa, Oryza australiensis
GQTPVFPRILGHEAGGIVESVGEGVTELTPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVH

SEQ ID NO: 32738 - protein, 197 aa, Oryza schlechteri
GQTPVFPRILGHEAGGIVESVGEGVTELVPGDHVLPVFTGECKDCAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVQ

SEQ ID NO: 32739 - protein, 197 aa, Porteresia coarctata
GQTPVFPRILGHEAGGIVESVGEGVKELVPGDHVLPVFTGECKDCAHCKSEESNMCDLLRINVDRGVMIGDGQSRFTIKGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHSKPVQ

SEQ ID NO: 32740 - protein, 197 aa, Porteresia coarctata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHKKPVQ

SEQ ID NO: 32741 - protein, 197 aa, Oryza schlechteri
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLSGASRIIGVDLNPAKFEQAKKFGCTDFVNPKDHKNPVQ

SEQ ID NO: 32742 - protein, 197 aa, Oryza meyeriana
GQTPVFPRILGHEAGGIVESVGEGVTELVPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLPGASRIIGVDLNPAKYEQAKKFGCTDFVNPKDHSKPVQ

SEQ ID NO: 32743 - protein, 197 aa, Oryza granulata
GQTPVFPRILGHEAGGIVESVGEGVTELVPGDHVLPVFTGECKECAHCKSEESNMCDLLRINVDRGVMIGDGQSRFTINGKPIFHFVGTSTFSEYTVIHVGCLAKINPEAPLDKVCILSCGISTGLGATLNVAKPKKGQTVAIFGLGAVGLAAMEGARLFGASRIIGVDLNPAKYEQAKKFGCTDFVNPKDHSKPVQ

SEQ ID NO: 32744 - protein, 197 aa, Oryza brachyantha
GQTPVFPRILGHEAGGIVESVGEGVTELAPGDHVLPVFTGECKECAHCKSEESNMCDLLRINVDRGVMIGDGQSRFTIGGKPIFHFVGTSTFSEYTVIHVGCLAKINPEAPLDKVCILSCGISTGLGATVNVAKPKKGQTVAIFGLGAVGLAAMEGARLSGASRIIGVDLNPAKFEQAKKFGCTDFVNPRDHKKPVQ

SEQ ID NO: 32745 - protein, 197 aa, Rhynchoryza subulata
GQTPVFPRILGHEAGGIVESVGEGVTELAPGDHVLPVFTGECKECAHCKSEESNMCDLLRINVDRGVMIGDGQSRFTINGKPIFHFVGTSTFSEYTVIHVGCLAKINPEAPLDKVCVLSCGISTGLGATLNVAKPTKGSTVAIFGLGAVGLSAMEGARLSGASRIIGVDLNPAKYEQAKKFGCTDFVNPKDYNKPVQ

SEQ ID NO: 32746 - protein, 197 aa, Leersia perrieri
GQTPVFPRILGHEAGGIVESVGEGVTELAPGDHVLPVFTGECKECAHCKSEESNMCDLLRINVDRGVMIGDGKSRFTINGKPIFHFVGTSTFSEYTVIHVGCLAKINPEAPLDKVCILSCGISTGLGATLNVAKPKKGSTVAIFGLGAVGLAAMEGARLSGASRIIGVDLNPAKYEQAKKFGCTDFVNPKDHKKPVQ

SEQ ID NO: 32747 - protein, 197 aa, Zizaniopsis villanensis
GQTPVFPRILGHEAGGIVESVGEGVTELAPGDHVLPVFTGECRECAHCKSEESNMCDLLRINVDRGVMIGDGKSRFTINGKPIFHFVGTSTFSEYTVIHVGCLAKINPEAPLDKVCILSCGISTGLGATLNVAKPKKGSTVAIFGLGAVGLAAMEGARLSGASRIIGVDLNPAKYGQAKKFGCTDFVNPKDHKKPVQ

SEQ ID NO: 32748 - protein, 323 aa, Salmonella enterica subsp. enterica serovar Ohio
MSKIFEDNSLTIGHTPLVRLNRIGNGRILAKVESRNPSFSVKCRIGANMIWDAEKRGVLKPGVELVEPTSGNTGIALAYVAAGRGYKLTLTMPETMSIERRKLLKALGANLVLTEGAKGMKGAIQKAEEIVASNREKFLLLQQFNNPANPEIHEKNTGPEIWGETDGQVGLFISGVGAGGTLNGVGRFLKSPRGKKNLITVAGEPTDSPVIPQALAGEELKPGPHKIQGIGAGFIPGNLDLKLVDKVIGITNEEAISTARRLMEEEGILAGISSGAAVAAALKLQEDEAFTNKNIVVTLPSPGERYLSTALFADLFTEKELQQ

SEQ ID NO: 32749 - protein, 191 aa, Suillus bovinus
MQTIKVVVVGDGAVGKTCLLISYTTNKFPSDYVPTVFDNYAVTVMIGEDPYTLGLFDTAGQEDYDRLRPLSYPQTDVFLVCFSVTSPPSFENVREKWIPEVHHHCPGVPCLIVGTQIDLRDDAQVIEKLSRQKQRPVPTEHGERLSRELGAVKYVECSALTQKGLKNVFDEAIVAALEPPVVKKTHKCVVV

SEQ ID NO: 32750 - protein, 194 aa, Suillus bovinus
MHNIKCVVVGDGAVGKTCLLISYTTNAFPGEYVPTVFDNYSANVMVDGKTISLGLWDTAGQEDYDRLRPLSYPQTDVFLICFSLVSPPSYENVRTKWWPEISHHAPSTSVVLVGTKLDLREDPATIEKLRDRRMQPIQYTQGVSMARDIGAVKYLECSALSQKGLKTVFDEVIRAVLNPPPKEKKRSGRGCVIV

SEQ ID NO: 32751 - protein, 441 aa, Oryza sativa (indica cultivar-group)
MDVEGEVPAAAAEAVANGLGGAEPSPAPVSAEQLDVEAYAAQYTGRTRLARLLFIAERCGVEAVELEALRMAYDEIKRGEDTMFHREVTNKINGRLGPKYALDQAWTDSVNRRAEQRKEKLESELNGYRTNLIKESIRMGYNDIGDFFYAHGHLSDAFKSYIRTRDYCTTSKHIVQMCMNVILVSIELGQFPHVSNYVSKAEQTPDTLDPIIVAKLRAAAGLAYLATKKYKLAARNFVETGHELGNNYSEVIAPQDVAVYGALCALASFDRSDLKSKVIDNSNFRNFLELVPEVRELVNDFYSSRYGSCLEHLEKLKTNLLLDIHLHDHVETLYMDIRHKAIIQYTLPFISVDLNTMAAAFMTSVSMLEKEVAALITENKIQARIDSHNKILYARHADQRNATFQRVLQTGNEFERDVKSLLLRANLIKHDFNQRAGQRKM

SEQ ID NO: 32752 - protein, 168 aa, Cucumis melo
MLVYQDLVSGDELLSDSFPYKEIENGMIWEVEGKWVVKGAVDVDIGANPSAEGGGEDEGVDDQAVKVVDIVDTFRLQEQPSMDKKVFLSCIKKYIKKLTPLLQGEQQEAFKNKIEGAVKYLLPKVKDLQFFVGESMADDSAMVFAYYKEGATDPTFLYIAPGLKEVKC

SEQ ID NO: 32753 - protein, 483 aa, Streptomyces coelicolor A3(2)
MQHVRFLNDIQPSYDLTYDDVFMVPSRSAVGSRQGVDLGSPDGTGTTIPLVVANMTAIAGRRMAETVARRGGLVVIPQDIPIEVVTDVVSWVKSRHHVLDTPIVLAPHQTVADALALLPKRAHNAGVVVDEDGKPVGVVTDTDLNGVDRFTQLEEVMSKDLILIDADLDPREAFNTLDAANRRYAPAVDKDGRLAGILTRKGALRATLYTPAVDAQGRLRIAAAVGINGDVAGKAKQLLDAGVDTLVIDTAHGHQESMISAVKVVRDLDPRVPIVAGNIVSAQGVRDLIEAGADIIKVGVGPGAMCTTRMMTGVGRPQFSAVLECAAEAKKYGKHVWADGGVRHPRDVAMALAAGASNVMVGSWFAGTYESPGDLQHDANGRAYKESFGMASARAVRNRTSEESAYDRARKALFEEGISTSRMFLDPARPGVEDLIDAIIAGVRSSCTYAGAGSLEEFTEKAIVGIQSAAGYAEGKPLHASWS

SEQ ID NO: 32754 - protein, 228 aa, Streptomyces coelicolor A3(2)
MAAQINPSILSADFARLADEAKAVEGADWLHVDVMDNHFVPNLTLGVPVVESLARATDTPLDCHLMIEAPDRWAPQYVEAGAGSVTFHAEAAAAPVRLAREIRAKGARASMALKPATPVEPYEDLLPELDMLLIMTVEPGFGGQAFLDIMLPKIRRTRELIKKHGLELWLQVDGGVSAATIERCADAGADVFVAGSAVYGASDPAEAVRALRTQADAATAEASWSCDH

SEQ ID NO: 32755 - protein, 283 aa, Raphanus sativus
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 32756 - protein, 283 aa, Raphanus sativus
MAKDVEGAEGVTARDYEDPPPTPFFDAEELTKWSLYRAVIAEFVATLLFLYITVLTVIGYKISSDTKAGGDECGGVGILGIAWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAA

SEQ ID NO: 32757 - protein, 489 aa, Halomonas elongata
MTAQSAQPLYIGGRPVDATSGETFTVTNPYDGSLLATIGQASQADVDSAVQAAQRGQREWAAMTGMERSRILLRAVALLRERNDELAELETRNTGKPISETASVDIVTGADALEYYAGLAPAIEGSQIPLRDTRLVYTRREPLGVIGAIGAWNYPIQIACWKAAPALAAGNAIVFKPSEVTPLTALKLAEIFTEAGLPDGVFNVVQGDGRVGAMLTEHEGIAKVSFTGEVGTGKKVMAAAGGSTLKDVTMELGGKSPLIVFADADLDRAADAAMMANFYSSGQICTNGTRVFVERSAKEAFEAKLVERVARIKAGDPMDPSVNFGPLVSFEHQEKVLSYIALGKEQGARVLAGGDAWNSGEWAKGAWAAPTVFTDCTDEMRVVKEEIFGPVMSVLAFDDEEEVIRRANNTKYGLAAGVFSESLNRAHRVIHQLEAGICWINTWGESPSEMPVGGYKESGIGRENGVETLNHYTQTKSVQIEMGPFESVF

SEQ ID NO: 32758 - protein, 337 aa, Populus tremuloides
MPVDASSLSGQGQTCVTGAGGFIASWMVKLLLDKGYTVRGTARNPADPNNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLFQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 32759 - protein, 167 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFENNTATYLTLAY

SEQ ID NO: 32760 - protein, 465 aa, Actinidia chinensis
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPAAYVKTFQGPPHGIQVERDKLNKYGRPLLGCTIKPKLGLSAKNYGRAVYECLRGGLDFTKDDENVNSQPFMRWRDRFLFCAEAIFKAQSETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDYIEKDRARGIYFTQDWVSLPGVLPVASGGIHVWHMPALTEIFGDDSVLQFGGGTLGHPWGNAPGAVANRVALEACVQARNEGRDLAREGNEIIRNASKWSPELAAACEVWKEIKFEFQAMDTL

SEQ ID NO: 32761 - protein, 469 aa, Akania bidwillii
TKASVGFKAGVKDYKLTYYTPDYETKDTDILAAFRMSPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLASEGNAIIREASKWSPELAAACEIWKEIKFEFPAMDTL

SEQ ID NO: 32762 - protein, 465 aa, Cornus florida
VGFKAGVKEYKLTYYTPTYETKDTDILAAFRVTPQPGVPPEEAGAAVAAESSTGTWITVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32763 - protein, 465 aa, Cornus mas
VGFKAGVKDYKLTYYTPSYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGLFFTQDWVSLPGVLPVASGGIHVWHMPALTEIFGDDSVLQFGGGTLGHPWGNAPGAVANRVALEACVQARNEGRDLAREGNDIIREASKWSPELAAACEVWKEIKFEFEAMDTL

SEQ ID NO: 32764 - protein, 465 aa, Cornus walteri
  misc_feature (18)..(18): Xaa can be any naturally occurring amino acid
  misc_feature (49)..(49): Xaa can be any naturally occurring amino acid
VGFKAGVKEYKLTYYTPXYETKDTDILAAFRVTPQPGVPPEEAVAAVAXESSTGTWTTVWTDGLTSLDRYKGRCYHIEPVPGEESQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHVHSGTVVGKLEGERDITLGFVDLLRDDFVEKDRSRGIFFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFEAMDTL

SEQ ID NO: 32765 - protein, 459 aa, Garrya elliptica
VGFKAGVKDYKLTYYTPDYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAINKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKAIKFEF

SEQ ID NO: 32766 - protein, 465 aa, Gunnera manicata
VGFKAGVKDYKLTYYTPDYETKDTDILAAFRMTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAFYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAAYEVWKEIKFEFEAMDTL

SEQ ID NO: 32767 - protein, 465 aa, Greyia radlkoferi
AGFKAGVKDYKLTYYTPEYDPKDTDTLAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPTAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMLKRAIFARELGVPIVMHDYLTGGFTANTSLAHYCRDNGLLLHIHRAMHAVIDRQKNHGIPFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32768 - protein, 465 aa, Deutzia gracilis
VGFKAGVKDYKLTYYTPDYETKDTDILAAFRVTPQPGVPPEEAGAAVAAESSTGTWTTVWTDGLTSLDRYKGRCYGIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGEREIALGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32769 - protein, 465 aa, Escallonia coquimbensis
VGFKAGVKDYKLTYYTPDYETKETDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32770 - protein, 465 aa, Boykinia rotundifolia
VGFKAGVKDYKLTYYTPDYETKDTDILAAFRVTPQPGVPPEEAGAVVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32771 - protein, 465 aa, Bursera inaguensis
VGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGAPIVMHDYLTGGFTANTSLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNDIIRDASKWSPELAAACEVWKEIKFEFEAMDTL

SEQ ID NO: 32772 - protein, 465 aa, Byrsonima crassifolia
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAQYCRDNGLLLHIHRAMHAVIDRQKNHGMHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 32773 - protein, 466 aa, Caltha palustris
SVGFKAGVKDYKLNYYTPEYTPKDTDTLAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNRPGAVANRVALEACVQARNEGRDLAREGNEIIREACKWSLELAAACEVWKEIKFEFEAMDTL

SEQ ID NO: 32774 - protein, 466 aa, Corokia cotoneaster
  misc_feature (466)..(466): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYGIEPVPGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALFKAQTETGEIKGHYLNATAGTCEEMMKRAVFARELGVPIVMHDYLTGGFTANTTLAHYCRDNGLLLHIHRAMHAVIDRQKNHGITFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFAAMDTLX

SEQ ID NO: 32775 - protein, 465 aa, Crossosoma californicum
VGFKAGVKDYKLTYYTPDYETKDTDILAAFRVTPQPGVPPEEAGAAVAAESSTGTWTTVWTDGLTNLDRYKGRCYHIEPVAGEETQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32776 - protein, 465 aa, Curtisia dentata
VGFKAGVKDYKLTYYTPDYETKDTDILAAFRVTPQPGVPPEEAGAAVAAESSTGTWTTIWTDGLTSLDRYKGRCYHIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGITFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32777 - protein, 465 aa, Daphniphyllum sp.
VGFKAGVKDYKLTYYTPDYDTKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYLKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFEAMDTL

SEQ ID NO: 32778 - protein, 465 aa, Darmera peltata
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPAAYAKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLSHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32779 - protein, 466 aa, Drimys winteri
VGFKAGVKDYKLTYYTPDYETKDTDILAAFRVTPQPGVPPEEAGAAVAAESSTGTWTTVWTDGLTSLDRYKGRCYHIEPVAGEEDQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFIQKDRSRGIYFTQDWVSMPGVLPVASGGIHVWHMPALTEIFGDDSVLQFGGGTLGHPWGNAPGAVANRVALEACVKARNEGRDLAREGNEIIREACKWSPELAAACEVWKEIKFEFKAVDTLD

SEQ ID NO: 32780 - protein, 465 aa, Helwingia japonica
VGFKAGVKDYKLTYYTPDYETKDTDILAAFRVTPQPGVPAEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKSQSETGEIKGHYLNATAGTCEEMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVKARNEGRDLAREGNEIIREASKWSPELAAACEVWKEIKFEFPAMDTL

SEQ ID NO: 32781 - protein, 465 aa, Lambertia inermis
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPSAYTKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHIPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32782 - protein, 465 aa, Lepuropetalon spathulatum
VGFKAGVKDYKLTYYTPDYETKDTDILAAFRMTPQPGVPPEEAGAAVAAESSTGTWTTVWTDGLTSLDRYKGRCYHIEPVAGEDNQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMIKRAVFARELGVPIVMHDYLTGGFTANTTLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32783 - protein, 465 aa, Manilkara zapota
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHVHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32784 - protein, 469 aa, Microbiota decussata
TKASVGFKAGVKDYRLTYYTPEYQTKDTDILAAFRVTPQPGVPPEEAGAAVAAESSTGTWTTVWTDGLTSLDRYKGRCYDIEPVPGEENQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFCFCAEAIYKAQAETGEIKGHYLNATAGTCEEMIKRAVFARELGVPIVMHDYLTGGFTANTSLAHYCRDNGLLLHIHRAMHAVIDRQRNHGMHFRVLAKALRMSGGDHIHAGTVVGKLEGEREVTLGFVDLLRDDFIEKDRSRGIYFTQDWVSMPGVMPVASGGIHVWHMPALTEIFGDDSVLQFGGGTLGHPWGNAPGAVANRVALEACVQARNEGRDLAREGNEVIREATKWSPELAAACEVWKEIKFEFDTIDRL

SEQ ID NO: 32785 - protein, 465 aa, Myriophyllum exalbescens
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAINKAQTETGEIKGHYLNATAGTNEDMMKRAQFARELGVPIIMHDYLTGGFTANTSLAFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEIWKEIKFEFAAMDTL

SEQ ID NO: 32786 - protein, 466 aa, Nothofagus dombeyi
  misc_feature (460)..(460): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFXEAMDTL

SEQ ID NO: 32787 - protein, 465 aa, Osyris lanceolata
  misc_feature (135)..(135): Xaa can be any naturally occurring amino acid
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYXKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32788 - protein, 465 aa, Photinia fraseri
VGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 32789 - protein, 465 aa, Pterostemon rotundifolius
VGFKAGVKDYKLTYYTPDYQTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYIKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAAYEVWKEIKFEFEAMDTL

SEQ ID NO: 32790 - protein, 465 aa, Platytheca verticellata
VGFKAGVKDYKLTYYTPDYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32791 - protein, 465 aa, Pittosporum japonicum
VGFKAGVKDYKLTYYTPDYQTKDTDILAAFRVTPQPGVPPEEAGAAVAAESSTGTWTTVWTDGLTSLDRYKGRCYEIEPVAGEENQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQVETGEIKGHYLNATAGTCEDMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLASEGNEIIREAAKWSPELAAACEIWKEIKFEFQAMDTL

SEQ ID NO: 32792 - protein, 465 aa, Phyllonoma laticuspis
VGFKAGVKDYKLTYYTPDYETKDTDILAAFRVTPQPGVPPEEAGAAVAAESSTGTWTTVWTDGLTNLDRYKGRCYEIEPVAGEENQFIAYVAYPLDLFEEGSVTNMFTSIVGNVFGFKALRALRLEDLRIPTAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHVHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 32793 - protein, 466 aa, Pelargonium capitatum
  misc_feature (212)..(212): Xaa can be any naturally occurring amino acid
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFXAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGKDLAREGNEIIRKACKWSRELGAACEVWKEIKFEFEAMDTL

SEQ ID NO: 32794 - protein, 465 aa, Quisqualis indica
VGFKAGVKDYKLTYYTPDYQTKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEGIYKAQAETGEIKGHYLNATAGTCEEMIKRAVFARELGAPIVMHDYLTGGFTANTSLAHYCRDNGLLLHIHRAMHAVIDRQKNHGMHFRVLAKALRMSGGDHIHAGTVVGKLEGEREITLGFVDLLRDDYIEKDRSRGIYFTQDWVSLPGVIPVASGGIHVWHMPALTEIFGDDSVLQFGGGTLGHPWGNAPGAVANRVALEACVQARNEGRNLAREGNEIIREASKWSPELAAACEVWKEIKFEFEAMDTL

SEQ ID NO: 32795 - protein, 466 aa, Sarcocaulon vanderietiae
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIRKACKWSRELAAACEVWKEIKFEFAAVDTL

SEQ ID NO: 32796 - protein, 465 aa, Spiraea x vanhouttei
VGFKAGVKEYKLTYYTPEYETKDTDILAAFRVTPQPGVPPEEAGAAVAAESSTGTWTTVWTDGLTSLDRYKGRCYHIEPVAGEENQFIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAAFARELGVPIVMHDYLTGGFTANTTLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32797 - protein, 467 aa, Tasmannia insipida
SVGFKAGVKDYKLTYYTPDYETKDTDILAAFRVTPQPGVPPEEAGAAVAAESSTGTWTTVWTDGLTSLDRYKGRCYHIEPVAGEEEQYIAYVAYPLDLFEEGSVTNMFTSIVGNVFGFKALRALRLEDLRIPIAYVKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMMKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEIIREACKWSPELAAACEVWKEIKFEFKAVDTLD

SEQ ID NO: 32798 - protein, 466 aa, Tropaeolum majus
SVGFKAGVKDYKLTYYTPDYETKDTDILAAFRMSPQPGVPAEEAGAAVAAESSTGTWTTVWTDGLTSLDRYKGRCYQIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIFFTQDWVSLPGVLPVASGGIHVWHMPALTEIFGDDSVLQFGGGTLGHPWGNAPGAVANRVALEACVQARNEGRDLASEGNAIIREASKWSPELAAACEVWKEIKFEFPAMDTL

SEQ ID NO: 32799 - protein, 465 aa, Tetracarpaea tasmanica
VGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAQFARELGVPIVMHDYLTGGFTANTSLSFYCRDNGLLLHIHRAMHAVIDRQKNHGIHFRVLAKALRMSGGDHIHSGTVVGKLEGEREITLGFVDLLRDDYIEKDRSRGIYFTQDWVSLPGVLPVASGGIHVWHMPALTEIFGDDSVLQFGGGTIGHPWGNAPGAVANRVALEACVQARNEGRDLAREGNEIIREACKWSPELAAACEVWKEIKFEFEAMDTL

SEQ ID NO: 32800 - protein, 466 aa, Viviania marifolia
  misc_feature (63)..(64): Xaa can be any naturally occurring amino acid
  misc_feature (408)..(408): Xaa can be any naturally occurring amino acid
SVGFKAGVKDYKLTYYTPDYETKDTDILAAFRVTPQPGVPPEEAGAAVAAESSTGTWTTVWTXXLTSLDRYKGRCYHIEPVAGEENQFIAYVAYPLDLFEEGSVTNMFTSIVGNVFGFKALRALRLEDLRIPVAYAKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFIEKDRSRGIYFTQDWVSLPGVLPVASGGIHVWHMPALTEIFGDDSVLQFGGGTLGHPWGNAPGXVANRVALEACVQARNEGRDLAREGNEIIRQACKWSPELAAACEVWKEIKFEFEAMDTL

SEQ ID NO: 32801 - protein, 466 aa, Achlys triphylla
  misc_feature (199)..(199): Xaa can be any naturally occurring amino acid
  misc_feature (297)..(297): Xaa can be any naturally occurring amino acid
SAGFKAGVKDYKLTYYTPDYVTKDTDILAAFRVTPQPGVPPEEAGAAVAAESSTGTWTTVWTDGLTSLDRYKGRCYHIEPVAGEENQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNXQPFMRWRDRFLFCAEAIYKSQAETGEIKGHYLNATAGTCEEMMKRAVFARELGVPIVMHDYLTGGFTANTTLAHYCRDNGLLLHIHRAMHAVIDRQKXHGIHFRVLAKALRMSGGDHIHAGTVVGKLEGEREITLGFVDLLRDDLIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32802 - protein, 466 aa, Bongardia chrysogonum
SAGFKAGVKDYKLTYYTPEYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32803 - protein, 466 aa, Coriaria myrtifolia
GVGFKAGVKDYKLTYYTPEYETKDTDILAAFRVTPQPGVPPEEAGAAVAAESSTGTWTTVWTDGLTSLDRYKGRCYQIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32804 - protein, 466 aa, Diphylleia cymosa
  misc_feature (242)..(244): Xaa can be any naturally occurring amino acid
SAGFKAGVKDYKLTYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEDMXXXAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLARQGNEIIREACKWSPELAAACEIWKEIKFEFEAMDTL

SEQ ID NO: 32805 - protein, 465 aa, Passiflora quadrangularis
  misc_feature (121)..(122): Xaa can be any naturally occurring amino acid
VGFKAGVKDYKLTYYTPEYNPKDTDILAAFRVTPQPGVPAEEAGAAVAAESSTGTWTTVWTDGLTSLDRYKGRCYDIEPVAGEESQFIAYVAYPLDLFEEGSVTNMFTSIVGNVFGFKALXXLRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLARYCRDNGLLLHIHRAMHAVIDRQKNHGMHFRVLAKALRMSGGDHIHAGTVVGKLEGERDITLGFVDLLRDDFVEKDRSRGIYFTQDWVSLPGVIPVASGGIHVWHMPALTEIFGDDSVLQFGGGTLGHPWGNAPGAVANRVALEACVQARNEGRDLAREGNEIIRSAAKWSPELAAACEVWKEIKFEFPAMDTL

SEQ ID NO: 32806 - protein, 466 aa, Pelargonium exstipulatum
  misc_feature (466)..(466): Xaa can be any naturally occurring amino acid
SVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYVKTFQGPPHGIQVERDKLNKYGRPLLGCTIKPKLGLSAKNYGRAVYECLRGGLDFTKDDENVNSQPFMRWRDRFLFCAEAINKSQAETGEIKGHYLNATAGTCEEMIKRAVFARELGAPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGKDLARQGNEIIRKACKWSRELAAACEVWKEIKFEFEAMDTX

SEQ ID NO: 32807 - protein, 186 aa, Physcomitrella patens
MSTSRFIKCVTVGDGAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELRKSIGAASYIECSSKTQQNVKAVFDAAIKVVLQPPKQKKK

SEQ ID NO: 32808 - protein, 182 aa, Physcomitrella patens
GAVGKTCMLISYTSNTFPTDYVPTVFDNFSANVVVDGNTVNLGLWDTAGQEDYNRLRPLSYRGADVFLLAFSLISKASYENISKKWIPELRHYAPSVPIILVGTKLDLRDDKQFFADHPGAAPITTSQGEELKRSIGAASYIECSSKTQQNVKAVFDAAIKVVLQPPKPKKKKKKQKNCVIL

SEQ ID NO: 32809 - protein, 449 aa, Bacillus circulans
SIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 32810 - protein, 433 aa, Thinopyrum elongatum
MQCFRFASWEKEREEELQGPARSQSALSNSSMSTDRDARRSGSECCSLTVSSEISVDSFGRYRQLSLPHRPNNDLRIFTFQELKSATRSFSRALMIGEGGFGCVYRGTIQSTLEPRRSLDVAIKQLGRKGLQGHKEWVTEVNFLGVVDHPNLVKLIGYCAEDDERGIQLLLVYEFMPHGSLADHLSTRSPKPASWAMRLRVALDTARGLKYLHEDSEFKIIFRDLKPSNILLDENWNAKLSDFGLARLGPQEGSHVSTAVVGTIGYAAPEYIHTGRLSSKNDIWSYGVVLYELLTGRRPLDRNRPRGEQNLVEWVKPYSSDTKKFETIMDPRLEGNYNLKSAARIASLANKCLVRHARYRPKMSEVLEMVQKIVDSSDLGTPERPLISHSKKLASDEKKRKGLNLKRRIADIKAGDGRWFRWHKWTPKLVRTQ

SEQ ID NO: 32811 - protein, 373 aa, Saccharomyces kluyveri
MLRLSTRASLTARPFFQGSFRTMATASIPEKQKGIIFYENGGELKYEDIPVPKPKPNELLINVKYSGVCHTDLHAWKGDWPLPTKLPLVGGHEGAGVVVAMGENVKGWKIGDLAGIKWLNGSCLSCEYCEKSNESNCPHADLSGYTHDGSFQQYATADYVQAARIPEGTDLAEVSPILCAGVTVYKALKSANLKAGDWVAISGAAGGLGSLAVQYAKAMGYRVLGIDGGAEKGELVKKLGGEVFIDFTKHKNLVEAVQEATNGGPHGVINVSVSEAAMTASTQFVRPTGTVVLVGLPAGAVIKSEVFSHVVKSINIKGSYVGNRADTREAIDFFARGMVKSPIHVVGLSELPKVYELMEKGKILGRYVVDTAK

SEQ ID NO: 32812 - protein, 293 aa, Brucella melitensis
MSYDVVVIGTGPGGYVAAIKAAQLGLKVAVVEKRKTFGGTCLNIGCIPSKALLHASEVFAEAGHSFDTLGVEVTPKLNLTKMLAHKDTTVKANVSGVEFLFKKNKITPYIGTGKIVGKGKVSVTSEDGKVEEIEAKNIIIATGSDVAGIPGVKVDIDEKVIVSSTGALSFDKVPGSLIVVGGGVIGLELGSVWARLGAKVTVVEYLDKVLGPMDGEVSKQFQRLLEKQGIAFKLGAKVTGVEKVGKGAKITFEPVKGGDAETLEADAVLIATGRRPYTDGLGLQEAGVAVDER

SEQ ID NO: 32813 - protein, 243 aa, Tatlockia micdadei
MKMRLVAAAAMGLAMSTTIAATATTDATTSAPGTSLTTDTEKLSYSIGADLGKNFKKQGIEISPAAMAKGLQDGMSGGQLLLTDDQMKDVLNKFQKDLMMKRSAEFNKKAEENKSKGEAFLNENKSKEGVVSLPSGLQYKILERGDGAKPTKDDVVTVEYTGKLIDGQVFDSTEKTGKPATFKVSQVIPGWTEALQLMPAGSTWEVYIPSNLAYGPRSVGGPIGPNETLIFKIHLISVKKSDA

SEQ ID NO: 32814 - protein, 173 aa, Mesostigma viride
MPRSQKNDNFIDKTFTVVADIILKVLPTTVREKAAFSYYRDGMSAQAEGEYAEALQNYYEAMRLEIDPYDRSYILYNIGLIHTSNGEHGKALEYYYQAIERNPSLPQALNNIAVIYHYRGEQAIEEGNIATSEILFNQAASYWKQAIRLAPNSYIEAQNWLKITGRIEDNINL

SEQ ID NO: 32815 - protein, 475 aa, Mesostigma viride
MSPKTETKAGTGFKAGVKDYKLTYYTPDYVVKDTDILAAFRMTPQPGVPPEECGAAVAAESSTGTWTTVWTDGLTSLDRYKGRCYDLEPVAGEENQYIAYVAYPIDLFEEGSVTNLFTSIVGNVFGFKALRALRLEDLRIPVAYVKTFQGPPHGIQVERDKLNKYGRPLLGCTIKPKLGLSAKNYGRACYECLRGGLDFTKDDENVNSQPFMRWRDRFLFVAEAIFKSQSETGEIKGHYLNATAATCEEMLKRAAYAKELGVPIIMHDYLTGGFTANTSLAAYCRDNGLLLHIHRAMHAVIDRQKNHGIHFRVLAKALRLSGGDHLHSGTVVGKLEGEREVTLGFVDLMRDDYIEKDRSRGVYFTQDWCSMGGVMPVASGGIHVWHMPALTEIFGDDSCLQFGGGTLGHPWGNAPGAVANRVALEACVQARNEGRDLAREGNDVIRAACKWSPELAAACEVWKEIKFEFETIDTL

SEQ ID NO: 32816 - protein, 348 aa, Mesostigma viride
MSILIDNISKKFGNFQALNHINLEIKSGSIIALLGPSGSGKSTLLRIIAGLDTPDEGTIWISGKNASGYSIQSRNIGFVFQNYALFKNMTVYDNIAFGLELRRISFNDISRKVNKLLELVQLQNLGHRYPAQLSGGQRQRIALARALAIEPKVLLLDEPFGALDARVRKNLRAWLRDLHNKFSITTIIVTHDQQEAMEIADEIVVFNSGRIEQIGKPQDIYDQPATPFVFSLLGYVNKISFDNEIANFLLSSFPEKQSVLMQEKQFYIRPHQIVISKQSNESNYSAKIENLLYIGNWIHLDIYVASFNVNLKVHVSPKEFDNLQLKSFQENIYVSLRSKGKEPIRFLE

SEQ ID NO: 32817 - protein, 468 aa, Nymania capensis
KASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 32818 - protein, 465 aa, Schinus molle
VGFKAGVKEYKLTYYTPEYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIFKAQAETGEIKGHYLNATAGTCEEMLKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32819 - protein, 466 aa, Tapirira mexicana
SVGFKAGVKDYKLTYYTPDYATKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32820 - protein, 468 aa, Buchanania latifolia
KASVGFKAGVKDYKLNYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRVPTAYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVCARELGVPIVMHDYLTGGFTANTSLAHYCRDNGLLLHIHRAMHAVIDRQKNHGMHFRVLAKALRLSGGDHVHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEIWKEIKFEFEAMDTL

SEQ ID NO: 32821 - protein, 466 aa, Aesculus pavia
SVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNAFGFKALRALRLEDLRIPSAYVKTFQGPPHGIQVERDKLNKYGRPLLGCTIKPKLGLSAKNYGRAVYECLRGGLDFTKDDENVNSQPFMRWRDRFLFCAEAIFKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFQFEAMDTL

SEQ ID NO: 32822 - protein, 466 aa, Malacocarpus crithmifolius
GVGFKAGVKEYKLTYYTPDYETKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNQIIREASKWSPELAAACEVWKEIKFEFEAMDTL

SEQ ID NO: 32823 - protein, 466 aa, Ruta graveolens
SVGFKAGVKDYKLTYYTPEYVTKDTDILAAFRVTPQPGVPPEEAGAAVAAESSTGTWTTVWTDGLTSLDRYKGRCYDIEPVAGEENQYICYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHSGTVVGKLEGERDITLGFVDLLRDDFIDKDRSRGIYFTQDWVSLPGVLPVASGGIHVWHMPALTEIFGDDSVLQFGGGTLGHPWGNAPGAVANRVALEACVQARNEGSDLAREGNEIIREACKWSPELAAACEVWKEIKFEFEAMDTL

SEQ ID NO: 32824 - protein, 285 aa, Lycopersicon esculentum
MEGKEEDVKVGANKYSERQPLGTSAQSKDYKEAPPAPLFEAGELHSWSFWRAGIAEFMATFLFLYITVLTVMGYSRANSKCSTVGVQGIAWAFGGMIFALVYCTAGISGGHINPAVTFGLFLARKLSLTRAVFYIVMQCLGAICGAGVVKGFQPSLFGTKGGGANVVAHGYTKGDGLGAEIIGTFVLVYTVFSATDAKRNARDSHVPILAPLPIGFAVFLVHLATIPITGTGINPARSLGAAIVYNKEHAWDDHWIFWVGPFIGAALAALYHQVIIRAIPFKSGN

SEQ ID NO: 32825 - protein, 510 aa, Arabidopsis thaliana
MEMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 32826 - protein, 492 aa, Arabidopsis thaliana
MEMLLGGRATNGALRSKTKIVCTLGPVSRSVEMIEKLLKAETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 32827 - protein, 380 aa, Vitis vinifera
MSSTAGQVIRCKAAVAWEAGKPLVIEEVEVAPPQVMEVRLKILVTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 32828 - protein, 363 aa, Vitis vinifera
MGVPQVLATFLALGELTNFLRLGFLRYWQRHGFCSLILLQHSLDGGVDDVIAPTQELSSVGLHVTATVMCASARSSTSTAQTAIYDTFIFALTDMVETERERERETRAEFGTSSCRIRHEGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 32829 - protein, 509 aa, Arabidopsis thaliana
MGLDSGAFSVSFVFVFLCLLFKSLDRQIRDSILAKRKRKVFNSLMRLWLNESLRIRVVMGKDRISELPDALLIKILSFLPTKIVVATSVFSKQWRPLWKLVPNLEFDSEDYDDKEQYTFSEIVCKSFLSHKAPVLESFRLEFESEKVDPVDIGLWVGIAFSRHLRELVLVAADTGTGTAFKFPSSLCTCNTLETLRLVLLILVDISSPVVMKSLRTLHLELVSYKDESSIRNLLSGCPILEELLVIRGEDSDIEVFTIDEVPSLKRLTINDDHDGQEFWGYVINAPSLKYLLIEDLRCPGFCLNAPELMEANIFDGTSITNDNFLGYLTSVKRLLLNLSPWKITYPTGSIFYQLVSLEMYTREIDWWDLLTLMLEHSPKLQVLKLTDVRHFIISQLCIFNCVKFHKNGLPGGKWNEPKYVPECLLSHLETFVWRRFDWGREEEKEIATYILKNARRLNKATFSTNPVNSEELDKLKERRKVHNELDGVVRASNSCQVLGSGASRWELKT

SEQ ID NO: 32830 - protein, 308 aa, Arabidopsis thaliana
MSSKDKKPSKPSSSRGGIRTLSDLNRRSGPDSDSDSDGPQEYYTGGEKSGMLVQDPSKKDDVDEIFNQARQLGAVEGPLEPPPSSRSFTGTGRLLSGENVPTGNQQPEPVVHNIVFWSNGFTIDDGPLRKLDDPENASFLEVNDFHSIRKSECPKELEPADRRAPVHVNLMRKEEKCPERQKRRVSFQGVGRTLGGSNEGSGSSSPVAPDSAPIPIQTEPAPSQSLVIDETVPTTSIQLRLADGTRLVAKFNHHHTVNDIRGFIDSSRPGASLNYQLQTMGFPPKPLTDLTQTIEEAGLANSVVLQKF

SEQ ID NO: 32831 - protein, 492 aa, Arabidopsis thaliana
MSIPLRYCLDFMGGQCSSLSCCRNTSHKTAVLEAPDVDNGESSEITDVPNFREYTLEQLKAATSGFAVEYIVSEHGEKAPNVVYKGKLENQKKIAVKRFTRMAWPDSRQFLEEARSVGQLRSERMANLLGCCCEGDERLLVAEFMPNETLAKHLFHWETQPMKWTMRLRVVLYLAQALEYCTSKGRTLYHDLNAYRVLFDEVFIRAFNKECNPRLSTFGLMKNSRDGKRRITPESVIYSFGTLLLDLLSGKHIPPSHALDLIRDRNLQTLTDSCLDGQFSDSDGTELVRLASRCLQYEARERPNTKSLVTALTPLQKETEVLSHVLMGLPHSGSVSPLSPLGEACSRRDLTAMLEILEKLGYKDDEGVTNELSFHMWTDQMQESLNSKKKGDVAFRQKDFREAIECYTQFIDGGMISPTVCARRSLCYLMSDMPKEALDDAIQAQVISPVWHVASYLQSASLGILGMEKESQIALKEGSNLEAKMNGVPRVK

SEQ ID NO: 32832 - protein, 435 aa, Arabidopsis thaliana
MSVTAGVSESAIAVREKLKGGIGQTKVRRYWPGKAPEWAEEAEEDDDVRMQKFSVLDRAFPKNDDLGVARKDDPRLRRLAQTKVENRDEVRADHRRIRQAEIISTEEEESRNQENRDEDDDEDALEERRRRIKEKNLRRAQEEAALLPLEEEDEIQEEEEEEEESEYETDSEDDMPGIALIKPVFVPKAERDTIAERERLEAEEEALEELAKRKLEQRKIETKQIVVEEVRKDEEIRKNILLEEANIGDVETDDELNEAEEYEVWKTREIGRIKRERDAREAMLREREEIEKLRNMTEQERRDWERKNPKPSSAQPKKKWNFMQKYYHKGAFFQADPDDEAGSAGTDGIFQRDFSAPTGEDRLDKSILPKVMQVKHFGRSGRTKWTHLVNEDTTDWSNPWTSNDPLREKYNKKMAGMDAPIAKPKGSKKMKDWET

SEQ ID NO: 32833 - protein, 401 aa, Arabidopsis thaliana
MEPPKEQQNTPEKSISDAPATISSAFPPSGCCTNCGGPTISEAPPPLASFPEMSPPPNYRPIRAPAINLPHNSQAIILSPVPHAEQVPVVSPPYHFQSPVKRIHSPDDIRRFHESASCKNFLGFVVSLSESIRGFKISDPCHISPTVAAIVSILETLLQWIDEIPPAQQSARYGNVSFRSWHERLRERGESLILEFLPEEFKESVIEIVPYFFDSFGNSSRIDYGTGHETNFAAWLYCLARMGIVKEEDYHSLVARVFVKYLELMRKLQMVYCLEPAGSHGVWGLDDYHFLPFIFGSSQLIDHKYMKPKSIHNDDILENFSSEYMYLSCIAFVKKVKKGLFAEHSPLLDDISGVPNWKKVNSGLLKMYRVEVLEKVPIMQHFLFGWLIKWYDSSFFLLSRF

SEQ ID NO: 32834 - protein, 414 aa, Arabidopsis thaliana
MDRIIGLPDEVLVKILSFVPTKVAVSTSILSKRWEFLWMWLTKLKFGSKRYSESEFKRLQCFLDRNLPLHRAPVIESFRLVLSDSHFKPEDIRMWVVVAVSRYIRELKIYSSHYGEKQNILPSSLYTCKSLVILKLDGGVLLDVPRMVCLPSLKTLELKGVRYFKQGSLQRLLCNCPVLEDLFVLLLRCDDIGMFIVIVPSLQRLSLYLSPRCNLEGFVIVLDTPLEYFKLVDRNYDRHPYMIENMPKLTSAYVEVISADLKSLVESITSVKYLTIFSEVILLSLFVCMLCLVTLHVWDDNLLARLLKDSPKLQELVYVSDKDVSSFDKLLYLIYCTLFFIIQSDFLLDLRIMTILCFPGINLVLFLNAFVQSTKVHQSTKVHLDKILRKTTRQRYCGLHLEKRLSLKDCNNHM

SEQ ID NO: 32835 - protein, 324 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKKFKGRVPGYAVKAVDTTGAGDSFVGAFLVSLGKDGSILDDEGKLKEALAFANACGAVCTTQKGAIPALPTPADAQKLMKSKSK

SEQ ID NO: 32836 - protein, 326 aa, Arabidopsis thaliana
MDRISGLPDEVLVKILSFVPTKVAVSTSILSKRWEFLWMWLTKLKFGSKRYSESEFKRLQCFLDRNLPLHRAPVIESFRLVLSDSHFKPEDIRMWVVVAVSRYIRELKIYSSHYGEKQNILPSSLYTCKSLVILKLDGGVLLDVPRMVCLPSLKTLELKGVRYFKQGSLQRLLCNCPVLEDLVVNLSHHDNMGKLTVIVPSLQRLSLSTPSSREFVIDTPSLLSFQLVDRNDNSHTFLIENMPKLREAYINVPFADIKSLIGSITSVKRLAISSEVGYGEGFIFNHLEELTLWNKYSSNLLVWFLKNSPNLRELMLVSETDVSFFH

SEQ ID NO: 32837 - protein, 470 aa, Arabidopsis thaliana
MITVDHKSDTVLLPIYGRMVPFNVTTIRTVLGNQNTIRVIFNVPGTPLNPNDSLKNKDAIYLKEVSFRTKDSRHSSDVVQQVKSLRRKVMARESERAERTSLVNQEKLQIVRNNSKPLSLSNLWIRPPFSGRKKNRGTLEAHVNGFRYSTTNERVDVLFANIKHAFFQPAEKEMTTLLHFHLHNHIMVGTKKTKDVQFYVEVMDVVQSLGGRRRSSAYDADEIVEEQRERDRKNKINMDFNHFANQVNDMWQLPQFASLSLEFDQPLREFGFNGVPHKTSTFIIPTSSCLVELTESPFLVVCLSEIEIVNLERVGFGQKSFDMAIIFKDLKKDVLRVDSVPTNAGGWEFLNQDGSDSESGGSEDSDKGYEPSDVEVESESEDETSESESDDEEEEEDSEQESEEEKGKTWAELEREATNADREHGVESDSEEERKRRKMKAFGKSRPGSSGAGGSSSMKNMPPSKRSRHR

SEQ ID NO: 32838 - protein, 1074 aa, Arabidopsis thaliana
MADSRNGNARAPPSGVPPKAGNTYSIDVKNFISRARALYEHWKKHSADLWGSADALAIATPPASDDLRYLKSSALNIWLLGYEFPDTIMVFTKKQIHFLCSRNKASLLEVVKKPAHDELKLDVIMHVKPKGDDGTGLMDAIFRAIRDLSRGDGNDSQVVGHIAREAPEGKLLETWTERLKNANFQFVDITGGLSDLFAVKDDTEVMSVKKAAYLAYSVMKNVVVPNLESAIDEEKDVTHSALMDLTEKAILEPTKASVKLKPENVDICYPPIFQSGGKFDLKPSAASNDELLTYDPASIIICAVGARYNSYCSNVARTYLIDATSLQSKAYEVLLKAHEAAIDALRSGRKINTVYQAALSVVEKNAPEFVDKLTKSAGTGIGLEFRESGLNINAKNDKVLRPKMAFNVSLGFQNLECESESRSKNKKFSLLLADTVLVTDQKPELLTKCSKSVKDVAYSFKEDEEEEKPRKKARTSGSENYITKTALRSDDHVVSKEELRKQHQAELARQKNEETARRLAGDSSGAGDSRSTAKTSADVVAYKNVNDMPHKELMIQVDTRNEAVLLPIYGSLVPFHVATIRTVSGNQDTNRNCYIRIIFNVPGTPFNPHDSNSLKNQGAIYLKEVSFRTKDSRHSSEVTQQIKTLRRQVMARESERAERATLVTQEKLQLAGNKFKPLRLSELWIRPPFSGRKKIPGTLEAHANGFRYSTTRPDERVDVLFANIKHAFFQPAEKEMITLLHFHLHNHIMVGTKKTKDVQFYVEVMDVVQSLGGGRRSAYDPDEIDEEQRERDRKNKINMDFNHFANRVNDMWQLPQFASLDLEFDQPLRELGFHGVPHKTSAFIIPTSSCLVELIEYPFLVVSLSEIEIVNLERVGFGQKNFDMAIIFKDFKKDVLRVDSVPTSSLEGIKEWLDTTDIKYYESKLNLNWRQILKTITDDPQSFIDDGGWEFLNLDGSDSESGGSEESDKGYEPSDVEVESESEDEASESESLVESDDDEEEDSEQESEEEKGKTWDELEREATNADREHGVESDSEEERKRRKMKAFGKSRPGTSGGGGSSSMKNMPPSKRKHR

SEQ ID NO: 32839 - protein, 394 aa, Arabidopsis thaliana
MDSSYLRISLSFLFWALLLSPAVSQSSSCSSQTFSGVKSYPHCLDLPDLKAILHYSYDASNTTLAVVFSAPPSKPGGWIAWAINPKSTGMAGSQALVASKDPSTGVASVTTLNIVSYSSLVPSKLSFDVWDVKAEEAANDGGALRIFAKVKVPADLAASGKVNQVWQVGPGVSNGRIQAHDFSGPNLNSVGSLDLTGTTPGVPVSGGGGAGNSRIHKRNIHGILNAVSWGLLFPIGAMIARYMRIFESADPAWFYLHVSCQFSAYVIGVAGWATGLKLGSESKGIQYNTHRNIGICLFSIATLQMFAMLLRPRKDHKFRFVWNIYHHGVGYSILILGIINVFKGLSILNPKHTYKTAYIAVIGTLGGITLLLEVVTWVIVLKRKSAKSTKPLKA

SEQ ID NO: 32840 - protein, 495 aa, Arabidopsis thaliana
MILITLCLTTLLALLLKSILKRTATKNFNLPPSPWRLPVIGNLHQLSLHTHRSLRSLSLRYGPLMLLHFGRTPVLIVSSADVAHDVMKTHDLVCANRPKTKVVDKILSGGRDVAFAPYGEYWRQMKSICIQNLLNNKMVRSYEKIREEEIKRMIEKLEKASCSSSPSPVNLSQILMTLTNDIICRVALGRKYSGKKDGIDVENIVRTFAALLGEFPVGEYIPSLSWIDRIRGLDHKMEVVDKRFDEFLERVVKEHEEADKETRSDLVDKLLTIQSDKTGQFELEKSALKLIIWDMFLAGTATTLSFLEWAMTELMRNPKVMKKLQEEIRSSSPQDLFVTEKEAEKMNYLQAVIKEALRLRPPAPLLVPRVLSEDVKLKGYNIPAGTQVIVNAWAIQRDTTTWGTDAEEFKPERHLDTNLDFQGQDFKFIPFGSGKRICPGIGFTSALIGVTLANIVKRFNWRMDVEPQRVQHDLTEATGLVVFRKFPLIAIPSSA

SEQ ID NO: 32841 - protein, 428 aa, Arabidopsis thaliana
MNSIQRFSLTTQRGKRLSVVKSCVRHFCGRDVVIKDEGDWFYSPEWWDPQDGGYTVSRAVSNKGNGVVSVVAHPSSLPSRDSWGETEKWLEKRYMEIIPRDTEEKNGRFNVLGYQWRSLRFNDDTRQSTVKVMAACRTLQPSSVFYMQQPHCLAVPYLKSMVSVGLTSLAASKFDMRSVAIGDKQMRVLCIGHGGGSLPLFIAKHILGAVVDIVELDPLVISESVRAMGFPAFSVMTATGKRVLPTPEIIDQVMWGGIHERLSLYESKAEDFILRNQSNTYDLIFMDAYDGADIFPHSLWDSSSVFMKALSKTLHHEHGTLVVNLHSDADISDIDRSNEGVTTGKYVRKVGKAYKKGLLENERNGLVFACEVPWLCNVSLVVSRGMGSEGRDREKTKSNLMKTSLEVDRVLRLPFSCLDYLKTGLAII

SEQ ID NO: 32842 - protein, 436 aa, Arabidopsis thaliana
MANEGSDPLLQYMISPRLKKPPQLLFPLPEDNEVAIPMPMTPSEFKERLIFGPFSCSPRDSSHFIDSMKQPSPSSSSTAVNNPFSDSSTLDPLLPPPPPQPEPWLSDQTSSHCQGHALHRSKTAPAMAVINDLHHPIRQKDPTETSRSVVRQAFALLVVYLSLGVLIYWLNRDHYVVNQTHPVVDGLYFCIVTMCTIGYGDITPNSVVTKLFSIMFVLVGFGFIDILLSGMVSYVLDLQESYMLDSAKRRDEPEKRRSYIIDVKKGRMRIRLKVALALGVVVLCIAVGVGIMHFIEEIGWLDSFYLSVMSVTTVGYGDRAFKTLPGRLFAAIWLLVSTLAVARAFLYLAEARVDKRNRERAKKVLCETMSVSQFFAADIDNNGCVSKAEYVIYKLKEMEKITDKDILPISKQFDKLDRCSNGKITLLDLLEGGSGD

SEQ ID NO: 32843 - protein, 457 aa, Arabidopsis thaliana
MDISALFLTLFAGSLFLYFLRCLISQRRFGSSKLPLPPGTMGWPYVGETFQLYSQDPNVFFQSKQKRYGSVFKTHVLGCPCVMISSPEAAKFVLVTKSHLFKPTFPASKERMLGKQAIFFHQGDYHAKLRKLVLRAFMPESIRNMVPDIESIAQDSLRSWEGTMINTYQEMKTYTFNVALLSIFGKDEVLYREDLKRCYYILEKGYNSMPVNLPGTLFHKSMKARKELSQILARILSERRQNGSSHNDLLGSFMGDKEELTDEQIADNIIGVIFAARDTTASVMSWILKYLAENPNVLEAVTEEQMAIRKDKEEGESLTWGDTKKMPLTSRVIQETLRVASILSFTFREAVEDVEYEGYLIPKGWKVLPLFRNIHHSADIFSNPGKFDPSRFEVAPKPNTFMPFGNGTHSCPGNELAKLEMSIMIHHLTTKYRCVCVYYLLITFSFTHFVLFFQIYV

SEQ ID NO: 32844 - protein, 378 aa, Arabidopsis thaliana
MEKTSMFSIHEGKPIRCKAAVSRKPGEALVIEEIHVDPPQAYEVRIKIICTSLCHTDVSFSKIDRHEAVGVIESIGEHVNGFQQGDVVLPVFHPHCEECRDCKSSKSNWCARFADDFLSNTRRYGMTSRFKDSFGEDIYHFLFVSSFSEYTVVDIAHLVKISPDIPVDKAALLSCGVSTGIGAAWKVANVEKGSTVAVFGLGAVGLAVGEGARLRGAGKIIGVDLNPEKFELGKKFGFTDFINSTLCGENKISEVIKEMTGGGVDYSFECVGLPSLLTEAFSSTRTGSGKTVVLGIDKHLTPVSLGSFDLLRGRHVCGSLFGGLKPKLDIPILVDHYLKKELNLDSFITHELKFEEINKAFDLLVQGKSLRCILWMNK

SEQ ID NO: 32845 - protein, 467 aa, Arabidopsis thaliana
MEKDVMTDETCIVGRNPATIVNVNGLNISHQCMISLKLKCVIIFFGVVDAGDLLFRLITPERFIRIWQRMDRINEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKGPLSADRYEREYGLSCPVKVLEITEYGGKYEELEQMEHFLKKLPCLELVKVRASAINDKEKSRITKDLLMVPRSSNCNIKLKFC

SEQ ID NO: 32846 - protein, 386 aa, Arabidopsis thaliana
MWVFGSGRVGSFRVRIFRVLKFWTRMVISTISGRVLSGFTSGPDNSGIAHNKKYPRVSRSVRVIPDTLGYLKTEPDRVISRNRSRMGSGISGRIRFDSSGSDIMPRPKKNLNVQKVIRREYPSIGEIQKRTKREKKTKRSSEIEREKECCEMNYAYSSYIAEFYNTISNVPGILLALIGLVNALRQRFEKRFSILHISNMILAIGSMLYHATLQHVQQQSDETPMVWEILLYMYILYSPDWHYRSTMPTFLFLYGAAFAIVHAYLRFGIGFKVHYVILCLLCIPRMYKYYIHTEDTAAKRIAKWYVATILVGSICWFCDRVFCKTISQWPVNPQGHALWHVFMSFNSYCANTFLMFCRAQQRGWNPKVKYFLGVLPYVKIEKPKTQ

SEQ ID NO: 32847 - protein, 377 aa, Arabidopsis thaliana
MDLNINKTTPVLSDPTTPVSKTRLGSSFPSGRFMMNSRKKIPKLDDVRSNGWLDAMISSSPPRKRLVKDFNIEIAPEDDFSQRAWMLKYPSAITSFAHIAAQAKNKKIAVFLDYDGTLSPIVDDPDRAIMSDAMRAAVKDVAKYFPTAIISGRSRDKVYQLVGLTELYYAGSHGMDIMTPVNPNGSPEDPNCIKTTDQQGEEVNLFQPAKEFIPVIEEVYNNLVEITKCIKGAKVENHKFCTSVHYRNVDEKDWPLVAQRVHDHLKRYPRLRITHGRKVLEVRPVIEWNKGKAVEFLLESLGLSNNDEFLPIFIGDDKTDEDAFKVLREGNRGFGILVSSVPKESNAFYSLRDPSEVKKFLKTLVKWGKMESSKTSF

SEQ ID NO: 32848 - protein, 460 aa, Arabidopsis thaliana
MSVITTPIETLHLKSTLRLLPRAVYRSQRIQVFPPNIFSNTSLSSPLRIDPISQGLFILLSSILRRLCLLGTCKIYTFFSHGFLQPTIYTVGGSRNLWRRYASDNFSEMGLDPGADPFKVCAMGSFLFHSMLCWVIEKPSIVDRMKKANSILPHVVLASTILALIYPPSFTWFTSRFFPLEQGFLMFAVGINSNEKDFLEAFKRPKAILLGYVGQYLVKPVLGFIFGLAAVSLFQLPTPIGAGIMLVSCVSGAQLSNYATFLTDPALAPLSIVMTSLSTATAVLVTPMLSLLLIGKKLPVDVKGMISSILQVVIAPIAAGLLLNKLFPKVSNAIRPFLPILSVLDTACCVGAPLALNINSVMSPFGATILLLVTMFHLSAFLAGYFLTGSVFRNAPDAKAMQRTLSYETGMQSSLLALALATKFFQDPLVGIPPAISTVVMSLMGFTLVLIWSKEKSNTF

SEQ ID NO: 32849 - protein, 1240 aa, Arabidopsis thaliana
MVSDADASTSSSSIDIMPSANIQNDVPEPSVHTSHRRTRKPAYLQDYYCHSVASLTIHDISQFLSYEKVSPLYHSFLVCIAKAKEPSTYNEAKEFLVWCGAMDDEIGAMETTHTWEICTLPPNKKPIGCKWVYKIKYNSDGTIERYKARLVAKGYTQQEGIDFIETFSPVCKLTSVKLILAISAIYNFTLHQLDISNAFLNGDLDEEIYMKLPPGYAARQGDSLPPNAVCYLKKSIYGLKQASRQWFLKFSVTLIGFGFVQSHSDHTYFLKITATLFLCVLVYVDDIIICSNNDAAVDELKSQLKSCFKLRDLGPLKYFLGLEIARSAAGINICQRKYALDLLDETGLLGCKPSSVPMDPSVTFSAHSGGDFVDAKAYRRLIGRLMYLQITRLDISFAVNKLSQFSEAPRLAHQQAVMKILHYIKGTVGQGLFYSSQAEMQLQVFSDASFQSCKDTRRSTNGYCMFLGTSLISWKSKKQQVVSKSSAEAEYRALSFATDEMMWLAQFFRELQLPLSKPTLLFCDNTAAIHIATNAVFHERTKHIESDCHSVRERSVYQATLSYSFQAYDEQDGFTEYLSPILRGTIMYIVSMFGLAGLEALICFIFLFLFSFLTSFKASAQNPFYLNHDCPNRTTYSSNSTYSTNLKTLLSSFASRNASYSTGFQNIRAGQTPDRVTGLFLCRGDLSPEVCSNCVAFSVNESLTRCPNQREAVFYYEECILRYSHKNFLSTVTYEGELIMRNPNNISSIQNQRDQFIDLVQSNMNQAANEAANSSRKFSTIKTELTSLQTLYGLVQCTPDLARQDCFSCLTSSINRMMPLFRIGARQFWPSCNSRYELYAFYNETAIGTPSPPPLFPGSTPPLTSPSIPALVGYCFLAQRTKKTFDTASASEVGDDMATADSLQLDYRTIQTATNDFAESNKIGRGGFGEVYKGTFSNGKEVAVKRLSKNSRQGEAEFKTEVVVVAKLQHRNLVRLLGFSLQGEERILVYEYMPNKSLDCLLFDPTKQTQLDWMQRYNIIGGIARGILYLHQDSRLTIIHRDLKASNILLDADINPKIADFGMARIFGLDQTQDNTSRIVGTYGYMAPEYAMHGQFSMKSDVYSFGVLVLEIISGRKNSSFDESDGAQDLLTHTWRLWTNRTALDLVDPLIANNCQNSEVVRCIHIGLLCVQEDPAKRPTISTVFMMLTSNTVTLPVPRQPGFFIQSSPVKDPTDSDQSTTTKSTPASIDDELITDLYPR

SEQ ID NO: 32850 - protein, 406 aa, Arabidopsis thaliana
MDGGAEGSQQPHLILANKLFLLTHPDVPDIEKVQLKSEVLDFIRSHGMAPLYETLIASSVLDLDQSLLESMRAANEEELKKLDEKIADAEENLGESEVREAHLAKALYFIRISDKEKALEQLKLTEGKTVAVGQKMDVVFYTLQLAFFYMDFDLVSKSIDKAKKLFEEGGDWERKNRLKVYEGLYCMSTRNFKKAASLFLDSISTFTTYEIFPYETFIFYTVLTSIITLDRVSLKQKVVDAPEILTVLGKIPFLSEFLNSLYECQYKAFFSAFGKFITRTRGHTSECMLLGFSGMAVQIKYDRYLYPHFRFYMREVRTVVYSQFLESYKSVTVEAMAKAFGVSVDFIDQELSRFIAAGKLHCKIDKVAGVLETNRPDAKNALYQATIKQGDFLLNRIQKLSRVIDL

SEQ ID NO: 32851 - protein, 374 aa, Arabidopsis thaliana
MDRISQLSDDLLLQILSFIPGKDVVATSLLSKRWQSLWMLVSELEYDDSYHTGDYKSFSQFVYRSLLSNNAPVIKHLHLNLGPDCPAIDIGLWIGFALTRRLRQLKINIRTSSNDASFSLPSSLYTSDTLETLRLINFVLLDVPSSVCLPSLKVLHLKTVDYEDDASLPSLLFGCPNLEELFVERHDQDLEMDVTFVVPSLRRLSMIDKNYGQCDRYVIDVPSLKYLNITDDAVYDVRQIENMPELVEAHVDITQGVTHKFLRALTSVRQLSLCLSLSEKQHESGLCGIETPIGWKLPSSVPECLLFSLEAFEWIGYKGRRGDREVATYVLKNAACLRTAKFSPESTDVGEKYHMLKELASVPTASTSSKLLFD

SEQ ID NO: 32852 - protein, 497 aa, Arabidopsis thaliana
MAMEQRPKTKIVCTLGPASRSVPMVEKLLMAGMSVARFNFSHGSYEYHQETLDNLRQAMLNTGMLCAVMLDTKGPEIRTGFLKDGKPIQLKQGQEITISTDYDLKGDEKTICMSYKKLAQDVNPGMVILCADGTISLKVLSCDKEKGTVRCRCENTSMLGERKNVNLPGVVVDLPTLTEKDKQDILEWGVPNQIDMIALSFVRKGSDLVQVRKLLGKHAKTILLMSKVENQEGVANFDDILINSDAFMIARGDLGMEIPIEKIFLAQKVMIYKCNFMGKPVVTATQMLESMIKSPRPTRAEATDVANAVLDGTDCVMLSGETAAGAYPELAVRTMAKICVEAESTLDYGDIFKRIMLHAAVPMSPMESLASSAVRTATSSRATLMMVLTRGGSTARLVAKYRPGIPILSVVVPEITSDSFDWACSNEAPARHSLIYRGLVPVLYAGSARASIDESTEETLEFASEYGKKKQLCKTGDSVVALFRTGNAIVIKILTVK

SEQ ID NO: 32853 - protein, 453 aa, Arabidopsis thaliana
MDTDLISNLPDDVLGKILSLVPTKLAAATSVLSKRWRNLLPLVDSLDFDETMLFYPDNKDGEDEASSYESGQRRRHSFSHFVDKTLALLSNAPLTEKFSLKCYHEDDGARINRWIRTALERGCLELNLEAANYLPIDSQYFTSNTLVKLTISDGFYPGGHLLPFGGVFFPALKTLTLVSVCFTSVEMINFFIHGCPALEELFLCVWMQYMSSPNVKRVTITSDFDDDIQRPSMVLKTPSLVYLDYSSYVAGNYYVVLDSLVEARLDLRLYEPIIYDEDGLWNAEVFGNITNLIEAIRTIKILHLSPSSLEVFYYCCDLPVLEDLVNLSIESDKEKGWEVMPRLLNKSPNLQTLVVKGLVHRVTYCCGDACACIRMKDREIVSCLSRCRVKVLKILGYGGSFRELKQMRHFLGKLKCLETVKVGVKEGSKKSNYLVANVMALPRVSSKCKIQFI

SEQ ID NO: 32854 - protein, 307 aa, Arabidopsis thaliana
MERIIGGKYKLGRKIGGGSFGEIFLGVFSLILEFCSSSLENSKTKHPQLLYEAKLYRTLEGGSGIPRIRWFGVDGTENALVMDLLGPSLEDLFVYCGRKFSPKTVLMLADQMLTRIEYVHSKGYLHRDIKPDNFLMGLGRKANQVYLIDFGLAKRYRDANTNRHIPYRENKNLTGTARYASCNTHLGIEQGRRDDLESLGYVLLYFLRGSLPWQGLKAVDKKQKYDKICEKKISTPIEVLCKSHPVEFASYFHYCHTLTFDQRPDYGFLKRLFRDLFSREGYEFDYIYDWTIIKYQQSQKTRSQSQV

SEQ ID NO: 32855 - protein, 307 aa, Arabidopsis thaliana
MERIIGGKYKLGRKIGGGSFGEIFLGFVFSSVLVPLVFRENSKTKHPQLLYEAKLYRILEGGSGIPRIKWFGVDGTENALVMDLLGPSLEDLFVYCGRKFSPKTVLMLADQMLTRIEFVHSKGYLHRDIKPDNFLMGLGRKANQVYLIDFGLAKRYRDANTNRHIPYRENKNLTGTARYASCNTHLGIEQSRRDDLESLGYVLLYFLRGSLPWQGLKAVDKKQKYDKICEKKISTPIEVLCKNHPVEFASYFHYCHTLTFDQRPDYGFLKRLFRDLFSREGYEFDYIFDWTIIKYQQAQKSRNQSQV

SEQ ID NO: 32856 - protein, 380 aa, Arabidopsis thaliana
MVMGIERKKLPTAKHYPHKQTPSSPFFFFFFHFPLFEIVKKILISLLLHSYIQLISSNVERICSVKACFHLRIFEKKVCNFMALEQQHVCEKRLQAKTFSTQEFQLTLNWDDLTCPICLDFPHNGVLLQCSSYGNGCRAFVCNTDHLHSNCLDRFISACGTESPPAPDEPRSKVLEESCKPVCPLCRGEVTGWLVVEEARLRLDEKKRCCEEERCRFMGTYLELRKHAQSEHPDSRPSEIDPARKLDWENFQQSSEIIDVLSTIHSEVPRGVVLGDYVIEYGDDDTGDEFEDVPNNEGNWWTSCILYQMFDNIRNARNRRRSRMSESRRGSRRSSYENSNSDDSSVASIEFPEYRVDEIDDEFISTSGANRSSSMHQRSE

SEQ ID NO: 32857 - protein, 498 aa, Arabidopsis thaliana
MPGGYKAFEICAKFCYGMTVTLNAYNITAVRCAAEYLEMTEDADRGNLIYKIEVFLNSGIFRSWKDSIIVLQTTRSLLPWSEDLKLVGRCIDSVSAKILVNPETITWSYTFNRKLSGPDKIVEYHREKREENVIPKDWWVEDVCELEIDMFKRVISVVKSSGRMNNGVIAEALRYYVARWLPESMESLTSEASSNKDLVETVVFLLPKVNRAMSYSSCSFLLKLLKVSILVGADETVREDLVENVSLKLHEASVKDLLIHEVELVHRIVDQFMADEKRVSEDDRYKEFVLGNGILLSVGRLIDAYLALNSELTLSSFVELSELVPESARPIHDGLYKAIDTFMKEHPELTKSEKKRLCGLMDVRKLTNEASTHAAQNERLPLRVVVQVLYFEQLRANHSPVASVAASSHSPVEKTEENKGEEATKKVELSKKSRGSKSTRSGGGAQLMPSRSRRIFEKIWPGKGEISNKSSEVSSGSSQSPPAKSSSSSSRRRRHSIS

SEQ ID NO: 32858 - protein, 506 aa, Arabidopsis thaliana
MASISLLQVSVAILCFLILHYFLFKKPHGRYPRNWPVLRMLPAMLKALHRIYDYSVKILETSDLTFPFKGPRFTGMDMLLTVDPANIHHIMSSNFSNYIKGPEFQDVFDVLGDSFITTDSELWKNMRKSYQAMLHSQEFQRFSMSTMTSKLKYGLVPLLNHFAEEGTTLDLQSVFGRFTFDTIFILVTGSDPRSLSIEMPEDEFAKALDDVGEGILYRHFKPRFLWKLQNWIGFGQEKKLTEANATFDRVCAKYISAKREEIKRSQGTSNGGSQDLLTSFIKLDTTKYKLLNPSDDKFLRDNILAFILAGRDTTATALSWFFWLLSENPHVVAKIHQEININTDLSRTGNSQENVDKLVYLHGALCEAMRLYPPVSFGRKSPIKSDVLPSGHKVDANSKIIICLYALGRMRAVWGEDASQFKPERWISENGGIKHEPSFKFLSFNAGPRTCLGKHLAMTQMKIVAVEILRNYDIKVLQGQKIVPALGFILSMKHGLQITVTKRCSA

SEQ ID NO: 32859 - protein, 319 aa, Arabidopsis thaliana
MTKIELRALGNTGLKVSAVGFGASPLGSVFGPVAEDDAVATVREAFRLGINFFDTSPYYGGTLSEKMLGKGLKALQVPRSDYIVATKCGRYKEGFDFSAERVRKSIDESLERLQLDYVDILHCHDIEFGSLDQIVSETIPALQKLKQEGKTRFIGITGLPLDIFTYVLDRVPPGTVDVILSYCHYGVNDSTLLDLLPYLKSKGVGVISASPLAMGLLTEQGPPEWHPASPELKSASKAAVAHCKSKGKKITKLALQYSLANKEISSVLVGMSSVSQVEENVAAVTELESLGMDQETLSEVEAILEPVKNLTWPSGIHQN

SEQ ID NO: 32860 - protein, 447 aa, Arabidopsis thaliana
MSHSWDGLGEIASVAQLTGLDAVKLIGLIVKAANTAWMHKKNCRQFAQHLKLIGNLLEQLKISEMKKYPETREPLEGLEDALRRSYLLVNSCRDRSYLYLLAMGWNIVYQFRKHQDEIDRFLKIIPLITLVDNARIRVILPAFWSNKFLCLMLWYIEILIVIQERFEYIDRDQREYTLDEEDRHVQDVILKQESTREAASVLKKTLSCSYPNLRFCEALKTENEKLQIELQRSQEHYDVAQCEVIQRLIGVTQAAAAVEPDSEKELTKKASKKSERSSSMKTEYSYDEDSPKKSSTRAASRSTSNVSSGHDLLSRRASQAQHHEEWHTDLLACCSEPSLCFKTFFFPCGTLAKIATAASNRHISSAEACNELMAYSLILSCCCYTCCVRRKLRKTLNITGGFIDDFLSHVMCCCCALVQELREVEIRGAYGTEKTKISPPSSQFMEH

SEQ ID NO: 32861 - protein, 433 aa, Arabidopsis thaliana
MEAMKETVEESLREMRETFASGRTRSLKWRKAQIGAIYEMVKDNEDKICNALFQDLGKHSTEAFRDELGVVLRTATVAINCLDKWAVPKHSKLPLLFYPAKGKVISEPYGTVLVLSSWNFPISLSLDPLIGAIAAGNTVLLKSSELSPNASAFLAKTIPAYLDTKAIKVIEGGPDVATILLQHQWDKIFFTGSPKIGRIIMAAAAQHLTPVTLELGGKSCISVDYVLIEKSFAPTLIDMLKPTIKSFFGENPKESGCLSRIANKHHVQRLSRLLSDPRPTILLDPPLDSEIMNEEIFGPILPIITVRDIQESIGIINTKPKPLAIYAFTNDENLKTRILSETSSGSVTFNDVMIQYMCDALPFGGVGESGIGRYHGKYSFDCFSHEKAIMEGSLGMDLEARYPPWNNFKLTFIRLAFREAYFKLILLMLGLKR

SEQ ID NO: 32862 - protein, 403 aa, Arabidopsis thaliana
MTVVREYDPTRDLVGVEDVERRCEVGPSGKLSLFTDLLGDPICRIRHSPSYLMLVAEMGTEKKEIVGMIRGCIKTVTCGQKLDLNHKSQNDVVKPLYTKLAYVLGLRVSPFHRRQGIGFKLVKMMEEWFRQNGAEYSYIATENDNQASVNLFTGKCGYSEFRTPSILVNPVYAHRVNVSRRVTVIKLEPVDAETLYRIRFSTTEFFPRDIDSVLNNKLSLGTFVAVPRGSCYGSGSGSWPGSAKFLEYPPESWAVLSVWNCKDSFLLEVRGASRLRRVVAKTTRVVDKTLPFLKLPSIPSVFEPFGLHFMYGIGGEGPRAVKMVKSLCAHAHNLAKAGGCGVVAAEVAGEDPLRRGIPHWKVLSCDEDLWCIKRLGDDYSDGVVGDWTKSPPGVSIFVDPREF

SEQ ID NO: 32863 - protein, 469 aa, Arabidopsis thaliana
MLPCLLVVLHRIYDYIVEILEISDLTFSFKGPWFAGMDTLLTVDPANIHHMMNSNFSNYIKGSDFKEVFDVFGDGIITTDSELWKNLRKSYQEMLHHQAFQSFSLSTTRSKLKDGLVPLLNHFAEEGTTVDLQDVLGRFTFDTILILITGSDPRSLSIEMHEDELAKALDVVGEGIFFRHVKPKFLWKLQNWMGFGHEKKMIEANATFDRVCAKYISDKRGEIIRSQRFSDISYGEPEDLLSSFMKLDTTKYNLLNPSDDKFLRDTILAFILAGRDTTASALTWFFWLLSENAQVVSKIRQEIINTNPSKNGNGQENLDKLVYLHGALCEAMRLYPPVSFGRKSPIKSDVLPSGHKVQANSKIIICLYALGRMRAVWGDDALEFKPERWVSDKGSLRHEPSFKFLSFNSGPRTCLGKHLAMTQMKMVAVEILHNYEIKVIKGQKIKPVLGFILSMKHGLRITITKRCPY

SEQ ID NO: 32864 - protein, 447 aa, Arabidopsis thaliana
MALQRQLLKRATSDIYHRRAISLLRTDFSTSPSIADAPPHIPPFVHQPRPYKGPSADEVLQKRKKFLGPSLFHYYQKPLNIVEGKMQYLYDESGRRYLDAFAGIVTVSCGHCHPDILNAITEQSKLLQHATTIYLHHAIGDFAEALAAKMPGNLKVVYFVNSGSEANELAMMMARLYTGSLEMISLRNAYHGGSSNTIGLTALNTWKYPLPQYGTSGKVAGFIAETIQGVGGAVELAPGYLKSVYEIVRNAGGVCIADEVQTGFGRTGSHYWGFQTQDVVPDIVTMAKGIGNGLPLGAVVTTPEIASVLASKILFNTFGGNPVCSAGGLAVLNVIDKEKRQEHCAEVGSHLIQRLKDVQKRHDIIGDVRGRGLMVGIELVSDRKDKTPAKAETSVLFEQLRELGILVGKGGLHGNVFRIKPPMCFTKDDAGKFLMHWTIPSPGCEQG

SEQ ID NO: 32865 - protein, 257 aa, Candida albicans
IIFRKRLDSDRNIDASLYFGNIDPQVTELLMYELFIQFGPVKSINMPKDRILKTHQGYGFVEFKNSADAKYTMEILRGIRLYGKALKLKRIDAKSQSSTNNPNNQTIGTFVQSDLINPNYIDVGAKLFINNLNPLVDESFLMDTFSKFGTLIRNPIIRRDSEGHSLGYGFLTYDDFESSDLCIQKMNNTILMNNKIAISYAFKDSSVDGKKSRHGDQVERKLAESAKKNNLLVTKTSKAGTTKGNKRKNKPHKVTKP

SEQ ID NO: 32866 - protein, 248 aa, Candida albicans
MARQFFVGGNFKANGTKQQITSIIDNLNKADLPKDVEVVICPPALYLGLAVEQNKQPTVAIGAQNVFDKSCGAFTGETCASQILDVGASWTLTGHSERRTIIKESDEFIAEKTKFALDTGVKVILCIGETLEERKGGVTLDVCARQLDAVSKIVSDWSNIVVAYEPVWAIGTGLAATPEDAEETHKGIRAHLAKTIGAEQAEKTRILYGGSVNGKNAKDFKDKANVDGFLVGGASLKPEFVDIIKSRL

SEQ ID NO: 32867 - protein, 510 aa, Lilium longiflorum
MANIDIEGILKELPADGRVPKTKLVCTLGPSSRSVPMLEKLLRAGMNTARFNFSHGTHEYHQETLDNLRIAMQNTQILCAVVLDTKGPEIRTGFLKDGKAVQPKEGQEIIVSTDYDLKGGGNTITMSYKKLPVDMKPGGTILCADGSISLTVLSCDPDAGTVRCRCENTALLGERKNVNLPGVVVDLPTLTEKDKEDILEWGVPNNIDMIALSFVRKGSDLVNVRQVLGSHAKNIKLMSKVENQEGVVNFDEILKETDAFMVARGDLGMEIPVEKIFLAQKLMIYICNLAGKPVVTATQMLESMIKSPRPTRAEATDVANAVLDGTDCVMLSGESAAGAYLEIAVKVMAKICIEAESSLDYDAIFKEMIRSAPLPMSPLESLASSAVRTANKAKAALIVVLTRGGTTAKLVAKYRPAVPILSVVVPVLTSDSFDWNVSDESPARHSLIYRGLIPLLAEGSAKATDAESTEVILEAALKSATARRLCKPGDSIVALHRIGVASVIKICIVK

SEQ ID NO: 32868 - protein, 173 aa, Hordeum vulgare subsp. vulgare
MAETEYRCFVGGLAWATDDHNLQAAFSQYGEILDAKIINDRETGRSRGFGFVTFGSEESMRQAIEEMNGKELDGRQVTVNEAQSRRSAGGGGGGYGGQRGGGGGYGGGGGYGGQGGGYGGQGGGGYGGQGGGGYGGQRGGGGGYGGGGGGYGGGGGGYGGQRGGGDSGGQWRS

SEQ ID NO: 32869 - protein, 179 aa, Saccharomyces cerevisiae
MVKVYIHDNKVDSDYRAPHNSGTELSLDELAKLGVIYKYCANEEEVNEIARQREYKNRDVVNICEGSFKSEAEFNEKLATFYQEHLHEDEEIRYCLEGAGYFDVRDASTPENWIRCLVESGDLLILPPGIYHRFTLTTSNHIKALRLFKDEPKWQAINRSNQADSLPVRKDYIALINQY

SEQ ID NO: 32870 - protein, 231 aa, Streptococcus pneumoniae
NSLFWNNHDLPRIVSIWGNDQEYREKSAKAFAILLHLMRGTPYIYQGEEIGMTNYPFETLDQVEDIESLNYPREALEKGVPIEEIMDSIRVIGRDNARTPMQWDESKNAGFSTGQPWLAVNPNYEMINVQEALANPDSIFYTYQKLVQIRKENSWLIRADFELLDTADKVFAYIRKDGDRRFLVVANLSNEEQDLTVEGKVKSVLIENTLAQEVFEKQILVPWDAFCVELL

SEQ ID NO: 32871 - protein, 369 aa, Photobacterium damselae subsp. piscicida
MKSRAAVAFGPGLPLEIVEIDVAPPKKGEVLVKISHTGVCHTDAYTLSGDDPEGLFPVVLGHEGAGVVVEVGEGVTSVKPGDHVIPLYTAECGECDFCTSGKTNLCVAVRETQGKGVMPDATSRFFVNGQPLYHYMGCSTFSEYTVVAEVSLAKINPQANAEQVCLLGCGVTTGIGAVHNTAKVQEGDSVAVFGLGGIGLAVVQGARQAKAGRIFAIDTNPSKFELAKQFGATDCINPNDYDKPVQQVLVEMTKWGVDHTFECIGNVNVMRSALESAHRGWGQSVIIGVAGAGKEISTRPFQLVTGRVWKGTAFGGVKGRTQLPGMVEDAMSGKIELAPFVTHTMELDKINEAFDLMHDGKSIRTVIHY

SEQ ID NO: 32872 - protein, 441 aa, Phaeodactylum tricornutum
MKFVQAAIFALAASASTTAAFAPAKTFGVRSFAPVSLIELEAKASIEDLSDAELKGKKVLVRCDVNVPLDGKKITDDTRIRSSIPTIEYLKNKGAIVSVCSHLGRPKDGPEDKFSLGPCAERMGELLGQTVTLAPDCIGEEVAKIVNDAKEGDVIMLENTRFYKEETKNDPEFVEKLAAPFDLYVNDAFGTAHRAHASTEGVTKFLKPSVGGFLLAKELEYLDGAISNGKKPMAAIVGGSKVSSKITVLEALLDKCDKVIIGGGMVFTFLKAKGFNVGTSLVEDDFVDTAKEVLAKAEKLGKEILLPIDIVIADKFDAEAETKVVSAEEIPDGWMGLDNGPETTAQQKEALSDCKTIIMNGPMGVFEFEKFAKGTFDLVNILADLSKDKGAITIIGGGDSVAATEQSGRAGDMSHISTGGGASLELLEGKVLPGVAALNDK

SEQ ID NO: 32873 - protein, 449 aa, Phaeodactylum tricornutum
MLFRMLTSTALRRSPVTTSLTCCCKANAFAVRIRSFHAAPVIQAKMTVEQLAQQVHMKGTNVLVRVDLNAPLATDDVTVTDDTRLRAIVPTTKFLLEQGANVILCSHFGRPKGEIIETGKNGRLNPVVKPLEVLLGQTITKLDDCMGPDVEAATKNLGEGKVVLLENTRFYSGETKNDPELAAGLGKLADYFVMDAFGTAHRAHSSTAGVTTHMKFNAAGKLMEKELQYLQGAVEEPKRPMMAIVGGAKVSTKIPVIESLLDKCDVILIGGGMIFTFYKALGYDIGASLVEDDIVELASSLMKKAEEKGVKLILPVDVVLADKFDNDANSAVAKVTDISGDWMGLDIGPETIDLFRSEIAEANTIVWNGPMGVFEFSNFAAGTNDVAQMLAQATAERGAVTIIGGGDSVAAVNKAGLGDKVSHISTGGGASLELLEGKVLPGVAALTEV

SEQ ID NO: 32874 - protein, 266 aa, Gossypium hirsutum
LSIEEVEVAPPQKDEVRIKILFTSLCHIDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQANKFGVTDFVNPKDYNKPVQEVIVEMTGGGVDRSVECTGSIQAMISAFECVHD

SEQ ID NO: 32875 - protein, 266 aa, Gossypium hirsutum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 32876 - protein, 266 aa, Gossypium herbaceum
LSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTDFVNPKDYNKPVQEVIVEMTGGGVDRSVECTGSIQAMISAFECVHD

SEQ ID NO: 32877 - protein, 266 aa, Gossypium raimondii
LSIEEVEVAPPQKDEVRIKILFTSLCHTDVHFWDAKGQNPLFPRILGHEAGGIVESVREGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTESVNPKDYNKPVQEVVVEMTGGGVDRSVECTGSIQAMISAFECVHD

SEQ ID NO: 32878 - protein, 266 aa, Gossypium robinsonii
  misc_feature (58)..(58): Xaa can be any naturally occurring amino acid
LSIEEVEVAPPQKDEVRIKILFTSLCHTDVYFWDAKGQNPLFPRILGHEAGGIVESVXKGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRSVECTGSIQAMISAFECVHD

SEQ ID NO: 32879 - protein, 1279 aa, Thermoanaerobacterium saccharolyticum
MYKKLFTKKFISFVMSLLLVLTAAFSSMPFHNVYAADNASVVANIVGDFQDQLGDSNWNIDSNITIMQYVGNGLYEFTTPTQLKAGSYQYKVALNHSWNGGGVPSQGNLTLNLTNDSYVTFWFDYNTQSVTDSTKYTPISNDKLPRLVGTIQSAIGAGKDWDPGTSTAIMIDDNFDNVYSYTAHIPKGDYQYKVTLGNTWAENYGANGVQDGSNIQLSVANDADITFFYDANTHNIWTNYSPTLTGLDNNIYYDDLKHDTHDPFFRNPFGAIKVGQTVTLRIQAKNHDLESARISYWDDINKTRTELPMTRIGESPDGNYEYWEIKLSFDHPTRIWYYFILKDGTKTAYYGDNDDQLGGLGKATDTVNKDFELTVYDKNFDTNDWMKGAVMYQIFPDRFYNGDTSNDHAKTLSRGNDPIEFHNDWNDLPDNPNNAGTPGYTGDGIWSNDFFGGDLKGIDDKLDYLKGLGVSVIYLNPIFESPSNHKYDTADYTKIDEMFGTTQDFEKLMSDAHAKGINIILDGVFNHTSDDSIYFNRYGKYPDLGAYQDWKDGNQSLSPYGDWYTINSDGTYECWWGYDSLPVIKSLNGSEYNVTSWANFIINDKNAISKYWLNPDENLNDGADGWRLDVENEVAHDFWTHFRDAINTVKPEAPMIAENWGDASLDLLGDSFNSVMNYQFRNDIIDFLIGQSFDDGNGQHNPIDAAKLDQRLMSIYERYPLPAFYSTMNLLGSHDTMSILTVFGYNSADPNENSDAAKRLAEQKLKLATILQMGYPGMADIYYGDEAGVSGGKDPDDRRTFPWGNEDTALQDFFKNVSSIRNNNQVLKTGDLETLYAQNDVYAIGRRIINGKDAFGNSYPDSAAIVAINRSNSDQQITIDTTKFLRDGVAFKDLINGDKSYTINGGQITINIPAMSGVMLISDDGQDLTAPQVPSNVVATSGNGKVDLSWSQSDGATGYNIYRSSVEGGLYEKIASNVTGTTFEDTNVTNGLKYVYAISAVDELGNESEMSIDTVAYPAYPIGWVGNLTQVVDNHVISVSNPTEDIYAEVWADGLTNSTGQGPNMIAQLGYKYVGGTVNDSVYGSVYNSVYGVDDSDFTWVNAQYVGDIGNNDQYKASLHLINRSMGYLMRFSDNQGQSWTTTDTLSFYVVPSDDLIKPTAPILNQPGVESSRVSLTWSPSTDNVGIYNYEIYRSDGGTFNKIATVSNEVYNYVDTSVINGTTYSYKVVAADPSFNRTESNVVTIKPDVVPIKVTFNVTVPDYTPNSVNLAGTFPNATW

SEQ ID NO: 32880 - protein, 339 aa, Escherichia coli
MSMIKSYAAKEAGGELEVYEYDPGELRPQDVEVQVDYCGICHSDLSMIDNEWGFSQYPLVAGHEVIGRVVALGSAAQDKGLQVGQRVGIGWTARSCGHCDACISGNQINCEQGAVPTIMNRGGFAEKLRADWQWVIPLPENIDIESAGPLLCGGITVFKPLLMHHITATSRVGVIGIGGLGHIAIKLLHAMGCEVTAFSSNPAKEQEVLAMGADKVVNSRDPQALKALAGQFDLIINTVNVSLDWQPYFEALTYGGNFHTVGAVLTPLSVPAFTLIAGDRSVSGSATGTPYELRKLMRFAARSKVAPTTELFPMSKINDAIQHVRDGKARYRVVLKADF

SEQ ID NO: 32881 - protein, 107 aa, Agaricus bisporus
PDFEAVLLLADQLISRIEYIHSRNFIHRDIKPDNFLMGTGKRGNQVNVIDFGLAKKFRDPKTHLHIPYRENKNLTGTARYTSINTHLGVEQARRDGLEIWPNFEAVL

SEQ ID NO: 32882 - protein, 386 aa, Arabidopsis thaliana
MSFLIPNRGVGGTKIPLSIIVLVLCGFMFFILLYTERISLLSSSSSSSSSFFKLKSCPRKDEKIRKERSEILEVLDDRFEFDPEECNVAAGKWVYNSSIEPLYTDRSCPYIDRQFSCMKNGQPETDYLRWEWQPDDCTIPRKGTLSDGSLRYNANLEYNATIEFYWAPYIVESNTDIPVISDPKKRIVKVDSVKDRAKFWEGADILVFNTYVWWMSGLRMKALWGSFGNGESGAEALDTQVAYRLGLKTWANWVDSTVDPNKTRVFFTTMSPTHTRSADWGKPNGTKCFNETKPIKDKKFWGTGSNKQMMKVVSSVIKHMTTHVTVINITQLSEYRIDAHTSVYTETGGKILTAEQRADPMHHADCIHWCLPGLPDTWNRILLAHL

SEQ ID NO: 32883 - protein, 501 aa, Streptomyces coelicolor A3(2)
MTANVDGVPEKFATLGLTYDDVLLLPGASAVLPNAVDTSSRISRNVRVNIPLLSAAMDKVTESRMAISMARQGGVGVLHRNLSIEDQANQVDLVKRSESGMVANPITIHPDATLGEADALCAKFRISGVPVTDGAGKLLGIVTNRDMAFETDRSRQVREVMTPMPLVTGQVGISGVDAMELLRRHKIEKLPLVDGDGILKGLITVKDFVKAEQYPHAAKDAKGRLLVGAAVGASPEALDRAQALAEAGVDFLVVDTSHGHNSNALSWMSKIKSSVGIDVVGGNVATRDGAQALIDAGVDGIKVGVGPGSICTTRVVAGIGVPQVTAIYEASLAARAAGVPLIGDGGLQYSGDIGKALAAGADTVMLGSLLAGCEESPGELQFINGKQFKSYRGMGSLGAMQSRGQGRSYSKDRYFQAEVASDDKLVPEGIEGQVPYRGPLANVLHQLVGGLRQTMGYVGAATIEEMESKGRFVRITSAGLKESHPHDIQMTVEAPNYSRSK

SEQ ID NO: 32884 - protein, 374 aa, Streptomyces coelicolor A3(2)
MTEIEIGRGKRGRRAYAFDDIAVVPSRRTRDPKEVSIAWQIDAYRFELPFLAAPMDSVVSPATAIRIGELGGLGVLNLEGLWTRHEDPQPLLDEIAELDTDNATRRLQEIYAAPIKEELIGQRIKEVRDSGVVTAAALSPQRTAQFSKAVVDAGVDIFVIRGTTVSAEHVSGSHEPLNLKQFIYELDVPVIVGGCATYTAALHLMRTGAAGVLVGFGGGAAHTTRNVLGIQVPMATAVADVAAARRDYMDESGGRYVHVIADGGVGWSGDLPKAIACGADSVMMGSPLARATDAPGRGNHWGMEAVNEELPRGKKVDLGTVGTIEEILTGPSRNPDGSMNFFGALRRAMATTGYSELKEFQRVEVTVADSQHRR

SEQ ID NO: 32885 - protein, 117 aa, Agaricus bisporus
YMHSEGILAGELKHGPLALIDENMPVIIIMTRDSLYPKVQSAFAQITARKARPIVLCNEGDDGIPANATTIRVPQTVDSLQGLLNIIPLQLLSYHLAVKNGCDVDFPRNLAKSVTVE

SEQ ID NO: 32886 - protein, 332 aa, Gonyaulax polyedra
MAGPQLDDFTLVKVLGKGSYGKVMLVRGAQDNRLYAMKMLRKENVIKRNQVEHTKTERSVLETVSHPFIVTLHYAFQTPKKLYMVMEYCPGGELFFHLSRAGRFSEGRTRFYVAETSSAVAYLHQLNVIYRDLKPENLLIDGEGHAKITDFGLRKEGIQDNHSAMTMCGTPEYLAPEILDKKGHGKAVDWYSVGALTYEMLTGLPPFYTKDLQKLFDRIRRGELTYPDYVSVLAKEFLRALLQRNPDARLAGGVPGGDEVKGHEFFGGLDWVALEKRAIPPPFKPTFGGQKEDDVVKYFEKDFVGQPVVNSEVGEGGRDLGHLEASTLTGKR

SEQ ID NO: 32887 - protein, 400 aa, Streptomyces clavuligerus
MSNQEFAQRWQGVMIDSYGTPGLSFVRGEGSTLWDADGTAYTDFVSGLAVNALGHAHPAVVGAVSRQIASLGHISNFYSAEPTITLAERLIELFGRPGRVFFCNSGAEANETAFKIGRLTGRSRIVAAQSGFHGRTMGSLALTGQPAKREPFLPLPGDVTHVPYGDAEALRAAVTEDTAMVILEPIQGESGVVVPPKGYLRAAREITEATGTLLVLDEVQTGIGRTGHWFAAQAEGVEADVVTLAKGLGGGLPLGAAVAFGRAAELMTPGHHASTFGGNPVSCARTRVLDTIAADGLLDRVKQLGSAPDEWSVRDAAAIRWSPMSGAGLMLGIVLNEPLAPQVQLAAQKAGFLVNVPAPDVVRLIPPLVIEETEVDAFLQALPGLLDAVHERDREGQTGE

SEQ ID NO: 32888 - protein, 376 aa, Solanum dulcamara
MAIDCMITNGKSPMLDEKKTLIFDASHMKRESNIPTQFIWPDHEKPCAVAQQLAVPLIDLRGFLSGDSDAAQQASKLVGEACRSHGFFLVVNHGVEANLISNAHRYMDTFFDLPLSEKQKAQRKIGEHCGYASSFTGRFSSKLPWKETLSFRYSAEENSSHIVEEYFQRTLGESFNHLGNVYQEYCNSMNTLSLGIMELLGMSLGVEKSHFKEFFEENDSIMRLNYYPPCQKPELTLGTGPHCDPTSLTILHQDCVGGLQVFVDDEWRSITPTFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWLQHNTTAQL

SEQ ID NO: 32889 - protein, 225 aa, Solanum dulcamara
LSFQYSDEEGSSHIVEDYFQRTMGEKFSHLGKVYQDYCNAMSTLSLRIMELLGLSLGVSRNHFKEFFQENESIMRLNYYPTCQKPELTLGTGPHCDPTSLTILHQDSVGGLQVFVDNEWHSITPNFNAFVVNIGDTFMALSNGRYKSCLHRAVVNNKIPRKSLAFFLCPKKDKVVTPPIELVDSNNPRIYPDFTWPDLLEFTQKQYRADMNTLQTFSIWLQKTQV

SEQ ID NO: 32890 - protein, 170 aa, Arabidopsis thaliana
MRKLRGIKIRRPIKQISRWILRRIKIRRSRYTRLSPNRPVCKPRAITKLISWGRSLTSHSARFIGSKCSNSGYIPIGQEPIREKPDPVPKGHSAVYIGKKDGDFQRVLVPIVYFNHPLFGELLREAEEEFGFSQEGGITIPCPYSDFKRVQTRIESGSGFCKFPWSRRWQ

SEQ ID NO: 32891 - protein, 131 aa, Elaeis guineensis
MADPIRRTDEYGNPIPEHQGHGGAVTGGTYGTTTTPHEGVLHGEGGRQQQVHPGKEEHPGGRHHRSGSSSSSSSSEDDGQGGRRKKGLKEKIKEKLPGGGHKSEEHGQTDEGQHEKKGMMEKIKEKLPGHH

SEQ ID NO: 32892 - protein, 373 aa, Petunia x hybrida
MPLHLRCSATVCVTGAAGFIGSWLVMRLLERGYNVHATVRDPENKKKVKHLLELPKADTNLTLWKADLTVEGSFDEAIQGCQGVFHVATPMDFESKDPENEVIKPTVRGMLSIIESCAKANTVKRLVFTSSAGTLDVQEQQKLFYDQTSWSDLDFIYAKKMTGWMYFASKILAEKAAMEEAKKKNIDFISIIPPLVVGPFITPTFPPSLITALSLITGNEAHYCIIKQGQYVHLDDLCEAHIFLYEHPKADGRFICSSHHAIIYDVAKMVREKWPEYYVPTEFKGIDKDLPVVSFSSKKLTDMGFQFKYTLEDMYKGAIDTCRQKQLLPFSPRSAEDNGHNREAIAISAQNYASGKENAPVANHTEMLSNVEV

SEQ ID NO: 32893 - protein, 437 aa, Arabidopsis thaliana
MDRISNLPDGVIYRVISLLSTKEATCLKYTSKNWLNLVTIIPIAVFVDSSASAISASFKDFADRIMLARLASHRIRRFSLKLQSLNFAQYKTVNDCLRNVLECGVLDLELDINVRGDYSLPSEIFTCKSVVKMKLGSGFVIDILPKNAWLPALKTLLLDTVRFEFDNTAGCSFTKLISACPVLEELVIDGHNCEDWKWSRRVSSQILKRLTIRRKEWVHDGSSFEPISLDIPSLEYFKYFDTLRDSYPVVKLNSLVEAKLELPSLYIGDTYNVRNLIKGLKNVQILRLGAVDTMHLFWVFREAVPVFENLFHLSVSTHDAICWDDLRILLEKSPNLKTLTIEALHYHGYGDENSVCECLDGYSFLLSCPIEILKITEFGGEIEEMEQVEYVLENLLCLVLLEIHVKTKKIDRKLQILADLLMLPRASSKCKVQVKFV

SEQ ID NO: 32894 - protein, 457 aa, Arabidopsis thaliana
MDRISNLPDEIICHIGSFLSAREAAFTTVLSKRWHNLFTIVPDLHFDSSVKDGESLTDFVDRVMALPASSRVNKLSLKWWFDEDTDSAQFDEDTEPEDTEPAQFDQINRSLRVVLKRGVADFYLWVHGKQGYTLPFEVFTCETVTKLSLGSGFAIDFLPENALLPALKTLSLYHVRFYEFGRCAFKTLLASSPVLEELTVCGVNWELWKWSRTVSSSSLKRLTIMRKQWDAFDDSDFKSISFDTPSLAYLYYSDYVPKEYLSVNLDSLVETKLYLCPEENYMWGKGDEKRFNPINLLHGLKNVETLNLYTIMTAEMFYVFREALPVFQKLSHLSVNLSNFCWSSMPMLIKKAPNLKTLNIDGPLHYESYYRCAGDIFCECVSEYSFLVSCPLEVLKITEYYGSFRELMQMKHFLEKLSCLELVEVHSQATGERKLKLIADLERLPRASSKCKFEVVS

SEQ ID NO: 32895 - protein, 206 aa, Schizophyllum commune
MALCGSSKGRGRGRPIQRKVVVCGDGACGKTSLLNVFTRGFFTQVYEPTVFENYVHDLYIDDQLVELSLWDTAGQEEFDRLRSLSYAETHVIMICFSVDNPTSLENVESKWLDEILEYCPGVKLVLVDSKCDLRDDPAVLDRLQRYGTHTDQYEEGLGVARRIRASRYLECSSKHNRGVNEVFLRGRARVTVHSIRQGSAGSCCVM

SEQ ID NO: 32896 - protein, 318 aa, Neisseria meningitidis Z2491
MMGFLIGLSRNLTRFTALVILLASAVAFIGPTSFAWVKGDVQVLVLGIIMLGMGMTLGREDYRILAQRPLDVFIGAAVQYTVMPLLAIGIAKLFDLSLGLTLGLVLVGTCPGGVSSNIMSFLAKGDVAFSVGMTTVSTVLAPAVTPLWMTCLVGQTVDMDGWGMFRFMLLVTLLPVVLGSAANILLHGKHWFENVRAVMPGVAVLAFACIVGGVASVHGHRFAESALVMVLAIAVHNIAGYVSGYYAAALFGMDTAKKRTLAIEVGVQNAGLATGLSAKFFPGNAESAVAAAVACVWHSVSGTVLGNLFALWDKRRDA

SEQ ID NO: 32897 - protein, 490 aa, Neisseria meningitidis Z2491
MNQTSRDLTRISHNTKIVATLGPGSNNVELLEDMIRVGGLNVVRFNFSHGTPEFHQENARIVREAAKRTGQEIAIIADLQGPKIRVGKIAGGGIELNKGETLGLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 32898 - protein, 392 aa, Neisseria meningitidis Z2491
MAFLKLTEQNVQGKTVLIRADMNVPFKDGKISDDTRIRASIASVKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 32899 - protein, 482 aa, Neisseria meningitidis Z2491
MKGDIGVIGLAVMGQNLILNMNDCGFKVVAYNRTIGKVDEFLNGAAKGTGIIGAYSLQDLVDKLAKPRKIMMMVRAGSVVDDFIEQLLPLLEEGDIIIDGGNANYSDTTRRTHYLAGKGILFVGAGVSGGEEGARRGPSIMPGGDKRAWEAVKPIFQAIAAKTPQGEPCCDWVGRDGAGHFVKMVHNGIEYGDMQLICEAYQFMKDGLGLSYDEMHRVFAEWNKTELDSYLIEITAAILGYKDEGGEPLVEKILDTAGQKGTGKWTGINALDLGIPLTLISEAVFARCVSSFKEQRVQTGKLFARTVTPVEGGKQEWVEALRQTLLASKIISYAQGFMLIREAGESYGWDLDYGNTALLWREGCIIRSAFLSNIRDAYENNPDLVFLGTDPYFKNILENCLPAWRKVVAKAVECGIPMPCMASAITFLDGYTTERLPANLLQAQRDYFGAHTYERTDKPRGEFFHTNWTGKGGDTASTTYDI

SEQ ID NO: 32900 - protein, 322 aa, Neisseria meningitidis Z2491
MGIEIMNHKKIVVLDADTLPGRVFHFDFPHELAVYGTTGADETAERVRDAHIVITNKVMISADIIAANPQLELIAVSATGVNNVDIGAAKAAGVAVCNVRAYGNESVAEHAFMLMIALMRNLPAYQRDVAAGLWEKSPFFCHYGAPIRDLNGKTLAVFGRGNIGRTLARYAQAFGMRVVFAEHKHAHAVREGYVSFEDAVQTADVLSLHCPLNAQTENMIGENELRQMKPGAVLINCGRGGLVDENALLAALKYGQIGGAGVDVLTEEPPRGGNPLLNARLPNLIVTPHTAWASREALDRLFDILLANIHSFVKGEAQNRVV

SEQ ID NO: 32901 - protein, 187 aa, Neisseria meningitidis Z2491
MTDLETKRLETQAMLENADLLFDQGQCRAALQKVADEITRDLGGKYPLLLPVMGGAVVFTGQLLPLLRFPLDFDYVHVSRYGDKLEGGAFNWKRMPDAEQIRGRHVVVLDDILDEGHTMSAIQAKLLEMGAASCRAAVFANKLIDKPKPIRADYVGLDVPNRYVFGYGMDAAGCWRNLGEIYALDGK

SEQ ID NO: 32902 - protein, 312 aa, Neisseria meningitidis Z2491
MLELNGLCKRFGGKTVADDICLTVGRGKILAVLGRSGCGKSTLLNMIAGIVRPDGGEIWLNGENITRMPPEKRRISLMFQDYALFPHMSALENAAFGLKMQKMPKAEAESLAMAALAEVGLENEAHRKPEKLSGGEKQRLALARALVVRPSLLLLDESFSSLDTHLRDRLRRMTAERIRKGGIPAVLVTHSPEEACTAADEIAVMHEGKILQCGTPETLVQTPAGVQVAHLMGLPNTDDDRHIPQHAVRFDQDGMECRVLSRTCLPESFSLSVLHPEHGILWLNLDMPHAGEISGNDTVRIHIEDREIVRFR

SEQ ID NO: 32903 - protein, 480 aa, Neisseria meningitidis Z2491
MKQLAMYINGRFENDFNGEWRNVLNPSTEEAIAREPKGGKADVDRAVAAARAAQPAWERLPAVERGAYLRKIAQGIRERADELTDTIVAEGGKTKDLARVEVMFTADYLDYQAEWARRYEGEIIQSDRPRENILLFKRPLGVIAGILPWNFPFFLIARKMGPALVTGNTIVVKPSSVTPINCHIFAEIVDAVGLPAGVFNVVNGPGAEIGNALSAHPQVDMVSLTGSVEAGRQVMEAASANITKVSLELGGKAPAIVLKDADLDLAVKSILASRVGNTGQICNCAERVYVHSSLKDAFIEKMTAAMKGVRYGNPAEAEAGALEMGPLIEERAVKAVAEKVERAVKQGAKLVCGGKRAEGRGYFFEPTLLTDTDNSMDIMKEETFGPVLPVSAFDTLDQVIALANDCEFGLTSSVYTTNLNEAFYVTRRLQFGETYINRENFEAMQGFHAGWKKSGIGGADGKHGLEEYLQTQVVYLETDI

SEQ ID NO: 32904 - protein, 286 aa, Neisseria meningitidis Z2491
MPVFPISLKIHAVKPTVRPYMSPSPFIEMKDVAFAYGDRPILNDINFSIPQGNFAAVMGGSGSGKTTLMRLITGQIRPQSGKVLIEGRDLAGFSADELYEHRRRMGVLFQHGALFTDLSVFDNIAFPMRELTRLPEAVIRDLVLLKLNAVGLRGVENLMPSELSGGMSRRVALARTIALDPEIMLYDEPFTGLDPISLGVIAHLISRVNKALRSTSVMVTHDIEKSLEIVDQVIFLAHGEIMFSGSPQEMRELDSPWVRQFVGGLADGPVAYRYPAQTSLQQDLLG

SEQ ID NO: 32905 - protein, 251 aa, Neisseria meningitidis Z2491
MWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 32906 - protein, 427 aa, Neisseria meningitidis Z2491
MNRNEILFDRAKAVIPGGVNSPVRAFGSVGGVPRFIKKAEGAYVWDENGTRYTDYVGSWGPAIVGHAHPEVIEAVREAALGGLSFGAPTEGEIAIAEEIAKIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGNDIACVILEPFVGNMNLVRPSEAFVKALRELTEKHGAVLIYDEVMTGFRVALGGAQSLHGITPDLTTMGKVIGGGMPLAAFGGRKDIMECISPLGGVYQAGTLSGNPIAVAAGLKTLEIIRREGFYENLTARTEQLVQGFRTAADAAGIEFTADSVGGMFGLYFAAHAPRNYADMARSNIEGFKQFFHGMLDRGIAFGPSAYEAGFVSAAHTPELIDETVAVAVEVFKAMAA

SEQ ID NO: 32907 - protein, 385 aa, Neisseria meningitidis Z2491
MPSVPTVYRSLPVHKPMSLTRLILKFYALLRLFLGKNARTAWISHPACAGHEPGANHPDSPDRILCIEQALRRAGIWQHLQTIEAEEISDTRLALVHSSKYLNRLESCQPQKGKIFRLNDDTAISTGSLSAARFAAGSAVQAVDMVMNRKAWHAFCAARPPGHHAGSGKAGGFCLLNNVAAGVMHAIAEYRLKRIAVIDFDVHYGDGTAEIFKDDPRILFFNLFETDLFPFPENNDMPDGGNMVHLPLPPGTGSRTFREAVRRQWLPRLAAFKPELVLLSAGFDAHRLDESGRLNLHEADFAWLTHKIIQTASGCPGKIVSVLEGGYTLEPLAQSAAEHIRVLAGLGKSDAATAYQKTLDPTKKRFAKPKTGQVRQPTQSDRYDI

SEQ ID NO: 32908 - protein, 131 aa, Neisseria meningitidis Z2491
MDKNLLEAVKFDEKGLVCAIAQDAETKRILMVAWMNAEALQKTVETGFAHYYSRSRQKQWMKGEESGHTQKVRELRLDCDGDAIVMLIAQNGGIACHTGRESCFYKVWRGGAWETADAVLKDEKEIYGSTH

SEQ ID NO: 32909 - protein, 261 aa, Neisseria meningitidis Z2491
MSRIRQAFAALDGGKALIPYITVGDPDIRTTLALMHGMVANGADILELGVPFSDPMADGPVIQRAAERALANGISLRDVLDVVRKFRETDTQTPVVLMGYLNPVHKMGYREFAQEAAKAGVDGVLTVDSPVETIDPLYRELKDNGVDCIFLIAPTTTEDRIKTIAELAGGFVYYVSLKGVTGAASLDTDEVSRKIEYLHQYIDIPIGVGFGISNAESARKIGRVAEAVIVGSRIVKEIENNAGNEAAVVGALVKELKDAVR

SEQ ID NO: 32910 - protein, 242 aa, Neisseria meningitidis Z2491
MIKFKNVHKHFKDLHVINGVNLEIKKGEVVVVCGPSGSGKSTLIRTVNQLESIESGEIWVDGVNVADPKTDLNKIREEVGFVFQSFNLYPHLTVLENITLAPMKVKGQNAEQAEKKAMELLERVGLAHKKDAFPSQLSGGQQQRVAIARGLAMEPRVMLFDEPTSALDPEMVGEVLKVMKDLAESGMTMMCVTHEMGFAREVADRVIFVDKGQILEDETPEAFFTNPKHERAKQFLQQVMTH

SEQ ID NO: 32911 - protein, 315 aa, Neisseria meningitidis Z2491
MNILSKISSFIGKTFSLWAALFAAAAFFAPDTFKWAGPYIPWLLGIIMFGMGLTLKPSDFDILFKHPKAVIIGVIAQFAIMPATAWLLSKLLNLPAEIAVGVILVGCCPGGTASNVMTYLARGNVALSVAVTSVSTLISPLLTPAIFLMLAGEMLEIQAGSMLMSIVKMVLLPIVLGLIVHKVLGSKTEKLTDALPLVSVAAIVLIIGAVVGASKGKIMESGLLIFAVVVLHNGIGYLLGFFAAKWTGLPYDAQKTLAIEVGMQNSGLAAALAAAHFAVAPVVAVPGALFSVWHNISGSLLATYWAAKAGKHKKP

SEQ ID NO: 32912 - protein, 433 aa, Neisseria meningitidis Z2491
MPSEHQHISSLLDFDRTHLLHPYTSMTDPLPVYPVKRAEGVFIELADGTRLIDGMSSWWCAIHGYNHPVLNQVVETQIKQMAHVMFGGLTHESAVELGKLLVGILPQGLDRIFYADSGSVSVEVALKMAVQYRQARGLMAKQNIATVRRGYHGDTWNAMSVCDPETGMHHIFGSTLPQRYFVDNPKSRFDDEWDGADLQPVRALFEAHHADIAAFILEPVVQGAGGMYFYHPQYLRGLRDLCDEFDIVLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELDKGVDMARFQADCVAQGIWVRPFGRLVYLMPPYIISDGLLTELADKTVQILKEHSK

SEQ ID NO: 32913 - protein, 459 aa, Neisseria meningitidis Z2491
MAKTLKTLYQCTECGGTSPKWQGKCPHCGEWNTLQESLAAPEPKNARFQSWAADTSTVQSLSAVTAAEVPRNPTGMSELDRVLGGGLVDGAVILLGGDPGIGKSTLLLQTIAKMAQSRKVLYVSGEESAQQVALRAQRLELPTEGVNLLAEIRMEAIQTALKQHQPEVVVIDSIQTMYSDQITSAPGSVSQVRECAAQLTRMAKQMGIAMILVGHVTKDGAIAGPRVLEHMVDTVLYFEGDQHSNYRMIRAIKNRFGAANELGVFAMTENGLKGVSNPSAIFLASYRDDTPGSCVLVTQEGSRPLLVEIQALVDDAHGFTPKRLTVGLEQNRLAMLLAVLNRHGGIACFDQDVFLNAVGGVKIGEPAADLAVILAMLSSFRNRPLPEKMVAFGEIGLSGEVRPVARGQERLKEAEKLGFKRAIVPKANMPRNVKEFPNLKIYGVSSLQEAIDICRDSRE

SEQ ID NO: 32914 - protein, 459 aa, Neisseria meningitidis Z2491
MLLDLNRFSFSVFLKEVRLLTALALPMLLAQVAQVGIGFVDTVMAGGAGKEDLAAVALGSSAFATVYITFMGIMAALNPMIAQLYGAGKTDEVGETGRQGIWFGLFLGVFGMVLMWAAITPFRNWLTLSDYVEGTMAQYMLFTSLAMPAAMVHRALHAYASSLNRPRLIMLVSFAAFVLNVPLNYIFVYGKFGMPALGGAGCGLATMAVFWFSALALWIYIAKENFFRPFGLTAKFGKPDWAVFKQIWKIGAPIGLSYFLEASAFSFIVFLIAPFGEDYVAAQQVGISLSGILYMIPQSVGSAGTVRIGFSLGRREFSRARYISGVSLVSGWMLAVITVLSLVLFRSPLVSMYNNDPAVLSIAATVLLFAGLFQPADFTQCIASYALRGYKVTKVPMFIHAAAFWGCGLLPGYLLAYRFDMGIYGFWTALIASLTIAAIALVWCLELCSREMVRSHKAV

SEQ ID NO: 32915 - protein, 215 aa, Neisseria meningitidis Z2491
MKALLLGAPGAGKGTQAQFITAAFGIPQISTGDMLRAAIKAGTPLGLEAKKIIDEGGLVRDDIIIGMVKERIAQDDCKNGFLFDGFPRTLAQAEAMVEAGVDLDAVVEIDVPDSVIVDRMSGRRVHLASGRTYHVTYNPPKVEGKDDVTGEDLIQRDDDKEETVKKRLAVYHEQTEVLVDFYSKLEGEHAPKYIKVDGTQPVEAVKAEVLGALGK

SEQ ID NO: 32916 - protein, 357 aa, Neisseria meningitidis Z2491
MSITIQNLNKHFGNFHALKNINLNVPTGKLVSLLGPSGCGKTTLLRIIAGLENADGGKILFDGQDVTAKHVRERKVGFVFQHYALFRHMNVFDNVAFGLTVLPKSERPSKGQIRAKVEELLKLVQLSHLAKSYPHQLSGGQRQRIALARALAVEPKLLLLDEPFGALDAKVRKELRTWLRDIHHNLGVTSILVTHDQEEALEVSDEIVVMNHGKIEQTGSAEAIYRKPENAFVTEFLGETDAFEGRIEKGFWHYNGFAWKLDAQYKWQEQTATGYIRPHEWQIAAEHETPMICAEIEKVHAVGALTHILVKHGKQDVHITLAGSDAARYPIAEGKELNLIPKQVYVFSQNELIEYSI

SEQ ID NO: 32917 - protein, 395 aa, Neisseria meningitidis Z2491
MNTLLKQLKPYPFARLHEAMQGISAPEGMEAVPLHIGEPKHPTPKVITDALTASLHELEKYPLTAGLPELRQACANWLKRRYDGLTVDADNEILPVLGSREALFSFVQTVLNPVSDGIKPAIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWDDEQHVIDNRRLYQEKFERVIPILQQVFDVKLPDASFYIWLKVPDGDDLAFARNLWQKAAIQVLPGRFLARDTEQGNPGEGYVRIALVADVATCVKAAEDIVSLYR

SEQ ID NO: 32918 - protein, 467 aa, Neisseria meningitidis Z2491
MKKIQADVVVIGGGTAGMGAFRNARLHSDNVYLIENNVFGTTCARVGCMPSKLLIAAAEARHHALHTDPFGVHLDKDSIVVNGEEVMQRVKSERDRFVGFVVADVEEWPADKRIMGSAKFIDEHTVQIDEHTQITAKSFVIATGSRPVILPQWQSLGNRLIINDDVFSWDTLPKRVAVFGPGVIGLELGQALHRLGVKVEIFGLGGIIGGISDPVVSDEAKAVFGEELKLHLDAKTEAKLDADGNVEVHWEQDGEKGVFVAEYMLAAVGRRPNVDNIGLENINIEKDARGVPVADPLTMQTSIPHIFIAGDASNQLPLLHEAADQGKIAGDNAGRYPNIGGGLRRSTIGVVFTSPQIGFVGLKYAQVAAQYQADEFVIGEVSFKNQGRSRVMLVNKGHMRLYAEKATGRFIGAEIVGPAAEHLAHLLAWAHQMKMTVPQMLDMPFYHPVIEEGLRTALRDADAKLKA

SEQ ID NO: 32919 - protein, 477 aa, Neisseria meningitidis Z2491
MSQYDVVVIGAGPGGYVAAIRAAQLGFKTACVDAGVNKAGNAPALGGTCLNVGCIPSKALLQSSEHFHAAQHEFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELLTEGVTALEFFASSEDIARIIHAHPTLSEVVHEAALAADKRALHG

SEQ ID NO: 32920 - protein, 296 aa, Neisseria meningitidis Z2491
MFPVFHLSGESRRRMLQAALRFPHVFKARAEDSHKGTFGTLAVVGGAVGMSGAPVLAASAAMYLGCGKVWAGFNQETLPFAVIAGFPEIMLDTADGLTKRQGINAWTAGCGLGTDKAAVGTLAGILTEHTDKPVLLDADALNILSTDAETRNLARGCKNLILTPHPAEAARLLGTTVAQVQADRTAAVRKIGAIFGATVVLKGHKTLVAASDTEIYVNESGNAGLATAGSGDVLGGIIGSLLAQGVPVFEAACAGAWLHGAAADVIKESAGIAAGLLAGEIAPAARWLRNRITESM

SEQ ID NO: 32921 - protein, 487 aa, Neisseria meningitidis Z2491
MRIVEKAYTFDDVLLVPAHSTVLPRDVKLQTKLTREITLNLPLLSAAMDTVTEARLAISMAQEGGIGIIHKNMPPEMQARAISKVKRHESGVVKDPVTVAPTTLIREVLEMRAQRKRKMSGLPVVENGKVVGIVTNRDLRFENRVDLPVSAIMTPRERLVTVPEGTSIDEARELMHTHKVERVLVLNEKDELKGLITVKDILKTTEFPNANKDSEGRLRVGAAVGTGGDTEERVKALVEAGVDVIVVDTAHGHSQGVIDRVRWVKETYPHIQVIGGNIATAKAALDLVAAGADAVKVGIGPGSICTTRIVAGVGVPQLTAIHNVAEALKGTGVPLIADGGIRFSGDIAKALAAGAYSVMLGGMFAGTEEAPGEIELYQGRSYKSYRGMGSLGAMSQGSADRYFQDKTDSADKYVPEGIEGRVPYKGPIVNIIHQLTGGLRSSMGYLGCANIAEMHEKAEFVEITSAGMSESHVHDVQITKEAPNYHR

SEQ ID NO: 32922 - protein, 242 aa, Neisseria meningitidis Z2491
MTTYRIAPSILSADFARLGEEVESVIAAGADLIHFDVMDNHYVPNLTFGPMVCAALKPYASVPIDVHLMVEPVDDLIQSFAKAGASIITFHPEASRHIDRSLSLIRDMGCQAGLVLNPATPVYLLENVLDRLDMVLLMSVNPGFGGQSFIPYTLEKIRQVRAMLDRYEEKSGRRIAIEVDGGIKTDNIAAAAQAGADTFVAGSAIFGKPDYKAVIDAMRAELEKSGRLNLAPMIEIEMPSEN

SEQ ID NO: 32923 - protein, 428 aa, Neisseria meningitidis Z2491 [sequence omitted]

SEQ ID NO: 32924 - protein, 397 aa, Neisseria meningitidis Z2491
MQNYLTPNFAFAPMIPERASGSRVWDTEGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGVVPDILSSAKALGCGFPIGAMLATETIAAAFQPGTHGSTFGGNPMACAVGSRAFDIINAPETLHNVRSQGQKLQTALLDLGRKTGLFSQVRGMGLLLGCVLDAPYRGRASEITAAALKHGVMILVAGADVLRFAPSLLLNDEDTAEGLRRLEHVLTEFAAANRP

SEQ ID NO: 32925 - protein, 166 aa, Neisseria meningitidis Z2491
MSQYFTLFRIEPAFDIDTENLEQTYRALAARFHPDKFASASAFEQKQAVMMSSTINDAYRTLKNPIDRAAYLLKTSGIDADAPEHTSFASEFLMQQMEWRETLMEARAGKDLESLKNLDNEIRDEQEKLFCGLKQSFARQDYDTAAQQVRQGRFLDKLRNEISSAL

SEQ ID NO: 32926 - protein, 477 aa, Neisseria meningitidis Z2491
MNEYSQLIKHPDISLSPISDGIGVGNPATGEILAYVRNTGSDKLKNLIQKAAAAQKLWAAKTALERADILWRWYFLVKENKEALARLMTMEQGKSLTESRGEIDYAASFVRWFAEEARRIDGDVLTSVKASQKLIVLKQPVGVTAAITPWNFPSAMIARKAAPALAVGCAMIVKPASLTPLSAYALVVLAYEAGVPQDLLPVVSGRASEIGREFATNPIIRKISFTGSTEVGAKIFADSAADIKKLSLELGGNAPFIVFDDADLDKAVEGALASKFRNSGQTCVCTNRVYAQSGIYDAFCRKLSEKAAALKLGNGLEDGVNQGPLIEEKAVEKVEQHIADALSKGAVCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 32927 - protein, 289 aa, Neisseria meningitidis Z2491
MSANEYTQIGWIGLGQMGLPMVTRLLDGGIEVGVYNRSPDKTAPISAKGAKVYGNTAELVRDYPVIFLMVSDYAAVCDILNGVRDGLAGKIIVNMSTISPTENLAVKALVEAAGGQFAEAPVSGSVGPATNGTLLILFGGSEAVLNPLQKIFSLVGKKTFHFGDVGKGSGAKLVLNSLLGIFGEAYSEAMLMARQFGIDTDTIVEAIGGSAMDSPMFQTKKSLWANREFPPAFALKHASKDLNLAVKELEQAGNTLPAVETVAASYRKAVEAGYGEQDVSGVYLKLAEH

SEQ ID NO: 32928 - protein, 227 aa, Neisseria meningitidis Z2491
MELVFIRHGQSEWNAKNLFTGWRDVKLSEQGLAEAAAAGKKLKENGYEFDIAFTSVLTRAIKTCNIVLEESDQLFVPQIKTWRLNERHYGRLQGLDKKQTAEQYGDEQVRIWRRSYDTLPPLLDKDDEFSAHKDRRYAHLPADVIPDGENLQVTLERVLPFWEDQIAPAILSGKRVLVAAHGNSLRALAKHIEGISDEDIMGLEIPTGQPLVYKLDDNLKVIEKFYL

SEQ ID NO: 32929 - protein, 174 aa, Neisseria meningitidis Z2491
MLDREGYRPNVGIILINERNEVFWGKRVREHSWQFPQGGIKPGESPETAMYRELYEEVGLLPQHVKIIGRTRDWLRYDVPNNWVRREWRGSYRGQKQIWYLLRLTGRDCDVNLRATRHPEFDGWRWHQYWAPVDEVIDFKRDVYLGALKELSSRFLRGMESYEDFAARQSSDNR

SEQ ID NO: 32930 - protein, 332 aa, Neisseria meningitidis Z2491
MKIAIYGTKSYDREHFTRANRHFGFELEFFDFMLDAKTAKMAEGAEAVCIFVNDDGSRPVLEKLAQIGVKTVALRCAGFNNVDLKAAEELGLKVVRVPAYSPESVAEHTVGLMLTLNRRIHKAYQRTRDANFSLEGLTGFNMYGKTAGVIGTGKIGIATMRILKGFGMNLLAHDPFCNPEAEKIGGRYVDLDELYAQSDIITLHCPSTPENHYMLNEAAFDKMKDGVMIINTSRGGLIDSAAAIEALKRRKIGALGMDVYENERELFFEDKSNDVITDDVFRRLSSCHNVLFTGHQAFLTEEALGNISEVTLSNIREVGQTGDCGNAVRADG

SEQ ID NO: 32931 - protein, 375 aa, Neisseria meningitidis Z2491
MLECTANHRSGEIMSQTIDELLLPHRNAIDTIDAEILRLLNERAQHAHAIGELKGTGAVYRPEREVAVLRRIQDLNKGPLPDESVARLFREVMSECLAVERPLTIAYLGPQGTFTQQAAIKHFGHAAHTMACPTIDNCFKQVETRQADYLVAPVENSTEGSVGRTLDLLAVTALQACGEVVLRIHHNLLRKNNGSTEGIAKVFSHAQALAQCNDWLGRHLPNAERIAVSSNAEAARLVAESDDGTVAAIAGRTAAEIYGLDMVAECIEDEPNNTTRFLVMGHHETGASGSDKTSLAVSAPNRAGAVASLLQPLTESGISMTKFESRPSKSVLWEYLFFIDIEGHRRDAQIQTALERLGERASFVKVIGSYPTAVL

SEQ ID NO: 32932 - protein, 436 aa, Neisseria meningitidis Z2491
MDTSKQTLLDGIFKLKANGTTVRTELMAGLTTFLTMCYIVIVNPLILGETGMDMGAVFVATCIASAIGCFVMGFVGNYPIALAPGMGLNAYFTFAVVKGMGVPWQVALGAVFISGLIFILFSFFKVREMLVNALPMGLKMSIAAGIGLFLALISLKGAGIIVANPATLVGLGDIHQPSALLALFGFAMVVVLGHFRVQGAIIITILTITVIASLMGLNEFHGIIGEVPSIAPTFMQMDFKGLFTVSMVSVIFVFFLVDLFDSTGTLVGVSHRAGLLVDGKLPRLKRALLADSTAIVAGAALGTSSTTPYVESAAGVSAGGRTGLTAVTVGVLMLACLMFSPLAKSVPAFATAPALLYVGTQMLRSARDIDWDDMTEAAPAFLTIVFMPFTYSIADGIAFGFISYAVVKLLCRRTKDVPPMVWIVAVLWALKFWYLG

SEQ ID NO: 32933 - protein, 1274 aa, Neisseria meningitidis Z2491
MPSEPVSGSNTNKPCLHTGLICVLPVSFSKKRKHLPCPHLKPCISSADLLRYYRIQTAPMPSEPPEKLWRIQKMFHFAFPAQTALRQAITDAYRRNEIEAVQDMLQRAQMSDEERNAASELARRLVTQVRAGRTKAGGVDALMHEFSLSSEEGIALMCLAEALLRIPDNATRDRLIADKISDGNWKSHLNNSPSLFVNAAAWGLLITGKLTATNDRQMSSALSRLISKGGAPLIRQGVNYAMRLLGKQFVTGQTIEEALQNGKEREKMGYRFSFDMLGEAAYTQADADRYYRDYVEAIHAIGKDAAGQGVYEGNGISVKLSAIHPRYSRAQHGRVMGELLPRLKELFLLGKKYDIGINIDAEEANRLELSLDLMEALVSDPDLAGYKGIGFVVQAYQKRCPFVIDYLIDLARRNNQKLMIRLVKGAYWDSEIKWAQVDGLNGYPTYTRKVHTDISYLACARKLLSAQDAVFPQFATHNAYTLGAIYQMGKGKDFEHQCLHGMGETLYDQVVGPQNLGRRVRVYAPVGTHETLLAYLVRRLLENGANSSFVNQIVDENISIDTLIRSPFDTIAEQGIHLHNALPLPRDLYGKCRLNSQGVDLSNENVLQQLQEQMNKAAAQDFHAASIVNGKARDVGEAQPIKNPADHDDIVGTVSFADAALAQEAVGAAVAAFPEWSATPAAERAACLRRFADLLEQHTPALMMLAVREAGKTLNNAIAEVREAVDFCRYYANEAEHTLPQDAKAVGAIVAISPWNFPLAIFTGEVVSALAAGNTVIAKPAEQTSLIAGYAVSLMHEAGIPTSALQLVLGAGDVGAALTNDARIGGVIFTGSTEVARLINKALAKRGDNPVLIAETGGQNAMIVDSTALAEQVCADVLNSAFDSAGQRCSALRILCVQEDVADRMLDMIKGAMDELVVGKPIQLTTDVGPVIDAEAQQNLLNHINKMKGVAKSYHEVKTAADVDSEKSTFVRPILFELNNLNELQREVFGPVLHVVRYRADKLDSVIDQINSKGYALTHGVHSRIEGTVRHIRSRIEAGNVYVNRNIVGAVVGVQPFGGHGLSGTGPKAGGSFYLQKLTRIPEWVAPTLSQIGQADEAALKRLEALVHKLPFNAEEKKAAAAALGHARIRTLRRAETVLTGPTGERNSISWHAPKRVWVHGGSLLQAFCALTELAASGVQAVVEPDSPLASYTADLEGLLLVNGKPETADISHVAALSPLDSARKQELAAHDGALIRILPSENGLDILQVFEEISCSVNTTAAGGNASLMAVAD

SEQ ID NO: 32934 - protein, 472 aa, Neisseria meningitidis Z2491
MSIKNAVKLIEESEARFVDLRFTDTKGKQHHFTVPARIVLEDPEEWFENGQAFDGSSIGGWKGIQASDMQLRPDASTAFVDPFYDDATVVLTCDVIDPADGQGYDRDPRSIARRAEAYLKSSGIGDTAYFGPEPEFFVFDGVEFETDMHKTRYEITSESGAWASGLHMDGQNTGHRPAVKGGYAPVAPIDAGQDLRSAMVNILEELGIEVEVHHSEVGTGSQMEIGTRFATLVKRADQTQDMKYVIQNVAHNFGKTATFMPKPIMGDNGSGMHVHQSIWKDGQNLFAGDGYAGLSDTALYYIGGIIKHAKALNAITNPSTNSYKRLVPHFEAPTKLAYSAKNRSASIRIPSVNSSKARRIEARFPDPTANPYLAFAALLMAGLDGIQNKIHPGDPADKNLYDLPPEEDTLVPTVCASLEEALAALKADHEFLLRGGVFSKDWIDSYIAFKEEDVRRIRMAPHPLEFEMYYSL

SEQ ID NO: 32935 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTDLFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKESKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGLPKGMDPSQLIMEEKFGLTLQKEPPLYIVPKTRD

SEQ ID NO: 32936 - protein, 284 aa, Azospirillum brasilense
MSALNDKSVDNGRIARRFAALKAEGRAGLVTFITAGDPDLETCRAVLHGLPAAGADLIELGLPFSDPMADGPAIQAASLRALHAGTTARKTLDLVRGFRETDADTPVILMGYYNPIHAYGVDRFLADAIEAGVDGLIVVDLPPEEDEELCIPALKAGVNFIRLATPTTDDKRLPAVLQNTSGFVYYVSIAGITGAASADNAAVGAAVERLKRHTDLPVAVGFGIKTPEQAAEVARVADAAVVGSAIVTRLAGGLDADGKARPGLAEDVLGFVRELAGGVRGAAF

SEQ ID NO: 32937 - protein, 325 aa, Allium tuberosum
MGEVGPAIAKDVTELIGKTPLVYLNKVTAGCKARIAAKLEMMEPCSSVKDRIGYSMITEAEKQGLITPGVSVLIEPTSGNTGIGLAFMAAAKSYKLILTMPASMSLERRIILKAFGAELVLTDPVKGMKGACEKAEEIAAKTPNSYVLQQFENPSNPKIHYETTGPEIWKATDGKIDGLVSGIGTGGTITGSGKYLKEQNPSVKLYGVEPVESAILSGGKPGPHKIQGIGAGFIPGVLDVNLIDETLQVSSEEAIEMAKQLALQEGLLVGISSGAAAIAAIRVAQRPENEGKLIVVVFPSFGERYLSTVLFQSIKKEAESMVFEP

SEQ ID NO: 32938 - protein, 371 aa, Penicillium janthinellum
MPSYLRNLVWATLAAGLVSAAPTPSRVSDLTKKSSSTCTFSSAASASASKSSCSTIVLSNIEVPAGKTLDLTDLKDGTKVIFEGTTTFGYKEWSGPLIKISGSDITVEAADGAVINADGSRWWDGEGTNGGKTKPKFFYAHSLDDSTISGLNIKNTPVQAFSIQSDNLIIDGVTIDNSDGDENGGHNTDGFDISESTGVTIRNAVVKNQDDCIAINSGQNIYFTGGTCSGGHGLSIGSVGGRDDNTVKNVTITDSTVTDSANGVRIKTVYDATGSVSDVTFSDITVSGITDYGIVIEQDYENGSPTGTPTSGVPITDLTVKGITGSVESDAVEVYILCGDDACSDWTWSGVDITSGQTSSKCENVPSGASC

SEQ ID NO: 32939 - protein, 378 aa, Penicillium expansum
MILTRSVVLGFLGSASLALASPVAELAEGSRLTPRGSACSYSGTSGAAAAIAGKAGCSSITLNNVVVPAGTTLDLTGLASGTKVIFEGTTTFGYKQWAGPLISISGTNIQVSGASGHLIDGQGSRWWDGEGSNSKTNIKPKFFFAHSLKGSSTITGLNIKDSPVQVFSISGSSGLTISGVTIDNKNGDTNSLGHNTDGFDIGDSDSITITGATVYNQDDCLAINSGTNIVFSGGYCSGGHGLSIGSVGGRSNNVVETVHISSTQVVNSQNGVRVKAVSGATGTIKGVTFQDITLSGITSQGITIRQEYTNSGYTGSPTTGVPITGLTLNNVHGTVTSKGTDITIECGSSASCSGWTWTKVAVSGGKADVCKNAPSGTC

SEQ ID NO: 32940 - protein, 1312 aa, Klebsiella aerogenes
MGTTTMGVKLDDATRERIKSAASRIDRTPHWLIKQAIFNYLEKLENDETLPELPALLSGAANESDDASEPTEEPYQPFLEFAEQILPQSVRRAAITAAWRRPETDAVPMLLEQARLPQPLGEQAHKLAYQLAEKLRNQKTASGRAGMVQSLLQEFSLSSQEGVALMCLAEALLRIPDKATRDALIRDKISNGNWQSHIGRSPSLFVNAATWGLLFTGKLVSTHNETSLSRSLNRIIGKSGEPLIRKGVDMAMRLMGEQFVTGETIAEALANARKLEEKGFRYSYDMLGEAALTAADAQAYMVSYQQAIHAIGKASNGRGIYEGPGISIKLSALHPRYSRAQYDRVMEELYPRLKSLTLLARQYDIGINIDAEEADRLEISLDLLEKLCFEPELAGWNGIGFVIQAYQKRCPFVIDYLIDLATRSRRRLMIRLVKGAYWDSEIKRAQMEGLEGYPVYTRKVYTDVSYLACAKKLLAVPNLIYPQFATHNAHTLAAIYQLAGQNYYPGQYEFQCLHGMGEPLYEQVVGKVADGKLNRPCRIYAPVGTHETLLAYLVRRLLENGANTSFVNRIADNTLPLDELVADPVSAVEKLAQQEGQAGLPHPKIPLPRDLYGSGRSNSAGLDLANEHRLASLSSSLLNSALHKWQALPMLEQPVAEGEMQPVVNPAEPKDIVGYVREASDAEVQQALTSAINNAPIWFATPPQERAAILERAAVLMESQMPTLMGILVREAGKTFSNAIAEVREAVDFLHYYAGQVRDDFDNETHRPLGPVVCISPWNFPLAIFTGQIAAALAAGNSVLAKPAEQTPLIAAQGVAILLEAGVPPGVIQLLPGRGETVGAALTSDERVRGVMFTGSTEVATLLQRNIASRLDPQGRPTPLIAETGGMNAMIVDSSALTEQVVIDVLASAFDSAGQRCSALRVLCLQEEVADHTLTMLRGAMSECRMGNPGRLTTDIGPVIDAEAKENIERHIQAMRAKGRTVYQAVRENSEDAREWRHGTFVPPTLIELDSFDELKKEVFGPVLHVVRYNRNELDKLVEQINASGYGLTLGVHTRIDETIAQVTGSAKVGNLYVNRNMVGAVVGVQPFGGEGLSGTGPKAGGPLYLYRLLSSRPQDAVGVTFARQDAERPLDAQLKTLLEKPLQALQQWAAGRPELQALCQQYSEQAQSGTQRLLPGPTGERNTLTLMPRERVLCVADNEQDALIQLAAVLAVGCEVLWPDSALQRDLAKKLPREVSERIRFAKAEQLPVQAFDAVIYHGDSDQLRELCEQVAARDGAIVSVQGFARGETNLLLERLYIERSLSVNTAAAGA

SEQ ID NO: 32941 - protein, 294 aa, Escherichia coli O6
MKVGFIGLGIMGKPMSKNLLKAGYSLVVADRNPEAIADVIAAGAETASTAKAIAEQCDVIITMLPNSPHVKEVALGENGIIEGAKPGTVLIDMSSIAPLASREISEALKAKGIDMLDAPVSGGEPKAIDGTLSVMVGGDKAIFDKYYDLMKAMAGSVVHTGEIGAGNVTKLANQVIVALNIAAMSEALTLATKAGVNPDLVYQAIRGGLAGSTVLDAKAPMVMDRNFKPGFRIDLHIKDLANALDTSHGVGAQLPLTAAVMEMMQALRADGLGTADHSALACYYEKLAKVEVTR

SEQ ID NO: 32942 - protein, 509 aa, Arabidopsis thaliana
MLDISNYVFFFFTLVTILLSCLVYILTRHSHNPKCANLPPGPKGWPVVGNLLQFARSGKQFFEYVDEMRNIYGPIFTLKMGIRTMIIISDANLAHQALIERGAQFATRPAETPTRKIFSSSDITVHSAMYGPVWRSLRRNMVQNMLCSNRLKEFGSIRKSAIDKLVEKIKSEAKENDGLVWVLRNARFAAFCILLDMCFGVKMEEESIEKMDQMMTEILTAVDPRIHDYLPILTPFYFKERKNSLELRRKLVQFVVGFIEKRRLAIRNLGSDKTASSFAYLDTLFDLRVDGRETSPSDEDLVTLCSEFLNAGTDTTGTAIEWGIAELISNPKIQSRLYDEIKSTVGDDRTVEEKDLNKMVFLQAFVKELLRRHPPTYFTLTHGVTEPTNLAGYDIPVGANVEFYLPGISEDPKIWSKPEKFDPDRFITGGEDADLTGVAGVKMMPFGIGRRICPGLGMAVVHVELMLSRMVQEFEWSSYPPESQVDFTGKLVFAVVMKNPLRARVKARV

SEQ ID NO: 32943 - protein, 499 aa, Vitis vinifera
MELLSCLLCFLAAWTSIYIMFSARRGRKHAAHKLPPGPVPLPIIGSLLNLGNRPHESLANLAKTYGPIMTLKLGYVTTIVISSAPMAKEVLQKQDLSFCNRSIPDAIRAAKHNQLSMAWIPVSTTWRALRRTCNSHLFTSQKLDSNTHLRHQKVQELLANVEQSCQAGGPVDIGQEAFRTSLNLLSNTIFSVDLVDPISETAQEFKELVRGVMEEAGKPNLVYYFPVLRQIDPQGIRRRLTIYFGRMIEIFDRMIKQRLQLRKIQGSIASSDVLDVLLNISEDNSNEIERSHMEHLLLDLFAAGTDTTSSTLEWAMAELLHNPETLLKARMELLQTIGQDKQVKESDISRLPYLQAVVKETFRLHPAVPFLLPRRVEGDADIDGFAVPKNAQVLVNAWAIGRDPNTWENPNSFVPERFLGLDMDVKGQNFELIPFGAGRRICPGLPLAIRMVHLMLASLIHSYDWKLEDGVTPENMNMEERYGISLQKAQPLQALPVRV

SEQ ID NO: 32944 - protein, 155 aa, Hordeum vulgare
MLVYQDKLSGDELLSDSFPYRELENGVLWEVDGHWVVQGAVDVDIGANPSAEGGGEDEGVDDQAVKVVDIVDTFRLQEQPAFDKKQFIAYIKRYIKNLTAKLEGEELDAFKKNVESATKYLLSKLKDLQFFVGESMHDDGSVVFKLDCLLQGGSC

SEQ ID NO: 32945 - protein, 480 aa, Arabidopsis thaliana
MASISLFEASIAIFCFIILHFFLGNWPVLGMLPGLLLEFHRIYDFSVEVLENSDLTFPFKGPWFTGMDMLFTVDPTNIHHIMSSNFSNYTKGPDFKQVFDVFGDGILTTDDSELWKNLKKASLVMLNHQGFQKNGTVVDLQDVFKRFMFDTTLVTVTGSADPRSLSIEMPEVEFAKALDHVGEGIMHRHVRPRLLWKLQKCVGFGQEKKFSKADATLNQACAKYILEKREETRSQGFDYHSNGSESEDILTYHIKIDTTKYELLNPSDDKFLRDTILAFVLAGRDTTASALTWFFWLLLENPQVVTKIRQEINTSNGGQEKPSCEPMEYLNNLVYLHGALYEAMRLYPPVPFERMSPIKPDVLPSGHKVDSSMKILIFIYALGRMRAVWGEDASEFKPERWLSETTSLRHEPSFKFLAFNAGPRSCIGKQLAMTLMKIVVVEILQNYDIKVVKGQKKIEPAPGPILRMKHGLRVTLTKKC

SEQ ID NO: 32946 - protein, 475 aa, Bersama lucens
  misc_feature (1)..(7): Xaa can be any naturally occurring amino acid
XXXXXXXKASAGFKAGVKDYKLNYYTPEYEPKDTDTLAAFRVTPQPGVPPEEAGAAVAAESSTGTWTTVWTDGFTSLDRYKGRCYHIEPVAGEENQYIAYVAYPLDLFEEGSVTNMVTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRVLFCAEALFKAQAETGEIKGHYLNATAGTCEEMLKRARCARELGVPIVMHDYLTGGFTANTSLAHYCRDNGLLLHIHRAMHACIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 32947 - protein, 475 aa, Goupia glabra
  misc_feature (1)..(7): Xaa can be any naturally occurring amino acid
XXXXXXXKARVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDAVLQFGGGTLGHPWGNAPGAVANRVALEACVKARNEGRDLAREGNEIIREASKWSPELAAACEVWKEIKFEFPPMDTL

SEQ ID NO: 32948 - protein, 475 aa, Malpighia coccigera
  misc_feature (1)..(10): Xaa can be any naturally occurring amino acid
XXXXXXXXXXVGFKAGVKDYKLTYYTPDYQTKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMMKRAIFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 32949 - protein, 475 aa, Planchonella pohlmaniana
  misc_feature (1)..(10): Xaa can be any naturally occurring amino acid
XXXXXXXXXXVGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEALYKAQAETGEIKGHYMNATAGTCEEMMKRAAFARELGVPIVMHDYLTGGFTANTSLAHYCRDNGLLLHIHRAMHAVIDRQKNHGMHFRVLAKGLRLSGGDHIHAGTVVGKLEGEREITLGFVDLLRDDYVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFAAMDTL

SEQ ID NO: 32950 - protein, 476 aa, Salix reticulata
  misc_feature (1)..(9): Xaa can be any naturally occurring amino acid
XXXXXXXXXSVGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPTAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEDMMKRAVFARELGVPIVMHDYLTGGFTANTTLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDKLD

SEQ ID NO: 32951 - protein, 475 aa, Stachyurus praecox
  misc_feature (1)..(9): Xaa can be any naturally occurring amino acid
XXXXXXXXXSVGFKAGVKDYKLTYYTPDYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVVLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 32952 - protein, 110 aa, Escherichia coli O157:H7
MQQRRPVRRALLSVSDKAGIVEFAQALSARGVELLSTGGTARLLAEKGLPVTEVSDYTGFPEMMDGRVKTLHPKVHGGILGRRGQDDAIMEEHQIQPIDMVVVNLYPFAQ

SEQ ID NO: 32953 - protein, 499 aa, Lotus corniculatus var. japonicus
MDIISFLYYSLFYVALFAIIKLFLGSRKFKNLPPGPTSLPIIGNLHHLKRPLHRTFRALSEKYGDVFSLWFGNRLVVVVSSFADVQECFTKNDVVLANRPRFLSGKYIFYNYTTLGSTSYGEHWRNLRRITSLDVLSNHRINSFSPIRRDETTRLIRKLAEDSAKNFSEVELTSRFFDMTFNNIMRMISGKRYYGEDCDMTELQEASEFRDMVTELLQLSGANNKADFMPILRLVDFEGLEKRVKGISSKTDRFLRGLLQEHRDKKQRTANTMIDHLLTLQESQPEYYTDQIIKGLALAMLLAGTDSSAVTLEWSMCNVLNYPEVLEKIKAELDTHVGQDRLVDESDIPKLTYLKNVINETLRLYTPAPLLLPHSASDDCTIGGYKVPRDTIVLINAWALHRDPQLWTEATTFKPERFDKKGELEKLIPFGLGRRACPGELLAIRAISMTLALLIQCFDWKRVSDEEIDMGERDGFVLMKSIPVKAMCKSRPVINNVFK

SEQ ID NO: 32954 - protein, 335 aa, Nicotiana tabacum
MVHEKQVIEEVSGWLRVFEDGSVDRTWTGPPEVKFMAEPVPPHDYFIDGVAVKDVVADEKSGSRLRIYLPERNDNSANKLPVILHFHGGGFCVSHADWFMYYTVYTRLARAAKAIIVSVFLPLAPEHRLPAACDAGFAALLWLRDLSRQQGHEPWLNDYADFNRVFLIGDSSGGNIVHQVAVKAGEENLSPMRLAGAIPIHPGFVRSYRSKSELEQEQTPFLTLDMVDKFLGLALPVGSNKDHQITCPMGEAAPAVEELKLPPYLYCVAEKDLIKDTEMEFYEAMKKGEKDVELFINNGVGHSFYLNKIAVRMDPVTGSETEKLCEAVAEFINKH

SEQ ID NO: 32955 - protein, 150 aa, Brassica oleracea
SRASGQGLEELMNEVVVISKLQHRNLVRVLGCCIEGEERLLVYEYMPNKSLDAYLFDPTKQKILDWKTRFNIMEGISRGVLYLHRDSRLFIIHRDLKASNILLDDNLNPKISDFGLARVFEANEDAAETRRVVGTYGYMSPEYAMEGYFS

SEQ ID NO: 32956 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRGEMINDGKSRFSINGKPIYHFLGTSTFSEYTVVHVGQVAKINPEAPLDKVCVLSCGMSTGFGATVNVAKPKKGQSVAIFGLGAVGLAAAEGARVSGASRIIGVDLNPSRFELAKNFGVTEFVNPKDHKKPVQEVIAEMTGGGVDRSVECTGSIQAMISAFECVHDGWGVAVLVGVPNKDDAFKTHPVNLLNERTLKGTFFGNYKPRTDIPAVVERYMNKELELDKFITHSVPFSEINKAFEYMLAGEGLRCVIRMVA

SEQ ID NO: 32957 - protein, 379 aa, Gossypium hirsutum
MSTAGQVIRCKAAVAWESGKPLSIEEVEVAPPQKDEVRIKILFTSLCHTDVYFWDAKGQNPLFPRILGHEAGGIVESVGEGVTDLKPGDHVLPIFTGECKECPHCLSEESNMCDLLRINTDRVGMINDGKSRFSINGKPIYHFLGTSTFSEYTVVHVGQVAKINPHAPLDKVCVLSCGMSTGFGATVNVAKPKKGQSVAIFGLGAVGLAAAEGARVSGASRIIGIDLNPSRFEQAKKFGVTEFVNPKDYNKPVQEVIVEMTGGGVDRTVQCTGSIQAMISAFECVHDGWGVAVLVGVPNKDDAFKTHPVNLLNERTLKGTFFGNYKPRSDIPAVVEKYMNKELELDKFITHTVPFSEINKAFELMLAGEGLRCCIRMDA

SEQ ID NO: 32958 - protein, 350 aa, Sorghum bicolor
MGEVVATWEATEGGAGVKGPVVVTGASGFLGSWLVMKLLQAGYTVRATVRDPANVVKTKPLLDLPGATERLSLWKADLADEGSFDDAIRGCTGVFHVATPMDFESKDPENEVIKPTVEGMMSIMRACKEAGTVRRIVFTSSAGTVNIEERQRPVYDQDNWSDVDFCQRVKMTGWMYFVSKSLAEKAAMAYAAEHGLDFISIIPTLVVGPFLSAGMPPSLITALALVTGNEAHYSILKQVQFVHLDDLCDAHLFLFEHPAAAGRYVCSSHDATIHGLAAMLRDRYPEYDIPERFPGIEDDLQPVHFSSKKLLDHGFTFKYTVEDMFDAAIRMCREKGLIPLATAGGGRALP

SEQ ID NO: 32959 - protein, 379 aa, Sorghum bicolor
MNGGASVKGPVVVTGASGFVGSWLVMKLLQAGYTVRATVRDPANVVKTKPLLDLPGATERLSLWKADLAVEGSFDDAIRGCTGVFHVATPMDFESKDPENEVIKPTVEGMISIMRACKEAGTVRRIVFTSSAGTCNIEEWRKPVYDEDNWTDVDFCRRVKMTGWMYFVSKTLAEKAALAYAAEHGMELVTIITTLVVGPFLSTGMPPSMITRLALVTGNEAHYSILKQVQFVHLDDLCDAHIFLFEHPAAAGRYVCSSCDTTIHDLAAMLRDRYPEYDIPERFPAGTGIEDDLQMVHMSAKKLQDLGFTFRYTRMEDMYDDAIRTCREKGLIPLAAAGRDDGSASVRAPGERDVTATAGGDVSAPVRAPGGETDVTIGA

SEQ ID NO: 32960 - protein, 1015 aa, Aquifex aeolicus
MNYMDISRRGFLKLSVGSVGAGILGGLGFDLTPAYARVRDLKITKAKVTKSICPYCSVSCGILAYSLSDGAMNVKERIIHVEGNPDDPINRGTLCPKGATLRDFVNAPDRLTKPLYRPAGSTEWKEISWDEAIEKFARWVKDTRDRTFIHKDKAGRVVNRCDSIVWAVGSPLGNEEGWLMVKIGIALGLSARETQATICHAPTVASLAPTFGRGAMTNNWVDISNSDLVFVMGGNPAENHPCGFKWAIKAREKRGAKIICIDPRFNRTAAVADIFVQIRPGTDIAFLGGLINYVLQNEKYQKEYVRLHTTGPFIVREDFGFKDGLFTGYDPKTRSYDTTTWDYEFDPATGYPKMDPEMKHPRCVLNILKEHYSRYTPEVVSQICGCSKEDFLRVAEEVAKCGAPNKFMTILYALGWTHHSYGTQLIRTACMLQLLLGNIGCPGGGINALRGHSNVQGMTDLAGQNKNLPTYIKPPKPEEQTLAQHLKNRTPRKLHPTSLNYWANYPKFFISFLKCMWGDAATPENDFAYDYLYKPEGGYNSWDKFIDDMYKGKIEGVVTAALNFLNNTPNAKKTVRALKNLKWMVVMDPFMIETAQFWKAEGLDPKEVKTEILVLPTAVFLEKEGSFTNSARWVKWKYKATDPPGDAKDEFWIFGRFFMKLKEFYEKEGGAFPEPILNLVWPYKNPYYPTAEEILTEINGYYTRDVDGHKKGERVRLFTDLRDDGSTACGGWLYCGVFPPEGNLAKRTDLSDPLGLGTYPNYAWNWPANRRVLYNRASCDEKGRPWDPERPLLRWDPERDMWVGDIPDYPATAPPEKGIGAFIMLPEGKGRLFAAKSYVTFKDGPLPEHYEPYESPVTNILHPNVPHNPVAKVYKSDLDLLGTPDKFPHVATTYRLTEHYHFWTKHLYGPSLLAPVMFIEIPEELAKEKGIQNGDLVRVSTARASIEAIALVTKRIKPLKVAGKTVYTIGIPIHWGFEGLVKGAITNFITPNVWDPNSRTPEFKGFLANIEKVKT

SEQ ID NO: 32961 - protein, 492 aa, Zea mays
MRRGGAGAPPDLGSVLGHTTPNLRDLYALGRKLGQGQFGTTYLCTELATGIDYACKSISKRKLITKEDVDDVRREIQIMHHLSGHKNVVAIKGAYEDQVYVHIVMELCAGGELFDRIIQRGHYSERKAAALTRIIVGVVEACHSLGVMHRDLKPENFLLANRDDDLSLKAIDFGLSVFFKPGQVFTDVVGSPYYVAPEVLLKSYGPAADVWTAGVILYILLSGVPPFWAETQQGIFDAVLKGAIDFDSDPWPVISDSAKDLIRRMLNPRPAERLTAHEVLCHPWIRDHGVAPDRPLDPAVLSRIKQFSAMNKLKKMALRVIAESLSEEEIAGLKEMFQTMDTDNSGAITYDELKEGLRKYGSTLKDTEIRDLMDAADIDNSGTIDYIEFIAATLHLNKLEREEHLVAAFSYFDKDGSGYITVDELQLACKEHNMPDAFLDDVINEADQDNDGRIDYGEFVAMMTKGNMGVGRRTMRNSLNISMRDDLVCSET

SEQ ID NO: 32962 - protein, 298 aa, Brevibacillus brevis
MNKNMSIVGVPMDLGADRRGVDMGPSAIRYAGVVARLEKMGFNIEDRGDIFVTLPHHFTETENHKYLDEVVEANEKLANVVSDIMTAGRFPLVLGGDHSIALGTIAGVAKHVKNLGVICLDAHGDLNTGATSPSGNIHGMPLAASLGYGHERLTNIGGYTPKVKAENVVIIGARDLDQGERELIKRIGMKVFTMHEIDKLGMARVMDEAIAHVSKNTDGVHLSLDLDGLDPHDAPGVGTPVIGGISYREGHVSLEMLADADILCSAEFVEVNPILDRENMTARVAVALMSSVFGDKLL

SEQ ID NO: 32963 - protein, 483 aa, Lycopersicon esculentum
MVSISKNNQKQQLLSKIATNDGHGENSPYFDGWKAYANNPFHPTDNPTGVIQMGLAENQLCFDLIQEWMVNNPKASICTVEGAENFQDIAIFQDYHGLPEFRQAVARFMEKVRGDRVTFDPNRIVMSGGATGAHEMLAFCLADPGDAFLVPTPYYPGFDRDLRWRTGVQLFPVVCESCNDFKVTTKALEEAYEKAQQSNIKIKGLLINNPSNPLGTLLDKDTLRDIVTFINSKNIHLVCDEIYAATVFDQPRFISVSEMVEEMIECNTDLIHIVYSLSKDLGFPGFRVGIVYSYNDTVVNISRKMSSFGLVSTQTQHMLASMLSDEIFVEKFIAESSERLGKRQGMFTKGLAQVGISTLKSNAGLFFWMDLRRLLKEATFDGELELWRIIINEVKLNVSPGCSFHCSEPGWFRVCFANMDDETMRIALRRIRNFVLQTKGLNNIAAIKKQCSRSKLQISLSFRRLDDFNSPAHSPMNSPLVRT

SEQ ID NO: 32964 - protein, 477 aa, Lycopersicon esculentum
MGLISKIATNDGHGENSAYFDGWKAYENDPFHPTQNPNGVIQMGLAENQLCFDLIQEWIVNNPKASICTYEGVQDFQDTAIFQDYHGLPEFRKAVARFMEKVRGDRVRFDPERIVMSGGATGAHESLAFCLADPGDAFLVPTPYYPGFDRDLRWRTGVQLFPVVCESSNNFKVTKEALEEAYSKAQESNIKVKGLLINNPSNPLGTILDKETLKDILRFINDKNIHLVCDEIYAATAFSQPSFISISEVKSEVVGCNDDLVHIVYSLSKDLGFPGFRVGIIYSYNDAVVNIARKMSSFGLVSTQTQRLIASMLLDTIFVEDFIAKSSMRLLQRYGLFTKGLGQVGITTLKSNAGLFIWMDLRRFLENSTFDDELKLWHIIIDKVKLNVSPGCSFHCSEPGWFRVCFANMDDATMKIALRRIRHFVYLQPNKGVEVATKKQYCRTRSKLEISLSFRRLDDFMNSPHSPMSSPMVQARN

SEQ ID NO: 32965 - protein, 409 aa, Cyanophora paradoxa
MARQKFDGNKPHVNIGTIGHVDHGKTTLTAAITTALASQGKGKARKYDEIDAAPEEKARGITINTAHVEYETEKRHYAHVDCPGHADYVKNMITGAAQMDGAILVVSAADGPMPQTREHILLAKQVGVPNMVVFLNKEDQIDDADLLELVELEVRELLSKYDFPGDQIPFVSGSALLALESLSSNPKLMRGEDKWVDKILALMDAVDEYIPTPERPIDKSFLMAIEDVFSITGRGTVATGRIERGAIKVGETVELVGLKDTKSTTVTGLEMFQKTLEEGMAGDNIGILLRGVQKTDIERGMVLAKPGSITPHTQFESEVYVLTKDEGGRHTPFFSGYRPQFYVRTTDVTGSIDAFTADDGSNAEMVMPGDRIKMTVSLVHPIAIEQGMRFAIREGGRTIGAGVVSKILK

SEQ ID NO: 32966 - protein, 434 aa, Arabidopsis thaliana
DLPPSPPSLPIIGHLHLLLSVLLHRSLQKLSTKYGSILYLRVFRFPVVLISSASIAYEIFRAHDLNISYRGFTPTDDSLFAGSFSFISAPYGDYWKFMKKVLVTNVFGPQAHEQSRGVRADVLERFYGNLFDKAIKKQSVEICAEALKLSNSSICKMIMGRSCSEERFRALATELDVLTKKLFFANMLRAWFKKLVVSLFKKETTVISYRFDELLESILVEHEKKLDVHHQRTDLMDALLAAYRDENAEYKITRNHIKSIIADLLFAGTENQVQTIQWAMAEIINNPNVLERLRGEIDSVVGKSRLIQETDLPKLPYLQAVVKETIRLHPPGPFFLRFTKEGCRIRGFYVPENTSVVVNVYAVMRDPDAWEDPLVFKPERFLASSRAEQEEERREKEIKYLPFGSGRRSCPGENLAYVIMGTAIGVMVQGFEWR

SEQ ID NO: 32967 - protein, 512 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAELNKNHDFDHSLGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNPRVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 32968 - protein, 354 aa, Lycopersicon esculentum
MEKSNENVEAFGWAARDTSGVLSPFNFSRRVTGEKDVQFKVMYCGLCHSDLHQIKNEWSNSIYPMVPGHEVVGVVTEVGSKVERFKTGDKVGVGCLVGSCRKCENCDNDLENYCPDQIMTYNGVYTDGTPTYGGYSDIMVTNEHYVVHWPENLRMEAAPLLCAGITTYSPLRHYGLDKPGMHIGVVGLGGLGHMAVKFAKAMGTKVTVISTSASDEAVERLGADSFLVSRDPDKMQGAAGSLDGIIDTVSAIHPLLPLINLLKTHGKLVMVGAPEKPLELPVFPLLLGGKLVAGSAIGGMKETQEMVDFAGKHNITPDIGVVSMDYVNTALERLLKSDVKYRFVLDIGNTLKKN

SEQ ID NO: 32969 - protein, 406 aa, Bacillus subtilis
METPRKILLMVKAGTATDATIQSLLPHLEKDDILIDGGNTYYKDTQRRNKELAESGIHFIGTGVSGGEEGALKGPSIMPGGQKEAHELVKPILEAISAKVDGEPCTTYIGPDGAGHYVKMVHNGIEYGDMQLISESYFILKQVLGLSADELHEVFAEWNKGELDSYLIEITADIFTKKDEETGKPLVDVILDKAGQKGTGKWTSQSALDLGVPLPIITESVFARFISAMKEERVKASGLLSGPEVKPVTENKEELIEAVRKALFMSKICSYAQGFAQMKAASEEYNWDLKYGEIAMIFRGGCIIRAAFLQKIKEAYDREPELDNLLLDSYFKNIVESYQGALRQVISLAVAQGVPVPSFSSALAYYDSYRTAVLPANLIQAQRDYFGAHTYERTDKEGIFHTEWMK

SEQ ID NO: 32970 - protein, 325 aa, Vigna unguiculata
MSTGAGQVVCVTGASGYIASWVVKFLLERGYTVKATVRDTSDPKKVDHLLSLDGAKERLHLVKANLLEEGSFDSAVEGCHAVFHTASPFFDDAKDPQTELLDPALKGTLNVLKSCVNSPTLKRVVVTSSIAAVSFNDRPKNPDVVVDETWYSDPEYCKRNGIWYNLSKTLAEDAAWKFAKENNIDLVTANPALVVGPLLQPVLNTSSAAVLNLINGSPTFKNVTLGWVDVRDVAIAHVLAYENASANGRYLLVERVAHFGDVVKILHDLYPTLQLPQKCVDDRPYDPIFQVSKEKAKSLGLEFTPLEVSIKDTVESLKEKGFIKF

SEQ ID NO: 32971 - protein, 333 aa, Ipomoea purpurea
LLELPKADTNLTVWKGVMEEEGSFDEAIAGCEGVFHVATPMDFDSKDPENEVIKPTINGVLNIINSCVKAKTVKRLVFTSSAGTLNVQPQQKPVYDETCWSDLDFIYAKKMTGWMYFASKILAEKEAWKATKEKKIDFISIIPPLVVGPFITPTFPPSLITALSLITGNEAHYSIIKQGQYVHLDDLCEAHIFLYEHPKAEGRFICSSHHTTIHGLADMITHNWPEYYIPSQFKGIEKELAVVYFSSKKLQDMGFQFKYSLEDMYRGAIETLRKKGLLPYSTKEAAAIEEEQETVPLKVEEPTAIEQKQETVPLKFEEPTAIEQKQEVVPLKA

SEQ ID NO: 32972 - protein, 485 aa, Achromobacter xylosoxidans
MKEIKHFINGAFVGSASGKLFDNVSPANGQVIGRVHEAGRAEVDAAVKAARAALKGPWGKMTVAERAEILHRVADGITARFDEFLEAECLDTGKPKSLASHIDIPRGAANFKVFADLLKNVANETFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDMDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLADDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVK

SEQ ID NO: 32973 - protein, 50 aa, Pisum sativum
KKKVTVFFGTQTGTAEGFAKAIAEEAKARYEKAKFRVVDMDDYAADDDEY

SEQ ID NO: 32974 - protein, 489 aa, Spinacia oleracea
EDNHSTVEDDAANYDFDLFVIGAGSGGVRAARFSANLGAKVGICELPFHPISSEVIGGVGGTCVIRGCVPKKILVYGASFGGELEDAKNYGWELNEKIDFNWKKLLQKKTDEIIRLNNIYKRLLSNAGVKLYEGEGKIVGPNEVQVTQLDGTKLSYSAKHILIATGSRAQRPNIPGQELAITSDEALSLEEFPKRVVILGGGYISVEFASIWRGMGADVNLCFRKELPLRGFDDEMRAAVARNLEGRGVNVHPRTTLTELVKTDGGVVARTDHGEEIEADVVLFATGRSPNTKRLNLEALGVELDRTGAVKVDEYSRTSVPSIWAIGDVTNRMNLTPVALMEGTCFAKTVFGGQNSKPDYSNIACAVFSIPPLAVVGLSEEQAIEQASGDILVFTSSFNPMKNTISGRQEKTIMKLVVDAETDKVLGASMCGPDAAEIMQGIAIALKFGATKAQFDSTVGIHPSAAEEFVTMREPSRRVPGAGKPKTNL

SEQ ID NO: 32975 - protein, 496 aa, Oryza sativa
MARKMLKDEEVEVAVTDGGSYDYDLFVIGAVSGGVRGSRTSASFGAKFAICELPFHPISSDWQGGHGGTCVIRGCVPKKILVYGSSFRGEFEDAKNLGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 32976 - protein, 502 aa, Brassica rapa
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIRTGSRAQKPNIPGHELAITSDEALSLEEFPKRAIVLGGGYIAVEFASIWRGMGATVDLFFRKELPLRAFDDEMRELVARNLEGRGINLHPQTSWHELIKTDDGIKVISSHGEEFVADVVLFATGRIPNTKRLNLEAVGVELDQAGAVKVDEYSRTNIPSIWAVGDATNRINLTPVALMEATCFANTVFGGKLRKADYTNVACAVFCIPPLAVVGLSEEEAVEKATGDILVFTSGFNPMKNTISGRQEESLMKLIVDEKTDKVIGASMCGPDAAEIMQGIAIALKCGATKAQFDSTVGIHPSSAEEFVTMRTVTRRIANKAKPQTSL

SEQ ID NO: 32977 - protein, 171 aa, Spinacia oleracea
MASDSSAQPKSVHEFVVRDARGNDVDLSIYKGKVLLIVNVASQCGLTNSNYTEMTELYEKYRELGLEILAFPCNQFGNQEPGSNEEVLEFACTRFKAEYPIFDKVDVNGSNAAPIYKFLKSSKGGLFGDGLKWNFTKFLVDKDGNVVDRYAPTTSPKSIEKDVKKLLGIQK

SEQ ID NO: 32978 - protein, 339 aa, Hordeum vulgare
MENILHATPAHVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIQADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 32979 - protein, 409 aa, Sphingomonas sp.
VIGSVAIVGASAAGVAAATTLRDEGYEGEITLIGGETDLPYERPAVSKDILLTGAAPPIIPEQRYAELNIKLLLGTRAERIDARYGQIELSDGRTMVSDRLLLATGGWPRRLPVPGAELGGLHYVRDARDGQAIRSGLRPGARIAVVGGGLIGAEVAASAVQAGCEVDWIEAEGLCLARALSRPLAEAMMDVHRQRGVRVHANALVVRLIGERSVQAVELADGRRIDADMVVVGIGITPAAELAEEADLTVSDGIVIDPFCRTSAENVYAAGDVARHQTRYMATPSRLEHWRNAQEQGVTAARAMLGHRQPYDELPWFWTDQYDLHIEGCGVMRADDETILRGNLADGNATVFHLRAGSLVGACALNRQGDVRGAMRLITRGLTPSADILSDPTKDLRKIEKELSRASA

SEQ ID NO: 32980 - protein, 430 aa, Schizosaccharomyces pombe
NTSSTEQIEVLENEYAAHNYHPLPVCFSKAKGAKVWDPEGREYLDFLAAYSAVNQGHCHPKIIEALVEQAQRVTLSSRAFYNDKFGPFAKYITEYFDYEMVIPMNTGAETVETACKLARLWGNKAKKIPTDEAIILSCVDNFHGRTMGIISMSTDPDARDNYGPYLPNVGPKISGADRVLRYNNIEDLKYYLDTFGPKVAAFLVEPIQGEAGVMVPDDGYLEEAYKLCKAHNVLFIADEVQTGVARTGKMLCIEHSNVKPDVVILGKAISGGVYPVSAVLSSREIMLNFEPGTHGSTYGGNPLGAAVSIAALEVVKEEKLTERAAVLGEKFRTALIECKSPIVQKVRGRGLLNAVVIDESKTNGRTAWDLCLIMRSRGVLAKPTHGNIIRFSPPLVITEEDLMKGIEVIKKSLNDLPTIDMTPYAEKPIH

SEQ ID NO: 32981 - protein, 392 aa, Bacillus subtilis
MEKASGAYFWDVDGNKYIDYLAAYGPIITGHAHPHITEAIKKAAENGVLYGTPTKHEVTFAKMLKEAIPAMDKVRFVNSGTEAVMTTIRVARAYTGRTKIIKFAGCYHGHSDLVLVAAGSGPSTLGTPDSAGVPKSIANEVITVPFNDIDSYKAALEKWGSEIAAVLVEPIVGNFGIVEPKEGFLEQVNELTHNAGALVIYDEVITAFRFMYGGAQDLLQVKPDLTALGKIIGGGLPIGAYGGKQEIMEQVAPLGPAYQAGTMAGNPASILSGIACLEVLKEKGVYEKLDHLGAMLEEGIMKHAETHGITITVNRLKGALTVYFSDEKVENYEQAERSDGETFSTFFKLMLERGINLAPSKYEAWFITTAHTEQDIKDTLTAVEDAFKHLKN

SEQ ID NO: 32982 - protein, 357 aa, Lycopersicon esculentum
MKKGSFAPNLKLSLPPPDEVALSKFLTESGTFKDGDLLVNRDGVRIVSQSEVAAPSVIQPSDNQLCLADFESSKVIGKGNGGIVRLVQHKWTGQFFALKVIQMNIDESMRKHIAQELRINQSSQCPYVVICYQSFFDNGAISLILEYMDGGSLADFLKKVKTIPERFLAVICKQVLKGLWYLHHEKHIIHRDLKPSNLLINHRGDVKITDFGVSAVLASTSGLANTFVGTYNYMSPERISGGAYDYKSDIWSLGLVLLECATGHFPYKPPEGDEGWVNVYELMETIVDQPEPCAPPDQFSPQFCSFISACVQKHQKDRLSANDLMSHPFITMYDDQDIDLGSYFTSAGPPLATLTEL

SEQ ID NO: 32983 - protein, 512 aa, Solanum tuberosum
MDGTAVQGTSSVDSFLRNYKLGKTLGIGSFGKVKIAEHTLIGHKVAVKILNRRKIRNMDMEEKVSREIKILRLFMHGHISRLYEVIETPSDIYVVMEYVKSGELFDYIVEKGRLQEDEARNFFQQIISGVEYCHINMVVHRDLKPENLLLDSKWNVKIADFGLSNIMRDGHFLKTSCGSPNYAAPEVISGKLYAGPEVDVWSCGVILYALLCGTLPFDDENIPNLFKKIKGGYITLPSHLSAGARDLIPRMLIVDPMKRMTIPEIRLHPWFQAHLPRYLAVPPPDTMQQAKKIDEEILQEVVKMGFDRNNLTESLRNRVQNEGTVPYYLLLDNRHRVSTGYLGAEFQESMEYGYNRINSNEPLLPCWQRFPGIMDYQQAGARQFPIERKWALGLQSRAHPREIMTEVLKALQELNVCWKKIGQYNMKCRWVPSVPGHHEGMGVNSMHGNQFFGDDSSIIENDGDTKLTNVVKFEVQLYQTREEKYLLDLQDQGSQFLFLDLCAAFLAQLRVL

SEQ ID NO: 32984 - protein, 493 aa, Ricinus communis
MAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 32985 - protein, 227 aa, Lentinula edodes
MPTIIDKLSDALHLHSHQSTFDSKVTVIFVLGGPGAGKGTQCARLVEDFSFSHLSAGDLLRAEQHREGSEYGQLIQTCIKEGSTVPMEVTVKLLENAMTATLAERRSGEGWTDGQGRFLIDGFPRKMDQAEKFEHDVGKATAVKFFSTTQEVMLDRLLERGKTSGREDDNVESIKKRFNTYKEQTMPVIEHYEKLGKVIEIDSSVSIEEVHQKTRSAVAKLLSGSTA

SEQ ID NO: 32986 - protein, 482 aa, Lactobacillus gasseri
MTGYTMPKGFLWGGAVAAHQLEGAWNEDGKGMSVADVMTVGSATKPREITDGVIPGKNYPNHDAIDFYHHYKGDIKLMAEMGFKAFRTSIAWTRIFPKGDEKEPNEAGLKFYDDLFDECHKYGIEPVITLSHFEIPYHLVKEYGGFTNRKLIDYFVRFARVCFKRYKNKVKYWMTFNEIDNQSSFNNDFLMATNSGILFKNGMGDKEKEAAMYQAAHYELVASALAVKEGHKINPDFQIGCMINYSPVRPLTPSSDDVLLADKFEQRRDFFSDVHVNGEYPNAVEDYIERNGYRPDITEEDKIALKEGTVDYVGFSYYQSTTVSSKKVKPDELTDLQEAIVENPTLQRSDWGWEIDPEGLRISLNHLTDRYHKPLFIVENGLGAYDKREADGSVHDPYRIDYLRKHIEQMEKAVVLDGVDLMGYLPWGCIDLVSAGTGQMDKRYGFIYVDKNDKGEGTLERSKKDSFDWYKKVIESNGKDLD

SEQ ID NO: 32987 - protein, 491 aa, Lactobacillus gasseri
MSFPKNFLWGGATAANQIEGAYDEDGKGLSVTDITTAGSLDAPRMLTYKLNGKLEKTPGIPGAGLPEGAVGAIDPNEYYPNHVAIDFYHHYKEDIKMFAEMGFKTFRLSIAWTRIFPKGDEEKPNQAGLDFYRRVFEECKKYGIEPLVTISHYEDPLYLSEKYHDWGDRKMIDMYVKYATTLFEEYRGLVKYWLTFNEINSTLLMLSAFGNNVTDDKVYQHAYQKLHYQFVASARAVKIAHALDPNYVVGNMICGIVDYPLTPDPKDILANRHMWEQNIFYCGDVQAKGKYPTYAKRLWNEHNVHLDITEQDRKDLLEGKVDIYTFSYYMSNIITTHEVKDKVGGNFAAGVKNPYLKYSEWGWATDPDGLQYYLEVMYDRYDIPMMVVENGLGAVDKISDDGKIHDDYRIDYLRMHIKAMERAIDDGVDLIGYTTWGCIDLVSAGTGQMSKRYGFIYVDRDDEGNGTLKRMPKDSFYWYKKVIESDGKDLD

SEQ ID NO: 32988 - protein, 425 aa, Podospora anserina
MNSLTDLFLASLLVPTSPWLCLPPRIDTIDQRGGRVTLKQVRNPRGHKAFNPARATYRTFLKYGVPAPDYIKKAVAHIDEEQEEAFARIKRDTGSAAAIPINEVDIAYVTPVTIGTPPQTLMLDLDTGSSDLWVFSSLTPSNQVRGQEIYSPTKSSTSKLLSGHTWSIRYGDGSGSRGTVYTDNFTIGGLEVKSQAVQAALEVSSMLTQEQSLDGLVGLGFSALNTVRPSSQLTFFDNARPNLDEEVFTADLKYHAAGSYDFGFIDSKKYAGNITYTAVQQSPGYWTHSLSGYSVGSGAFQASQISYRQVQGAQNSQYYGGYVFPCYRQVQGAQNSQYYGGYVFPCSSTLPTFTFGIEGARFTIPASYINYTRISPTSTTCYGGLQSSSGLGINIFGDVALKRAFVVFSGTNPPRIGFAIKPLAS

SEQ ID NO: 32989 - protein, 469 aa, Garrya elliptica
  misc_feature (1)..(10): Xaa can be any naturally occurring amino acid
XXXXXXXXXXVGFKAGVKDYKLTYYTPDYETKDTDILAAFRVTPQPGVPPEEAGAAVAAESSTGTWTTVWTDGLTSLDRYKGRCYHIEPVVGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAINKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKAIKFEF

SEQ ID NO: 32990 - protein, 429 aa, Thermotoga maritima [sequence omitted]

SEQ ID NO: 32991 - protein, 217 aa, Nicotiana tabacum
MAGGYRAEDDYDYLFKLVLIGDSGVGKSNLLSRFSRNEFNLESKSTIGVEFATRSIRVDDKIVKAQIWDTAGQERYRAITSAYYRGAVGALVVYDITRHVTFENVERWLKELRDHTDQNIVIMLVGNKADLRHLRAVSTEDAKAFAERENTFFMETSALESLNVENAFTEVLTEIYKVVCRKALEVGDDPAALPKGQTINVGKDDVSAVKKVGCCSS

SEQ ID NO: 32992 - protein, 207 aa, Lycopersicon esculentum
MTAIGEVENPAVVQRPTEASKVKEQASATEKAVKEKKPRAPKEKKPKSAKAVTHPPYFQMIKEALLSLNEKGGSSPYAVAKYMEDKHKDELPANFRKILGLQLKNSAAKGKLIKIKASYKLSEAGKKETTTKTSTKKLPKADSKKKPRSTRATSTAAKKTEVPKKAKATPKPKKVGAKRTRKSTPAKAKQPKSIKSPAAKRAKKIAV

SEQ ID NO: 32993 - protein, 144 aa, Nicotiana sylvestris
MAFYNKLGGLLRQSISGNAVSATSPMPSMLDAVRCMSTKLFVGGLSWGTDDQSLRDAFATFGDVVDARVIVDRDSGRSRGFGFVNFSDDECANEAIKAMDGQELQGRNIRVSIAQERAPRSGGFGGSGGGFGGGYGQARDNDGY

SEQ ID NO: 32994 - protein, 216 aa, Hordeum vulgare
MGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAAGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRG

SEQ ID NO: 32995 - protein, 281 aa, Spinacia oleracea
MSKEVSEEAQAHQHGKDYVDPPPAPFFDLGELKLWSFWRAAIAEFIATLLFLYITVATVIGHSKETVVCGSVGLLGIAWAFGGMIFVLVYCTAGISGGHINPAVTFGLFLARKVSLLRALVYMIAQCLGAICGVGLVKAFMKGPYNQFGGGANSVALGYNKGTALGAEIIGTFVLVYTVFSATDPKRSARDSHVPILAPLPIGFAVFMVHLATIPITGTGINPARSFGPAVIFNSNKVWDDQWIFWVGPFIGAAVAAAYHQYVLRAAAIKALGSFRSNPTN

SEQ ID NO: 32996 - protein, 248 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFSLVYTVYPTAADPKKGSLGTIAPLAIGLIVGANILAAGPFSGGSMNPARSFGPAVAAGDFSGHWVYWVGPLIGGGLAGVTYGNVFMTSEHVPLASEF

SEQ ID NO: 32997 - protein, 377 aa, Buchnera sp.
MAKKDYYQILGIPKSAEEREIKKAYKKLAMKYHPDRNQGDKTAEGKFKEIKEAYEILINEEKRSAYDQYGHAAFENGQSNSTYSTFTNSADFSDIFGDVFGDIFGGNRTQRAKKGADLCYNMEITLEEAVKGIKKEIQIPTLQKCKTCYGSGTRTGTKPRSCSTCHGKGQIHIRKGFFTVQQSCSTCHGKGTIITDPCNLCHGQGRVETYKILSVKIPPGLDTNDRIRLNNEGEAGANGAQSGDLYVQITVKKHPIFEREGNNLYCEVPKNFTMAALGGEIEVPTLDGRVKLKIPYETQSGKLFRIRGRGVKSVQNRNQGDLLCRVVVETPVNLNEQQKNLLHELGNSFHGFRGEKNSPRSKRFFDGVKRFFDDLTR

SEQ ID NO: 32998 - protein, 135 aa, Gossypium hirsutum
MAHFQNQYSAPEVTQTDAYGNPTRRTDEYGNPIPTQETGRGILGIGGHHHGGHHGLHRTGSSSSSSSSSEDEGTGKKKKGLKQRLKEKIPGNKEHQSQATSTTTPGQGATYHQQHHEKKGVMDKIKEKLPGHHNP

SEQ ID NO: 32999 - protein, 154 aa, Sorghum bicolor
MEYGQQGQHGHGTTGLDQYGNPVAARNRGMRTGTGHGAMLGLSTACSLAWVEHGQFQPAREGAKDRMHLHRSGSSSSSSSETDGMGGRRKKGIGEKIKEKLPGAHKDNQHATAPAAAAYGQQGHTGVRTYGTEGTASEKKGIMDKIKEKLPGQH

SEQ ID NO: 33000 - protein, 148 aa, Cicer arietinum
MVLLISFEVSARDLTETSSNTEKEVAEQKNEVNDVKYGGGNYGNGGGNYGQGGGNYGNGGGNYGHGGGNYGNGGGNYGHGGGNYGNGGGNYGHGGGNYGHGGGNYGNGGHGGHGGGYCGNGCCGGYYSGSCRRCCSYVGEAIDVNTLN

SEQ ID NO: 33001 - protein, 461 aa, Escherichia coli
MADNKPELQRGLEARHIELIALGGTIGVGLFMGAASTLKWAGPSVLLAYIIAGLFVFFIMRSMGEMLSLEPVTGSFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGGFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 33002 - protein, 385 aa, Solanum tuberosum
HIITAVIGSGVLSLAWAIAQLGWVAGPAVLFAFSFITYFTSTLLADCYRSPGPISGKRNYTYMDVVRSHLGGVKVTLCGIAQYANLVGVTIGYTITASISMVAVKRSNCFHKNGHEASCSIESYPYMIIFAVIQIVLSQIPNFHKLSWLSILAAVMSFTYASIGLGLSIAKASGVGHHVKTALTGVVVGVDVSGTEKVWRSFQAIGDIAFAYAYSTVLIEIQDTLKSSPSESKVMKRASLAGVSTTTLFYVLCGTIGYAAFGNNAPGNFLTGFGFYEPFWLIDFANVCIAVHLVGAYQVFCQPLYGFVEGRCSERWPDSKFITSEYAMQVPWCGTYNLNLFRLVWRTTYVIVTAVIAMIFPFFNDFLGLIGAASFYPLTVYFPVE

SEQ ID NO: 33003 - protein, 190 aa, Salmonella typhimurium
SMTEQGLREVSNPSAIFLSRGDEVTSGSSVMVVWEGTRPLLVEIQALVDHSMMANPRRVAVGLEQNRLAILLAVLHRHGGLQMSDQDVFVNVVGGVKVTETSADLALLLAMVSSLRDRPLPQDLVVFGEVGLAGEIRPVPSGQERISEAAKHGFRRAIVPAANVPKKPPEGMLVFGVKKLADALSVFDDL

SEQ ID NO: 33004 - protein, 415 aa, Schizosaccharomyces pombe
MQSLKPLEPLPLLSSKTLKPIAHVNADVLISKVTVDDRFSSNDGISTPALSLEAVSNVSRTALEDAERSLHKSATTTSESGKSNGVAVIGHRGLGKNQPDRLSLQLGENTLQSFIKAADLGASYVELDVQMTKDMVPVVYHDFIVNETGTDAQVHSLTLEQFLGASHSPSEEIKDDASDIQQKRRPRAYSSSFTPSGSQVNFGEFAGENARLKPKVYKGNALGHTICAPSTTLKDVLKEVPQSVGLNVEFKYPMLSEAEEEKLLPIAYDYNFYVDTILSIIKKYGGKRKYIFSSFNPDICILLSLKSTNPVLFLTEGGTAYRTDVRAASLRQALKFASQWSFLGIVSACEPLIMCPRLIKAVKQLGLSCYTYGVLNNDVDNVRRQVRFGVDAVIVDNVLAIRRALNQYDESLESD

SEQ ID NO: 33005 - protein, 400 aa, Chlamydia trachomatis
MDFRWFMKRNPHFVSLTKNYLFADLQKRVAQFRLENPQHTVINLSIGDTTQPLNASVAEAFASSIARLSSPTTCRGYGPDFGLPALRQKLSEDFYRGFVDAKEIFISDGAKVDLFRLLSFFGPNQTVAIQDPSYPAYLDIARLTGAKEIIALPCLQENAFFPEFPEDTHIDILCLCSPNNPTGTVLNKDQLRAIVHYAIEHEILILFDAAYSTFISDPSLPKSIFEIPDARFCAIEINSFSKPLGFAGIRLGWTVIPQELTYADGHFVIQDWERFLSTTFNGASIPAQEAGVAGLSILPQLEAIHYYRENSDLLRKALLATGFEVFGGEHAPYLWVKPTQANISDRDLFDFFLREYHIAITPGIGFGRSGSGFVRFSSLGKREDILAACERLQMAPALQS

SEQ ID NO: 33006 - protein, 413 aa, Rhodobacter sphaeroides
MAKEPMLQFVKMARETPEKRPRSKRSQDFGEICGRICPQDRKCEGNCVIEQSGHGTVTIGAVEKYITDTAWENGWVVPGKPAYERSESVGIIGAGPGGLAAADALRRAGLQVTVYDRYDRAGGLLTYGIPGFKLEKDVVARRVEQLEQAGVQFVLNCNVGEDLSFDAIRGQHDAVLIATGVYKQRDLAAPGVGSAGVVQALSYLTASNRRSFGDEVDDDGLDASGKRVVVIGGGDTAMDCVRTAIRQGATSVKCLYRRDRANMPGSQREVANAEEEGVEFVWLSAPRGFIAGDAVEGVIVQKMRLGEPDATGRQMPEIIEGADYVEPADLAIMALGFEPEDLPTLWGVPDLTVTRWGTIKADFRTHATSLPGVYAVGDIVRGASLVVWAIRDGRDAAQSILDYLAQPAVVAAE

SEQ ID NO: 33007 - protein, 384 aa, Vigna unguiculata
MVTATATAAATAPSHQAIPLLTPYKMGKFNLSHRVVLAPLSRERSYNNVPQPHAVVYYSQRTSNGGLLIAEATGVSDTAQGYPNTPGIWTKEQVEAWKPIVDAVHAKGGIFFCQIWHVGRVSDSSYQPNGQAPISSTDKPLPPTPRANGLGYIEHTPPRRLTTEELPGIVNDFRIAARNAIEAGFDGVEVHGAHGYLLDQFLKDQANDRTDQYGGSLENRCRLPLEVVEAVVNEVGADRVGIRLSPFADFNDCGDSNPLQLGLYMVNALNKYNILYCHMVEPRMGSVGGPDENLTPMRKVFNGTFIVAGGYDREDGIKAIAEDRADLVAYGRLFLANPDLPKRFALNAPLNQYNRKTFYHEDPDPLVGYIDYPFLDEESNGVAS

SEQ ID NO: 33008 - protein, 1421 aa, Polyangium cellulosum
MADRPIERAAEDPIAIVGAGCRLPGGVIDLSGFWTLLEGSRDTVGQVPAERWDAAAWFDPDLDAPGKTPVTRASFLSDVACFDASFFGISPREALRMDPAHRLLLEVCWEALENAAIAPSALVGTETGVFIGIGPSEYEAALPRATASAEIDAHGGLGTMPSVGAGRISYVLGLRGPCVAVDTAYSSSLVAVHLACQSLRSGECSTALAGGVSLMLSPSTLVWLSKTRALATDGRCKAFSAEADGFGRGEGCAVVVLKRLSGARADGDRILAVIRGSAINHDGASSGLTVPNGSSQEIVLKRALADAGCAASSVGYVEAHGTGTTLGDPIEIQALNAVYGLGRDVATPLLIGSVKTNLGHPEYASGITGLLKVVLSLQHGQIPAHLHAQALNPRISWGDLRLTVTRARTPWPDWNTPRRAGVSSFGMSGTNAHVVLEEAPAATCTPPAPERPAELLVLSARTAAALDAHAARLRDHLETYPSQCLGDVAFSLATTRSAMEHRLAVAATSSEGLRAALDAAAQGQTPPGVVRGIADSSRGKLAFLFTGQGAQTLGMGRGLYDVWPAFREAFDLCVRLFNQELDRPLREVMWAEPASVDAALLDQTAFTQPALFTFEYALAALWRSWGVEPELVAGHSIGELVAACVAGVFSLEDAVFLVAARGRLMQALPAGGAMVSIAAPEADVAAAVAPHAASVSIAAVNGPDQVVIAGAGQPVHAIAAAMAARGARTKALHVSHAFHSPLMAPMLEAFGRVAESVSYRRPSIVLVSNLSGKAGTDEVSSPGYWVRHAREVVRFADGVKALHAAGAGTFVEVGPKSTLLGLVPACLPDARPALLASSRAGRDEPATVLEALGGLWAVGGLVSWAGLFPSGGRRVPLPTYPWQRERYWIDTKADDAARGDRRAPGAGHDEVEKGGAVRGGDRRSARLDHPPPESGRREKVEAAGDRPFRLEIDEPGVLDRLVLRVTERRAPGLGEVEIAVDAAGLSFNDVQLALGMVPDDLPGKPNPPLLLGGECAGRIVAVGEGVNGLVVGQPVIALSAGAFATHVTTSAALVLPRPQALSATEAAAMPVAYLTAWYALDGIARLQPGERVLIHAATGGVGLAAVQWAQHVGAEVHATAGTPEKRAYLESLGVRYVSDSRSDRFVADVRAWTGGEGVDVVLNSLSGELIDKSFNLLRSHGRFVELGKRDCYADNQLGLRPFLRNLSFSLVDLRGMMLERPARVRALFEELLGLIAAGVFTPPPIATLPIARVADAFRSMAQAQHLGKLVLTLGDPEVQIRIPTHAGAGPSTGDRDLLDRLASAAPAARAAALEAFLRTQVSQVLRTPEIKVGAEALFTRLGMDSLMAVELRNRIEASLKLKLSTTFLSTSPNIALLTQNLLDALATALSLERVAAENLRAGVQSDFVSSGADQDWEIIAL

SEQ ID NO: 33009 - protein, 2439 aa, Polyangium cellulosum
MATTNAGKLEHALLLMDKLAKKNASLEQERTEPIAIIGIGCRFPGGADTPEAFWELLDSGRDAVQPLDRRWALVGVHPSEEVPRWAGLLTEAVDGFDAAFFGTSPREARSLDPQQRLLLEVTWEGLEDAGIAPQSLDGSRTGVFLGACSSDYSHTVAQQRREEQDAYDITGNTLSVAAGRLSYTLGLQGPCLTVDTACSSSLVAIHLACRSLRARESDLALAGGVNMLLSSKTMIMLGRIQALSPDGHCRTFDASANGFVRGEGCGMVVLKRLSDAQRHGDRIWALIRGSAMNQDGRSTGLMAPNVLAQEALLRQALQSARVDAGAIDYVETHGTGTSLGDPIEVDALRAVMGPARADGSRCVLGAVKTNLGHLEGAAGVAGLIKAALALHHESIPRNLHFHTLNPRIRIEGTALALATEPVPWPRAGRPRFAGVSAFGLSGTNVHVVLEEAPATVLAPATPGRSAELLVLSAKSTAALDAQAARLSAHIAAYPEQGLGDVAFSLVATRSPMEHRLAVAATSREALRSALEAAAQGQTPAGAARGRAASSPGKLAFLFAGQGAQVPGMGRGLWEAWPAFRETFDRCVTLFDRELHQPLCEVMWAEPGSSRSSLLDQTAFTQPALFALEYALAALFRSWGVEPELIAGHSLGELVAACVAGVFSLEDAVRLVVARGRLMQALPAGGAMVSIAAPEADVAAAVAPHAASVSIAAVNGPEQVVIAGAEKFVQQIAAAFAARGARTKPLHVSHAFHSPLMDPMLEAFRRVTESVTYRRPSMALVSNLSGKPCTDEVCAPGYWVRHAREAVRFADGVKALHAAGAGIFVEVGPKPALLGLLPACLPDARPVLLPASRAGRDEAASALEALGGFWVVGGSVTWSGVFPSGGRRVPLPTYPWQRERYWIEAPVDGEADGIGRAQAGDHPLLGEAFSVSTHAGLRLWETTLDRKRLPWLGEHRAQGEVVFPGAGYLEMALSSGAEILGDGPIQVTDVVLIETLTFAGDTAVPVQVVTTEERPGRLRFQVASREPGARRASFRIHARGVLRRVGRAETPARLNLAALRARLHAAVPAAAIYGALAEMGLQYGPALRGLAELWRGEGEALGRVRLPESAGSATAYQLHPVLLDACVQMIVGAFADRDEATPWAPVEVGSVRLFQRSPGELWCHARVVSDGQQAPSRWSADFELMDGTGAVVAEISRLVVERLASGVRRRDADDWFLELDWEPAALEGPKITAGRWLLLGEGGGLGRSLCSALKAAGHVVVHAAGDDTSAAGMRALLANAFDGQAPTAVVHLSSLDGGGQLDPGLGAQGALDAPRSPDVDADALESALMRGCDSVLSLVQALVGMDLRNAPRLWLLTRGAQAAAAGDVSVVQAPLLGLGRTIALEHAELRCISVDLDPAQPEGEADALLAELLADDAEEEVALRGGERFVARLVHRLPEAQRREKIAPAGDRPFRLEIDEPGVLDQLVLRATGRRAPGPGEVEIAVEAAGLDSIDIQLAVGVAPNDLPGGEIEPSVLGSECAGRIVAVGEGVNGLVVGQPVIALAAGVFATHVTTSATLVLPRPLGLSATEAAAMPLAYLTAWYALDKVAHLQAGERVLIRAEAGGIGLCAVRWAQRVGAEVYATADTPEKRAYLESLGVRYVSDSRSGRFAADVHAWTDGEGVDVVLDSLSGEHIDKSLMVLRACGRLVKLGRRDDCADTQPGLPPLLRNFSFSQVDLRGMMLDQPARIRALLDELFGLVAAGAISPLGSGLRVGGSLTPPPVETFPISRAAEAFRRMAQGQHLGKLVLTLDDPEVRIRAPAESSVAVRADGTYLVTGGLGGLGLRVAGWLAERGAGQLVLVGRSGAASAEQRAAVAALEAHGARVTVAKADVADRSQIERVLREVTASGMPLRGVVHAAGLVDDGLLMQQTPARLRTVMGPKVQGALHLHTLTREAPLSFFVLYASAAGLFGSPGQGNYAAANAFLDALSHHRRAHGLPALSIDWGMFTEVGMAVAQENRGARLISRGMRGITPDEGLSALARLLEGDRVQTGVIPITPRQWVEFYPATAASRRLSRLVTTQRAVADRTAGDRDLLEQLASAEPSARAGLLQDVVRVQVSHVLRLPEDKIEVDAPLSSMGMDSLMSLELRNRIEAALGVAAPAALGWTYPTVAAITRWLLDDALAVRLGGGSDTDESTASAGSFVHVLRFRPVVKPRARLFCFHGSGGSPEGFRSWSEKSEWSDLEIVAMWHDRSLASEDAPGKKYVQEAASLIQHYADAPFALVGFSLGVRFVMGTAVELASRSGAPAPLAVFALGGSLISSSEITPEMETDIIAKLFFRNAAGFVRSTQQVQADARADKVITDTMVAPAPGDSKEPPSKIAVPIVAIAGSDDVIVPPSDVQDLQSRTTERFYMHLLPGDHEFLVDRGREIMHIVDSHLNPLLAARTTSSGPAFEAK

SEQ ID NO: 33010 - protein, 189 aa, Escherichia coli
MSGDILQTPDAPKPQGALDNYFKITARGSTVRQEVLAGLTTFLAMVYSVIVVPGMLGKAGFPPAAVFVATCLVAGFGSLLMGLWANLPMAIGCAISLTAFTAFSLVLGQQISVPVALGAVFLMGVIFTAISVTGVRTWILRNLPMGIAHGTGIGIGLFLLLIAANGVGMVIKNPIEGLQWRSVRLPPSR

SEQ ID NO: 33011 - protein, 276 aa, Escherichia coli
MALGAFTSFPVMMSLLGLAVIFGLEKCRVPGGILLVIIAISIIGLIFDPAVKYHGLVAMPSLTGEDGKSLIFSLDIMGALQPTVLPSVLALVMTAVFDATGTIRAVAGQANLLDKDNQIINGGKALTSDSVSSIFSGLVGAAPAAVYIESAAGTAAGGKTGLTATVVGALFLLILFLSPLSFLIPGYATAPALMYVGLLMLSNVSKLDFNDFIDAMAGLVCAVFIVLTCNIVTGIMLGFVTLVVGRVFAREWQKLNIGTVIITAALVAFYAGGWAI

SEQ ID NO: 33012 - protein, 422 aa, Deinococcus radiodurans [sequence omitted]

SEQ ID NO: 33013 - protein, 482 aa, Deinococcus radiodurans
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 33014 - protein, 245 aa, Mycobacterium tuberculosis
LFGMHGQTYQALSARAAAFHERFVQALATGGGAYAAAEAASVSPLQSALDLLNAPTQALLGRPLVGNGANGAPGTGANGGDGGILFGSGGAGGSGAAGMAGGNGGAAGLFGNGGAGGAGGSATAGAAGAGGNGGAGGLLFGTAGAGGNGGLSLGLGVAGGAGGAGGSGGSDTAGHGGTGGAGGLLFGAGEDGTTPGGNGGAGGVAGLFGDGGNGGNAGVGTPAGNVGAGGTGGLLLGQDGMTGLT

SEQ ID NO: 33015 - protein, 509 aa, Mycobacterium tuberculosis
MPCPSRRPEQTRAARWYLAWRALTQQPWPQDTQRTVAASRYRGGVNDWVPTGRRCGPRRTAVGPPPAARRREGEPDNQDPAGLLTDKYELTMLAAALRDGSANRPTTFEVFARRLPTGRRYGVVAGTGRLLEALPQFRFDADACELLAQFLDPATVRYLREFRFRGDIDGYAEGELYFPGSPVLSVRGSFAECVLLETLVLSIFNHDTAIASAAARMVSAAGGRPLIEMGSRRTHERAAVAAARAAYIAGFAASSNLAAQRRYGVPAHGTAAHAFTMLHAQHGGPTELAERAAFRAQVEALGPGTTLLVDTYDVTTGVANAVAAAGAELGAIRIDSGELGVLARQAREQLDRLGATRTRIVVSGDLDEFSIAALRGEPVDSYGVGTSLVTGSGAPTANMVYKLVEVDGVPVQKRSSYKESPGGRKEALRRSRATGTITEELVHPAGRPPVIVEPHRVLTLPLVRAGQPVADTSLAAARQLVASGLRSLPGDGLKLAPGEPAIPTRTIPA

SEQ ID NO: 33016 - protein, 274 aa, Shewanella sp. DB6705
KLKDKTVGIVGAGNTGSAVAKCLQAYGVTVLLHDPVIQDSDPRDFISLDELIACCDVISLHVPITKTGEHKTWYLFDEARLNSLKQGTWLLNCCRGEVIDNQALIKVKLERPDIKLVLDVWEGEPNPMHELIPLVELATPHIAGYSLEGKARGTFMLYQKLMQVLGKDADKSMTALLPSLWSVQLDVESIPDQKSLLQLARFIYDLRDDDELFRKTILDDSSKNPQVNSLNNNGFDLMRKNHLHRREFSALRLVNTGHSDVNWLTNLGFSGIGQ

SEQ ID NO: 33017 - protein, 274 aa, Shewanella violacea
KLKDKTVGIVGAGNTGSAVAKCLQAYGVTVLLHDPVIQDSDPRDFISLDELIARCDVISLHVPIIKTGEHKTWYLFDETRLNSLKPGTWLLNCCRGEVIDNRALIKVKQQRPDIKLVLDVWEGEPNPMHELIPLVELATPHIAGYSLEGKARGTYMLYQKLMQVLGRDADKSMTTLLPSLWSVQLDIEPIPNEKSLLKLARFIYDLRDGDELFRETILDDSSKNDQVNCVNNNGFDLMRKNHQHRREFRALRLVNTGHSDVNWLTNLGFSGVGQ

SEQ ID NO: 33018 - protein, 1064 aa, Saccharomyces cerevisiae [sequence omitted]

SEQ ID NO: 33019 - protein, 191 aa, Streptomyces coelicolor
MTGTPQRSHPQPERTFVTIDFAALPDDFLWGTATSAYQIEGAVAEDGRSPSIWDTFSHTPGKIDNGDHGDVACDHYHRTHEDIELMRRLGTNAYRLSVAWPRVVPGGDGPVNAKGLAFYDRLVDDLLAAGITPSVTLYHWDLPQVLQDRGGWPERDTAEHFAAYAAVVAERLGDRVAHWATLNEPLCSAWI

SEQ ID NO: 33020 - protein, 408 aa, Streptomyces coelicolor
IDSPCELIDFWRFNVHYARNILAEQPPANSQGVWNRMDHRPLEGFVYAITPFNFSAIAANLPTAPALMGNVVVWKPSPTQTHAAVLLMQLLEEAGLPKGVINLVTGDGIAVSEVALEHRDLAGIHFTGSTKTFQHLWKTVGNNIEKYRTYPRLVGETGGKDFLVAHPSADRAVLKTALTRGAFEYQGQKCSATSRAYIPASIWNDGFKEEFAAEVDYLTMGDVTDLSNFIGAVIDERSFAKNKAAIDRAKEDETCTIVAGGSYDDSVGYFVRPTVVECTDPENEVFRTEYFGPFLAVHVYDDSADDAYDAMLTQMESVSDYALTGSVISNDRAAAAYTMEKLRYAAGNFYINDKSTGAVVGQQPFGGGRASGTNDKAGAPQNLMRWTLTRAIKETLVAPTDYTYPHMG

SEQ ID NO: 33021 - protein, 395 aa, Streptomyces coelicolor
SRNNCHHFVTRILEDLMGSRLTEEQSAFVAAVADFAKRECGTRQQRDALTGDGRGAHHPGLYGRLAELGWLGVCLPEEYGGAGGGLADACLFLEETSYGMVPAGGFITTVIAAKAYERFGTEKQRHEVLSGVVRGDVLSIAMSEPEAGSDVGALRCRARRAADGTWLIDGQKTWISNAHCARSILLVARTGEDKHGGLTMFHLPADTPGVEVRGIDTMGGREVNDVFLTGVRLPADAVVGQVDDGWRQLMAGLNHERLFLASNMLGLARRAFDDALGYVREREQFGRPVGSFQALRHRVADLATEIECTRLLVRDVALDCDAQPDRLFPREASMAKLKATEVAKRAALEGMQMMGGYGYTTEFDMERHLRAAVVSTVYGGTSEIQRDVIGKTYGL

SEQ ID NO: 33022 - protein, 236 aa, Streptomyces coelicolor
MKAVQVVGYGKNLEMAEVPAPEVTGPYDVIVRIGGAGVCRTDLHILEGQWAEKSGVELPYTIGHENAGWVHAVGSAVTNVSEGDKVIVHPLITCGLCRACRAGDDVHCENNRFPGIDTAGGYAEYLKTSARSVVRLDDSLEPADVAALADAGLTAYHAAAKAARRLRPGDRCVVIGAGGLGHIGIQVLGALTAAEIVVVDRNPDAVDLAVSVGADHGVLADGGHVDRVRELTGGHG

SEQ ID NO: 33023 - protein, 311 aa, Streptomyces coelicolor
AEHFAAYAAVVAERLGDRVAHWATLNEPLCSAWIGHLEGKMAPGQTDLTAAVRASYHLLLGHGLAMQAIRAAAPDAQVGIVNNLSTIHAATDREEDLAAARRMDGHTNRWWLDPVHGRGFPQDMREVYGVELPERPGDMRLIGAELDWLGLNYYFPQTVAADPTGPAPQVRTVRRAGVPRTGMDWEIDAGGIEELLLRLTEEYGPRKLYVTENGSSFPDLVRPDGSVDDPERQEYLTAHLAACASAARKGAPLAGYFAWSLLDNFEWAYGYDKRFGLVHVDYATQVRTIKGSGHHYADIIGRARGRERKAA

SEQ ID NO: 33024 - protein, 252 aa, Streptomyces coelicolor
NFIVVEEDRTARQIAEKRAARERNAAFAKRTRRVSLEDLDKVLKAGEVQQLNLIIKGDASGSVEALESSLLQLDVGEEVDIRVLHRGVGAVTESDIDLAMGSDAIVIGFNVRAAGRAAQMAEREGVDVRYYSVIYQAIEEIEAALKGMLKPEYEEVELGTAEIREVFRSSKLGNIAGVLIRSGEVKRNTKARLLRDGKVIAENLNIEGLRRFKDDVTEIREGFEGGINLGNFNDIKVDDVIATYEMREKPRV

SEQ ID NO: 33025 - protein, 420 aa, Streptomyces sp.
MTPAEKNWAGNITFGAKRLCVPRSVRELRETVAASGAVRPLGTRHSFNTVADTSGDHVSLAGLPRVVDIDVPGRAVSLSAGLRFGEFAAELHARGLALANLGSLPHISVAGAVATGTHGSGVGNRSLAGAVRALSLVTADGETRTLRRTDEDFAGAVVSLGALGVVTSLELDLVPAFEVRQWVYEDLPEATLAARFDEVMSAAYSVSVFTDWRPGPVGQVWLKQRVGDEGARSVMPAEWLGARLADGPRHPVPGMPAGNCTAQQGVPGPWHERLPHFRMEFTPSNGDELQSEYFVARADAVAAYEALARLRDRIAPVLQVSELRTVAADDLWLSPAHGRDSVAFHFTWVPDAAAVAPVAGAIEEALAPFGARPHWGKVFSTAPEVLRTLYPRYADFEELVGRHDPEGTFRNAFLDRYFRR

SEQ ID NO: 33026 - protein, 276 aa, Arabidopsis thaliana
MANSWDQLGEIASVAQLTGIDALKLIGMIVNAANTARMHKKNCRQFAHHLKLIRNLLEQIKNSEMNQRSEILEPLQGLDDALRRSYILVKSCQEKSYLYLLAMGWNIVNQFEKAQNEIDLFLKIVPLINMADNARIRERLEAIERDQREYTLDEEDRKVQDVILKQESTREAATSVLKKTLSRSYPNMGFCEALKTEEEKLQLELQRSRARYDADQCEVIQRLIDVTQTAATVEPNLEKVLTKKEELTSSKKRDDLYDTDSSSIRADSRLIPFTPI

SEQ ID NO: 33027 - protein, 1070 aa, Arabidopsis thaliana
MPHRDHIAWASVLTALNQANLSGKTLSVFSSVGSSSGLRPDDFVFSALVKACANLGSIDHGRQVHCHFIVSEYANDEVVKSSLVDMYAKCGLLNSAKAVFDSIRVKNTISWTAMVSGYAKSGRKEEALELFRILPVKNLYSWTALISGFVQSGKGLEAFSVFTEMRRERVDILDPLVLSSIVGACANLAASIAGRQVHGNALIDMYAKCSDVIAAKDIFSRMRHRDVVSWTSLIVGMAQHGQAEKALALYDDMVSHGVKPNEVTFVGLIYACSHVGFVEKGRELFQSMTKDYGIRPSLQHYTCLLDLLGRSGLLDEAENLIHTMPFPPDEPTWAALLSACKRQGRGQMGIRIADHLVSSFKLKDPSTYILLSNIYASASLWGKVSEARRKLGEMEVRKDPGHSSVEVRKETEVFYAGETSHPLKEDIFRLLKKLEEEMRIRNGYVPDTSWILHDMDEQEKEKLLFWHSERSAVAYGLLKAVPGTPIRIVKNLRVCGDCHVVLKHISEITEREIIVRDATRYHHFKGGKCSCNDFCNYGHAKSIFILNKETIKWRRVASLIPHTQREMATETVLATAVSNGKSKGCCKSGPGYATPLAAMAGPREKLIYVTALYSGTGRDKPDYLATVDVDPSSPTFSSVIHRLKMPYIGDELHHTGWNSCSSCHGDASADRRYLVLPGLISGRIYAIDTKTDPKAPSLYKVVEPKEIAEKTGLAFPHTSHCLASGDMLVSCLGDKEGNAKGNGFLLLDSDFNVKSRWDKPGHGPLFGYDFWYQPRFKTMISTSWGAPKAFSKGFNLQHVADGLYGSHLHIYQWPEGEMKQIIDLGNTGLLPLEIRFLHDPSKDTGYVGSALSSNMIRFFKNSDDTWSHEASEVVISVKPLKVENWILPEMPGLITDFLISLDDRFFYFVNWLHGDIRQYNIEDPKNPVLTGQIWVGGLLQKGSPYKAVGEDGNTYQFDVPQIKVCNQNIIFWSVLTKGKSLRAGPQMIQLSLDGKRLYATNSLFSAWDRQFYPEIMEKGSHIIQIDVDTDKGGLTLNPDFFVDFGDEPDGPALAHEMRYPGGDCTSDIWI

SEQ ID NO: 33028 - protein, 137 aa, Phaseolus vulgaris
MAQKAQKNDTDFKVPEPITPCATATAAAATSISEPSRFFDAATPATSSRSPKRSLPLEDAANADRTVASEPKRAVNRCSGCRRRVGLTGFRCRCGDLFCAEHRYTDRHDCSYDYKTVGREAIARENPVVKAAKIVKV

SEQ ID NO: 33029 - protein, 481 aa, Lycopersicon esculentum
MAAVNGVGLSWPSKLTKNQTPKWGFSPSHRRCNPSSSSSATIRMTASVDEKKKTFTLEKSEEAFSKAKELMPGGVNSPVRAFKSVGGQPIIIDSVKGSRMRDIDGNEYIDYVGSWGPAIIGHADDEVLAALAETMKKGTSFGAPCLLENTLAEMVISAVPSIEMVRFVNSGTEACMGVLRLARAFTCRPKIIKFEGCYHGHADPFLVKAGSGVATLGLPDSPGVPKAATIDTLTAPYNDISAVESLFEEHKGEIAAVILEPVVGNAGFIPPKLEFLAAIRKITKENDALLIFDEVMTGFRLAYGGAQEYFGITPDLTTLGKIIGGGLPVGAYGGRRDIMEMVAPAGPMYQAGTLSGNPLAMTAGIHTLKRLQGQGTYEHLDKITAELTQGILDAGKKTGHAMCGGSIRGMFGFFFADGPIYNFSDAKKSDTEKFGRFYRGMLEEGVYFAPSQFEAGFTSLAHTPEDIQRTVAAAEKVLKQI

SEQ ID NO: 33030 - protein, 144 aa, Nicotiana sylvestris
MAFYNKLGGLLRQSISGNAVSATSPMKSMLDAVRCMSTKLFVGGLSWGTDDQSLRDAFATFGDVVDARVIVDRDSGRSRGFGFVNFSDDECANEAIKAMDGQELQGRNIRVRIAQERAPRSGGFGGSVVDLVAAMVKLETMMDT

SEQ ID NO: 33031 - protein, 502 aa, Nicotiana tabacum
MEHSLMSTGSYFLLFSSSAFLLILLSFSVEKSHALETRETIESHFHTLQLSSLLPSSSCNPATKGKRRGASLEVVNRQGPCTLLNQKGAKAPTLTEILAHDQARVDSIQARITDQSYDLFKKKDKKSSNKKKSVKDSKANLPAQSGLPLGTGNYIVNVGLGTPKKDLSLIFDTGSDLTWTQCQPCVKSCYAQQQPIFDPSTSKTYSNISCTSAACSSLKSATGNSPGCSSSNCVYGIQYGDSSFTIGFFAKDKLTLTQNDVFDGFMFGCGQNNKGLFGKTAGLIGLGRDPLSIVQQTAQKFGKYFSYCLPTSRGSNGHLTFGNGNGVKASKAVKNGITFTPFASSQGTAYYFIDVLGISVGGKALSISPMLFQNAGTIIDSGTVITRLPSTAYGSLKSAFKQFMSKYPTAPALSLLDTCYDLSNYTSISIPKISFNFNGNANVELDPNGILITNGASQVCLAFAGNGDDDSIGIFGNIQQQTLEVVYDVAGGQLGFGYKGCS

SEQ ID NO: 33032 - protein, 328 aa, Oryza sativa
MADLFTEYADFCFKTFGNRVKHWFTFNEPRIVALLGYDQGTNPPKRCTKCAAGGNSATEPYIVAHNFLLSHAAAVARYRTKYQAAQQGKVGIVLDFNWYEALSNSTEDQAAAQRARDFHIGWYLDPLINGHYSQIMQDLVKDRLPKFTPEQARLVKGSADYIGINQYTASYMKGQQLMQQTPTSYSADWQVTYVFAKNGKPIGPQANSNWLYIVPWGMYGCVNYIKQKYGNPTVVITENGMDQPANLSRDQYLRDTTRVHFYRSYLTQLKKAIDEGANVAGYFAWSLLDNFEWLSGYTSKFGIVYVDFNTLERHPKASAYWFRDMLKH

SEQ ID NO: 33033 - protein, 442 aa, Schizosaccharomyces pombe
MFQRRSLLSVRSAGSQIAFRRFVSLTHKDPTPDTTSCNIIKKEGANIISVYARYPVVAAKGEGSYLFDKEGRKYIDFTSGVAVTSLGHAHPEVARLAADQCSKLVHSSNLFYNEPAIELSNVINNSLAKNSGIAGPTKIFFANCGTEANETDLKFARRAAFEKYGEGKSQIVYFNNSFHGRSLGSLSITANPKYKRGFQPLLPDVVQAVYNDPASIEQFVNDNSTSAPGDPPEPGEGGICPAKPEFLIALRKACDKVGASLIYDEIQCGLGRSGDLWAHSIVKDVDLQAFKIEFPPPDNGLPIEATIVSSKIAAEIHPGEHGSTFGGNPVACRVGTFCVNELGSSKILQNVRKQHKALTSRFDDFVAKYPNLIRGYAGRGLLLGLQFTEPPAKFIELARQQGLLLLPGGNNNTRVLPSLNVKDEVIAKGLDIMESTLKALSK

SEQ ID NO: 33034 - protein, 205 aa, Schizosaccharomyces pombe
MAMFSLEIPAISAETSKKLVVVGDGGCGKTCLLIVFSSGTFPERYVPTVFENYITDITYGPNSKVIELALWDTAGQEEYDRLRPLSYPNSNVILLCFSIDCPASLNNVTEKWYPEVQHFCPRTPIVLVGLKADLRKDRNATEVLRTQGLTPVTYQQAQSVALSMNAPYVECSAKENTGVNEVFQLAVGLTIKKSFSFSKKSCVIL

SEQ ID NO: 33035 - protein, 418 aa, Schizosaccharomyces pombe
MLKLAESGAILQDYLDDYFYTSWYTGNRNLIQLDHYGFPTASNFELNPKSTDNCGTVDFQGIPWGNKAIGKRKNFRLYRLHTYSLSCNHSDWSPEELSLDTVQVAAEDSFYEFQRFLKNPNCLRNHHHLCKSVKVVGEHSVIYVSNNSIRMENTLHDNSVQIIDLKNNILQKKAISCLDTTNAVGCLGTLYGQYCIFNFKNGSFSTRKLSDDSINHIQLFSEKKFILGCNDGAVYVEDVQRTSPILVYRCSNAVNCVQLFDETPLALVCTDSKDAMLIDIRSNSVSAKLPHSDSVLTGSWHPNGNILATGGQDTTAKVWDIRALGKSFRNLGSQMSAVTNLCFSPLGESLAVTEQADFVQLFDTKLFNTSQVIDFFGEIAGTAYSSSGDSLFIGVDDPMLGGILEFRRPLQHPLSFIF

SEQ ID NO: 33036 - protein, 1230 aa, Candida albicans
MSILSENNPTPTSITDPNKSSHLHNPELNSGTRVASGPGPGPEAESTPLAPPTEVMNTTSANTSSLSLGSPMHEKIKQFDQDEVDTGETNDRTIESGSGDIDDSQQSHNNNNNNNNNNNESNPESSEGDDEKTQGMPPRMPGTFNVKGLHQGDDSDNEKQYTELTKSINKRTSKDSYSPGTLESPGTLNALETNNVSPAVIEEEQHTSSLEDLSLSLQHQNENARLSAPRSAPPQVPTSKTSSFHDMSSVISSSTSVHKIPSNPTSTRGSHLSSYKSTLDPGKPAQAAAPPPPEIDIDNLLTKSELDSETDTLSSATNSPNLLRNDTLQGIPTRDDENIDDSPRQLSQNTSATSRNTSGTSTSTVVKNSRSGTSKSTSTSTAHNQTAAITPIIPSHNKFHQQVINTNATNSLSSLEPLGVGINSNSSPKSGKKRKSGSKVRGVFSSMFGKNKSTSSSSSSNSGSNSHSQEVNIKISTPFNAKHLAHVGIDDNGSYTGLPIEWERLLSASGITKKEQQQHPQAVMDIVAFYQDTSENPDDAAFKKFHFDNNKSSSSGWSNENTPPATPGGSNSGSGSGGGGAPSSPHRTPPSSIIEKNNVEQKVITPSQSMPTKTESKQSENQHPHEDNATQYTPRTPTSHVQEGQFIPSRPAPKPPSTPLSSMSVSHKTPSSQSLPRSDSQSDIRSSTPKSHQDVSPSKIKIRSISSKSLKSMRSRKSGDKFTHIAPAPPPPSLPSIPKSKSHSASLSSQLRPATNGSTTAPIPASAAFGGENNALPKQRINEFKAHRAPPPPPSAPPAPPVPPAPPANLLSEQTSEIPQQRTAPSQALADVTAPTNIYEIQQTKYQEAQQKLREKKARELEEIQRLREKNERQNRQQETGQNNADTASGGSNIAPPVPVPNKKPPSGSGGGRDAKQAALIAQKKREEKKRKNLQIIAKLKTICNPGDPNELYVDLVKIGQGASGGVFLAHDVRDKSNIVAIKQMNLEQQPKKELIINEILVMKGSSHPNIVNFIDSYLLKGDLWVIMEYMEGGSLTDIVTHSVMTEGQIGVVCRETLKGLKFLHSKGVIHRDIKSDNILLNMDGNIKITDFGFCAQINEINSKRITMVGTPYWMAPEIVSRKEYGPKVDVWSLGIMIIEMLEGEPPYLNETPLRALYLIATNGTPKLKDPESLSYDIRKFLAWCLQVDFNKRADADELLHDNFITECDDVSSLSPLVKIARLKKMSESD

SEQ ID NO: 33037 - protein, 403 aa, Chondrostereum purpureum
MTSFSSLFKLLILASATAAAPSKRATCTVKSVDDAKDIAGCSAVTLNGFTVPAGNTLVLNPDKGATVTMAGDITFAKTTLDGPLFTIDGTGINFVGADHIFDGNGALYWDGKGTNNGTHKPHPFLKIKGSGTYKKFEVLNSPAQAISVGPTDAHLTLDGITVDDFAGDTKNLGHNTDGFDVSANNVTIQNCIVKNQDDCIAINDGNNIRFENNQCSGGHGISIGSIATGKHVSNVVIKGNTVTRSMYGVRIKAQRTATSASVSGVTYDANTISGIAKYGVLISQSYPDDVGNPGTGAPFSDVNFTGGATTIKVNNAATRVTVECGNCSGNWNWSQLTVTGGKAGTIKSDKAKITGGQYLADQPASNDIEEMPAQDPNDPEDPDTAMQEAEAEEAAAGNSTTSG

SEQ ID NO: 33038 - protein, 195 aa, Schizosaccharomyces pombe
SRPHNTTHYRDPYGKRVGIIGMGAIGKSFAQKILPLGCEIVYHNRNRLEAEEEKRLGASFVSFDELLSSSDVISINCPLTPATHDLISTKEFEKMKDGVYIINTARGAIINEDAFIKAIKSGKVARAGLDVFLNEPTPNKFWLECDKVTIQPHCGVYTNFTVAKTEECVLASIETFLDTGIPTNPVNGPFGMNGC

SEQ ID NO: 33039 - protein, 463 aa, Arabidopsis thaliana
MAPVKQKKKNKKKPLDKAKKLAKNKEKKRVNAVPLDPEAIDCDWWDTFWLRNSSPSVPSDEDYAFKHFFRASKTTFSYICSLVREDLISRPPSGLINIEGRLLSVEKQVAIALRRLASGDSQVSVGAAFGVGQSTVSQVPINLYSAPYFPDFNIYMLYPDTIHLFPQVTWRFIEALEERAKHHLRWPDSDRIEEIKSKFEEMYGLPNCCGAIDTTHIIMTLPAVQASDDWCDQEKNYSMFLQGVFDHEMRFLNMVTGWPGGMTVSKLLKFSGFFKLCENAQILDGNPKTLSQGAQIREYVVGGISYPLLPWLITPHDSDHPSDSMVAFNERHEKVRSVAATAFQQLKGSWRILSKVMWRPDRRKLPSIILVCCLLHNIIIDCGDYLQEDVPLSGHHDSGYADRYCKQTEPLGSELRGCLTEHLLSIELLGSIIFALCVEKFVILRKGICSGGCVSVLVLCAHK

SEQ ID NO: 33040 - protein, 321 aa, Pinus thunbergii
MSIKEWFEDKRKITALLKNSVERDSKDANETEKNKNKSIDYAKIKKLWAQCDNCENLLYLRFLRENQSVCKECGYYLQMNSSDRIELPIDRDTWRPMDEDMYTLDVLQFYSENEPSHSDNLNSEDESYKDHITFYQIETGLTDAIQTGIGQLNGLTIALGVMDFQFMGGSMGSVVGEKITRLIERATAESLPLIMVCASGGARMQEGSFSLMQMAKIASALYIHQKEKKLLYISILTSPTTGGVTASFGMLGDIIIAEPKAYIAFAGKRVIEQTLGQKVIEDFQVTEHLFGHGLFDLIVPRNLLKGVLSELFWFYVLRSSL

SEQ ID NO: 33041 - protein, 475 aa, Pinus thunbergii
MSPKTETKASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPSYSKTFQGPPHGIQVERDKLNKYGRPLLGCTIKPKLGLSAKNYGRAVYECLRGGLDFTKDDENVNSQPFMRWRDRFVFCAEALNKAQAETGEIKGHYLNATAGTCEEMMKRAIFARELGVPIVMHDYLTGGFTANTSLAHYCRDNGLLLHIHRAMHAVIDRQRNHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREACKWSPELAAACEIWKEIKFEFDVIDRL

SEQ ID NO: 33042 - protein, 169 aa, Pinus thunbergii
MPRSQRNDNFIDKTFTIVADILLRIIPMAPGEKEAFTYYRDGMSAQSEGEYAEALQNYYEAMRLETDPYDRSYILYNIGLVHTSNGEHTKALEYYFQALERNPSLPQALNNTALICHYRGEQAIRQGDPETAEAWFDQAAEYWEQAIALAPGNYIEAQNWLKITGRFGE

SEQ ID NO: 33043 - protein, 475 aa, Arabidopsis thaliana
MDRISSLSNDIISNIVSFLSAKDAAVASVLSKRWQNIYTIVPNLEFDNTLENQGSLTDFLNGLLALPASTRIKNVSIKRRGRDGPNRDADLNRFLCNVLKRGVLKLKLDIWVTLDGRYSLPVEVFTCKTLVELELGSILQIDLVPENALLPALKTLIIDAVQFSDQSGCAFQKLLSSCPVLVELRMLNVQWEHWQWSRRVSSPTLEKLTMNHRYHFGNTYYDMEGITFDTPSLTSLKYYDLPPKSYPTVNLDSLVEATISLTLPLHHAWTGKHARRGDTVPSVTNLIKGLRNVETLNLSSTDTVAAFYFSNEAIPVFENLHRLSIATEREFCWRTLPYLLKKSPNLESLVIGGPLHYNYQLGDGYESEEIYSEDDDEEESESDDDEPICECLSDYSFLESCLVKTVEISEYSGTKIELKHMKHFLEKLSCLELVKVFSHERDEEEHVQLRTNLLNLPRSSKCKTQFEFIPPRSSV

SEQ ID NO: 33044 - protein, 461 aa, Arabidopsis thaliana
MDRVGSLPDELLSHILSFLTTKEAALTSLLSKRWRYLIAFVPNLAFDDIVFLHPEEGKPERDEIRQSFMDFVDRVLALQAESPIKKFSLKCRIGVDSDRVDGWISNVLNRGVSELDLLIILGMTMEDSYRLSPKGFASKTLVKLEIGCGIDISWVAGSIFLPMLKTLVLDSVWFYVDKFETLLLALPALEELVLVDVNWLDSDVTISNASLKTLTIDSDGHLGTFSFDTPSLVYFCYSDYAAEDYPVVKMENLREARIFLLVTDNEIERVRLPINDGLEDAMDNVVLRFGHVGKLMNGIRNVEYLELSADTLEVLSLCCESMPVFKNLKSLAIKSTEGRGWQAMPVLLRNCPHLEFLLIEGLLHHVTDKCGDACDCVPREDKGRSLTSCPEMDIYADEDGPTNLEAPGMFEQITQLFTLYDEFYTCDVQFMVRGSLYKKLTAQCCVFKEENLPHRLVRTLG

SEQ ID NO: 33045 - protein, 274 aa, Methanocaldococcus jannaschii
MIKVAVTGALGRMGSNIIKTITQQEDMKVVCAFEVPNHPKKGEDVGELIGIGKIGVPLSTADELDKVLKETKPDVLVDFTIAHACVENVKIAAKNGVNLVIGTTGFTEEQKAEIEKAIKENNVAAVISQNFAIGVNIFFKTLEFLAKKLGDYDIEIIEMHHRYKKDAPSGTALRAAEIIKANRGIESVFVYGRYGMTGERKKEEIGIHALRGGDVVGDHTVIFAGDGERIELTHRASSRQAFVNGVILAIRYIADKKEGIYNTFDVLGLNEIKF

SEQ ID NO: 33046 - protein, 201 aa, Aspergillus awamori
MNPEYDYLFKLLLIGDSGVGKSCLLLRFADDTYTESYISTIGVDFKIRTIELDGKTMKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 33047 - protein, 443 aa, Pseudomonas putida
MRTLDVHPIIDNARFTPFHWMVMAWCGLLLIFDGYDLFIYGVVLPVIMKEWGLTPLQAGALGSYALFGMMFGALAFGSLADRIGRKKGIAICFALFSVATILNGFASSPSEFGIYRFIAGLGCGGLMPNAVALMNEYAPKRLRSTLVAIMFSGYSLGGMLSAGVGIFMLPRFGWESMFFAAAVPLLLLPVILYYLPESIGFLVRKGRTEEARALLKRLDPQCDVQADDVLQAADRKAGGGASVLELFRNGLAIRTLALWLAFFCCLLMVYALSSWLPKLMANAGYSLGSSLSFLLALNFGGMAGAILGGWLGDRYNLVKVKVAFFIAAALSISLLGVNSPMPVLYLLIFIAGATTIGTQILLYAGAAQMYGLSVRSTGLGWASGIGRNGAIVGPLLGGALMGINLPLQLNFIAFAIPGAIAALAMAVHLASGRRQARAIAAQA

SEQ ID NO: 33048 - protein, 491 aa, Streptococcus pyogenes
  misc_feature (52)..(52): Xaa can be any naturally occurring amino acid
  misc_feature (60)..(60): Xaa can be any naturally occurring amino acid
  misc_feature (77)..(77): Xaa can be any naturally occurring amino acid
  misc_feature (116)..(116): Xaa can be any naturally occurring amino acid
  misc_feature (144)..(144): Xaa can be any naturally occurring amino acid
  misc_feature (158)..(158): Xaa can be any naturally occurring amino acid
  misc_feature (363)..(363): Xaa can be any naturally occurring amino acid
  misc_feature (367)..(367): Xaa can be any naturally occurring amino acid
  misc_feature (392)..(392): Xaa can be any naturally occurring amino acid
  misc_feature (398)..(398): Xaa can be any naturally occurring amino acid
  misc_feature (439)..(439): Xaa can be any naturally occurring amino acid
  misc_feature (447)..(447): Xaa can be any naturally occurring amino acid
  misc_feature (467)..(467): Xaa can be any naturally occurring amino acid
SNWDTKFLKKGYTFDDVLLIPAESHVLPNEVDLKTKLADNLTLNIPIITAAXDTVTGSKXAIAIARAGGLGVIHKNXSITEQAEEVRKVKRSENGVIIDPFFLTPEHKVSEAEELXQRYRISGVPIVETLANRKLVGIITNRDXRFISDYNAPISEHXTSEHLVTAAVGTDLETAERILHEHRIEKLPLVDNSGRLSGLITIKDIEKVIEFPHAAKDEFGRLLVAAAVGVTSDTFERAEALFEAGADAIVIDTAHGHSAGVLRKIAEIRAHFPNRTLIAGNIATAEGARALYDAGVDVVKVGIGPGSICTTRVVAGVGVPQVTAIYDAAAVAREYGKTIIADGGIKYSGDIVKALAAGGNAVXLGSXFAGTDEAPGETEIYQGRKYKTYRGXGSIAAXKKGSSDRYFQGSVNEANKLVPEGIEGRVAYKGAASDIVFQXLGGIRSGXGYVGAGDIQELHENAQFVEXSGAGLIESHPHDVQITNEAPNYSV

SEQ ID NO: 33049 - protein, 398 aa, Vitis vinifera
MSLLFLFSLLPPILGSPAPVQDPEVVVQEVHRSINASRRNLGYFSCGTGNPIDDCWRCDANWDKNRQRLADCAIGFGKDAMGGKNGRIYVVTDSEDDDPVNPRPGTLRHAVIQDEPLWIIFKRDMVIKLKQELVMNSFKTIDGRGASVHIAGGPCITIHYASNIIIHGLHIHDCKQGGNANIRNSPHHSGWWTVSDGDGVSIFGGRHIWVDHCSLSNCHDGLIDAIHGSTAITISNNFMTHHDKVMLLGHSDSYTEDKNMQVTIAFNHFGEGLVQRMPRCRHGYFHVVNNDYTHWEMYAIGGSADPTINSQGNRFLAPNDRFKKAVTKHEDAPESEWRHWNWRSEGDLMLNGAFFLQSGAGASSSYARRSSLSARPSSLVGSITLGSGALGCRKGSRC

SEQ ID NO: 33050 - protein, 417 aa, Candida albicans
MMNIDQHHQLQQQHQQQMLQQQAQAQAQAQAQAQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 33051 - protein, 322 aa, Oryza sativa (indica cultivar-group)
MAPTSTFPVINMELLAGEERPAAMEQLDDACENWGFFEILNHGISTELMDEVEKMTKDHYKRVREQRFLEFASKTLKEGCDDVNKAEKLDWESTFFVRHLPESNIADIPDLDDDYRRLMKRFAAELETLAERLLDLLCENLGLEKGYLTKAFRGPAGAPTFGTKVSSYPPCPRPDLVKGLRAHTDRGGIILLFQDDSVGGLQLLKDGEWVDVPPMRHSIVVNLGDQLEVITNGRYKSVMHRVVAQTDGNRMSIASFYNPGSDGVISPAPALVKEEEAVVAYPKFVFEDYMKLYVRHKFEAKEPRFEAFKSMETETSNRIAIA

SEQ ID NO: 33052 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 33053 - protein, 163 aa, Triticum aestivum
  misc_feature (95)..(119): Xaa can be any naturally occurring amino acid
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVXXXXXXXXXXXXXXXXXXXXXXXXXEVEEVKKEYPDAYVRIIGFDNMRQVQCVSFIAFKPPGCEESGKA

SEQ ID NO: 33054 - protein, 435 aa, Schizosaccharomyces pombe
MNSQTSVVGVHYRVGRKIGEGSFGVIFDGMNLLNNQLIAIKFEPKKSEAPQLRDEYRTYKLLVGNAGIPNVYYFGQEGLHNILVIDLLGPSLEDLFEWCGRRFSVKTVAMTAKQMLSRVQTIHEKNLVYRDIKPDNFLIGRPSSRNANMVYMVDFGMAKYYRDPKTKQHIPYSERKSLSGTARYMSINTHLGREQSRRDDLESLGHVFMYFLRGSLPWQGLKAANNKHKYEKISEKKQSTSISELCAGFPNEFSKYMTYVRSLEFDEEPDYAFLQELFDDVLRANGDTNDGVYDWMLLNDGKGWESSSSHFSVVAMKRRKNYLGLNVVQNDDSRKKNSTLQTQNMRFKSSYGVRGPRNYSSFDALPSKNAPLVRQEQSASKKTIYAHSSRGYDRVRPMYVSQPSNNAVGVNHPNDNSDSEAKGGFFDMICCRCFS

SEQ ID NO: 33055 - protein, 504 aa, Sphingomonas sp. LB126
MMESTGNAAIFEQARARIARPFGHFINGLWEAGSGEPIAVVNPATEQPIGSIAAGGEAEVDRAVAAARQRFESAEWTRMPAAERERLLLRLADLVERDRDELAAIETLDNGMPFAPARMMAVGSAISAIRYNAGWARRMTGEEAPVSVPGRWHGYTSREPLGVAALIVPWNAPFAITCNKVSAALAAGCTVVLKPAELAPMSGLRLAELVQEAGFPDGCLNVVTGLGAQAGAALVRHPGVDKISFTGSTATGQSILRETAGRLTRVSLELGGKSAVLVFPDADLEKAIPAVAMGIFGNSGQVCAAGSRLFLHDSVFDRFVTGLVDFAEKLMVGPGDQPGVALGPLISAGQKERVMGYIAAGEAEGAQIATRGSAPDEPGYFVKPTIFVDTRPDMRIVREEIFGPVLSVMRFSDDNLENLARQANDSIYGLSAYVWTRDLSTAHAMARYLRAGSVKVNGSGMEFALPFGGFKQSGIGRENGPRGGGSLYRKEVGNDRLVMVWTAL

SEQ ID NO: 33056 - protein, 405 aa, Populus nigra
MGFLCCSGKPSKRLESSSINENNSNIKRKDQTHVTSGSLKMKPYVNNLSKEGESKDDQLSLDVKSLNMKDEISKDRRSNGKQAQTFTFEELAAATSNFRSDCFLGEGGFGKVYKGYLDKINQAVAIKQLDRNGVQGIREFVVEVVTLSLADHPNLVKLIGFCAEGDQRLLVYEYMPLGSLENHLHDIPPNRQPLDWNTRMKIAAGAAKGLEYLHNEMKPPVIYRDLKCSNILLGEGYHPKLSDFGLAKVGPSGDKTHVSTRVMGTYGYCAPDYAMTGQLTFKSDIYSFGVVLLELITGRKAIDQRKERGEQNLVAWARPMFKDRRNFSCMVDPLLQGQYPIRGLYQALAIAAMCVQEQPNMRPAVSDLVMALNYLASHKYDPQVHSVQDSRRSPSRPGLDKDRGQ

SEQ ID NO: 33057 - protein, 406 aa, Populus nigra
MGFLCFSGKSSKRSENSSIDENNSNIKRKDQTQLTSGSMKVKPYVNDSREEGASKDDQLSLDVKSLNLKDEISKDIRNNGNPAQTFTFEELVAATDNFRSDCFLGEGGFGKVYKGYLEKINQVVAIKQLDQNGLQGIREFVVEVLTLSLADNPNLVKLIGFCAEGDQRLLVYEYMPLGSLENHLHDIPPNRQPLDWNARMKIAAGAAKGLEYLHNEMAPPVIYRDLKCSNILLGEGYHPKLSDFGLAKVGPSGDHTHVSTRVMGTYGYCAPDYAMTGQLTFKSDVYSFGVVLLELITGRKAIDQTKERSEQNLVAWARPMFKDRRNFSGMVDPFLQGQYPIKGLYQALAIAAMCVQEQPNMRPAVSDVVLALNYLASHKYDPQIHPFKDPRRRPSHPGLDKDNGRT

SEQ ID NO: 33058 - protein, 319 aa, Populus euramericana
MEFPVISMEKLNGEERAATMEKIKDACENWGFFELLNHGISHEFLDTVERMTKEHYKKCMEQRFKELVASKALDGVQTEIKDLDWESTFQLRHLPKSNIAEIPDLDDEYRKVMKEFALKLEKLAEELLDLLCENLGLEKGYLKRAFYGSNGSPTFGTKVSNYPPCPKPDLVKGLRAHTDAGGIILLFQDDKVSGLQLLKDGQWIDVPPMRHSIVVNLGDQLEVITNGKYKSVEHRVIAQTDGTRMSVASFYNPGSEAVIYPAPALVEKEAEEKKKVYPKFVFDDYMKLYAGLKFQAKEPRFEAMKAVETTVNLGPIATA

SEQ ID NO: 33059 - protein, 411 aa, Candida albicans
  misc_feature (207)..(207): Xaa can be any naturally occurring amino acid
MDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAXVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 33060 - protein, 474 aa, Streptomyces sp. CHR28
MLQAHTGYDLAIVGSGGGAFAAAIAARNKGRRVVMVERGTTGGTCVNVGCVPSKALLAAAEARHGARAASRFPGLQATEPALDFPALIGGKDALVEQLRAEKYTDLAAEYGWQIVHGTAAFADGPVLEVSLNDGGTTTIEAAHYLIATGSAPTAPPIDGLDQVDYLTSTTAMELQQLPEHLLVLGGGYVGLEQAQLFARLGSRVTLAVRSRLASREEPEISAGIEDVFREEGFAVHTRTQLRAVRRDGDGILATLTGPGGEQQVRASHLLIATGRRPVTDGLGLERVGVKTGERGEVVVDEYLRTDNPRIWAAGDVTGHPDFVYVAAAHGTLVADNALDGAERTLDYTALPKVTFTSPAIASVGMTDAQLAEAGIACQCRTLPMEYVPRALANRDTRGLVKLIAERGTGKLLGAHVLADGAGDIITAATYAITAGLTVDQLARTWHPYLTMAEALKLAAQTFTSDVAKLSCCAG

SEQ ID NO: 33061 - protein, 512 aa, Debaryomyces occidentalis
MRFSTEGFTSKVVAAILAFSRLVSAQPIIFDKRDVSSSADKWKDQSIYQIVTDRFARSDGSTTADCLVSDRKICGGSYKGIIDKLDYIQGMGFTAIWISPVVEQIPDNTAYGYAYHGYWMKNIDELNTNFGTADELKQLASELHSRSMLLMVDVVYNHYAWNGDGSSVDYSSFTPFNQQSYFHDYCLITNYNDQTNVEDCWEGDTEVSLPDLSTEDNEVIGVFQTWVSDFVQNYSIDGLRIDSAKHVDTASLTKFEDASGVYNLGEVYQGDPTYTCPYQNYMKGVTNYPLYYPVYRFFSDTSATSSELTSMISTLQSSCSDVSLLGNFIENHDQVRFPSVTSDTSLIKNAMAFIILGDGIPIIYYGQEQGLNGGSDPANREALWLSGYNTDSEYYELISKLNQIRNQAIKKDSAYSTYKSSVVSSSDHYIATRKGSDANQLISIFNNLGSNGSQDITVSNTGYSSGDKVIDIISCNSVSAGDSGSLSVSISGGMPQVYAPSSVLSGSGICNQ

SEQ ID NO: 33062 - protein, 305 aa, Pichia jadinii
MATEKKQSTFLIDFLMGGVSAAISKTAAAPIERVKLLIQNQDEMIKQGRLAKRYDGIADCFRRTAGEEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 33063 - protein, 305 aa, Pichia jadinii
MATEKKQSTFLIDFLMGGVSAAISKTAAAPIERVKLLIQNQDEMIKQGRLAKRYDGIADCFRRTAGDEGVVSFWRGNTANVIRYFPTQALNFAFKDKFKAMFGFKKEEGYWKWFAGNLASGGLAGGSLFGSVYSLDYARTRLANDAKSAKGTGERDSTGLLDVYKKTLASDGIAGLYRGFLPSVVGIVVYRGLYFGLYDSLKPVLLTGSLENNSWAAFLLGWVVTTGASTASYPLDTVRRRMMMTSGQAVKYDGAFDAFRKIVAAEGVKSLFKGCGANILRGVAGAGVISLYDQLQVILFGKKFK

SEQ ID NO: 33064 - protein, 478 aa, Iriartea deltoidea
MSPQTETKASVGFKAGVKDYKLTYYTPDYETKDTDILAAFRVTPQPGVPPEEAGAAVAAESSTGTWTTVWTDGLTSLDRYKGRCYHIETVVGEENQYIAYVAYPLDLFEEGSVTNMFTSIVGNVFGFKALRALRLEDLRIPTSYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREMTLGFVDLLRDDFIEKDRSRGIFFTQDWVSMPGVIPVASGGIHVWHMPALTEIFGDDSVLQFGGGTLGHPWGNAPGAVANRVALEACVQARNEGRDLAREGNEIIREASKWSPELAAACEVWKEIKFEFQPVDTLDVK

SEQ ID NO: 33065 - protein, 397 aa, Penicillium roquefortii
MVVFSQVTVALTCFSAIASAAAVRQEPPQGFTVNQVQKAVPGTRTVNLPGLYANALVKYGATVPATVHAAAVSGSAITTPEADDVEYLTPVTIGSSTLNLDFDTGSADLWVFSSELTSSQQSGHDVYNVGSLGTKLSGASWSISYGDGSSASGDVYKDTVTVGGVKATGQAVEAAKKISSQFLQDKNNDGLLGMAFSSINTVSPTPQKTFFDTVKSSLGEPLFAVTLQGTGRPWHLRFGYIDSDKYTGTLAYADVDDSDGFWSFTADSYKIGTGAAGKSITGIADTGTTLLLLDSSIVTGLLQEGYPGSQNSSSAGGYIFPCSATLPDFTVTINGYDAVVPGKYINFAPVSTGSSSCYGGIQSNSGIGFSIFGDIFLKSQYVVFDSEGPRLGFAAQA

SEQ ID NO: 33066 - protein, 341 aa, Actinobacillus actinomycetemcomitans
MINLILCGGSGTRLWPLSRVKVPKQFIKLFNHHSLFQLTQSRNAQFSEKTIAVVNDTQFLLAYEQSDNVNQMKFILEPVGRNTAPAIALSCFGLEYNDIVLVTSSDQLIKNQDNYLNMVCKAEKLAEKGFLVTFGLKPKYPETGFGYIETLDEENVLTFREKPDFDTAKKYVESGRYFWNCGIFCFKAGVFLEELLKYSPDIYYKAKEAYEERVINDNIESISLGNMLEIPSDSIDYAVMEKSDKIKVICGDLGWSDIGSFDSLEKEFAKNQDSNNQIEHHISISSSNNFIWSKKKIVTIDVDDLIIVDTDDVLLVVKKGSSQKVKKVVEYLKEIEPNLVN

SEQ ID NO: 33067 - protein, 147 aa, Euphorbia esula
MDKAKNFVAEKIAHVQKPEATISKVDLSSVHRDRVEYSAKVSVNNPYGHPLPVCEVSYTLKSDGREIAKGTMADPGSLKASGTTELIVPVGVPHSIIVSLVKDVAKDWDIDYELQVGLTIDLPVIGNFTIPLNTKGEVKLPTLSDCF

SEQ ID NO: 33068 - protein, 202 aa, Lycopersicon chilense
MTAIGEAVQRQTEASKVKEQAPATEKAVKEKKPRAPKEKKPKSAKAVTHPPYFQMIKEALLALNEKGGSSPYAVAKYMEDKHKDELPANFRKILGLQLKNSAAKGKLIKIKASYKLSEAGKKETTTKTSTKKLLKADSKKKTRSTRATATAAKKTEVPKKAKATPKPKKVGAKRTRKSTPAKAKQPKSIKSPAAKRAKKIAV

SEQ ID NO: 33069 - protein, 318 aa, Carica papaya
MENFPVIDLSKLNGEERASTMELIHDACENWGFFELVNHGISHDLMDTVERLTKEHYKKCMEQRFKEMVESNGLEAVQSEINDMDWESTFFLRHLPASNMHEIPDLEDDYRKAMKEFAVGLQKLAEQMLDLLCENLGLEKGYLKKVFYGSKGPNFGTKVRNYPPCPKPDLIKGLRAHTDAGGIILVFQDDKVSGLQLLKDDQWVDVPPMKHSIVINLGDQLEVITNGKYKSVMHRVIAQTDGNRMSLASFYNPGDDAVIYPAPSLVEKEAEKNQIYPKFVFDDYMKLYVGLKFQAKEPRFEAMKAMESTVTPGAIATV

SEQ ID NO: 33070 - protein, 486 aa, Nocardioides sp. KP7
MINAKLIINGREETSDRTIDVVSPADTRVVLGSVPDATSEQVDEAVQAAATAFPEWSSRPLEERQGALFAAAGAIHDMIEEYAPLLSRENGKILEESHIDLEFASGICGYTAGISAEALADQRIHDAGGTTLIRRRPIGPVAAVTPWNFPVVLSFMKLAPALVAGNTVVLKPSENSPLVLTEVIRALQEHFPPGVLNMVTGGDATGEALVAHPLIRKIGFTGGIDTGRKVMAVAAQDIKRVTLELGGNDPAVVLDDVDLSPETMRRIAKGAFSATGQVCFGLKSIYVPTRIHDRFVEAFHAAVDEIVVGPGDDPRSTMGPLNNAQQKGSVEKILEEARGAGAVVTTLGRKLDTAAWEHGHFMMPSVVTDADPRLAIVEQEQFGPTVPVVRYTELDEVIRLTNRSQFGLAASIWSADEDRAFELGRRLDTGSVFINSHSFSSLDPRAPFGGTKNSGLGREFSPASLDAYTELQTISRRTGPPGPPLS

SEQ ID NO: 33071 - protein, 414 aa, Nocardioides sp. KP7
MTGGQVAALIGGGMAGVHAAEVLRRDGFDGRVLLVSAEQHLPYDRPPLSKALLRGELALADCLLRPPEWYEEQGIEVLLGVSVDALDPGRRTLRLSTGEQVEFDRALLATGARPRWPLGLAPGCGPVFALRTVDDCLAIRSRLRSGASVVVVGGGFVGAELASSAASLGCRVTMLEAADAPFQRVLGRTVGELFGRFYATGGIRLVTGVQVTGTSVGPEGARLTAGDGRFWDADVVVVGVGVVPNTELAVDAGLRVSDGVEVDAYCTTSAPHVFAAGDVANRPDPVLGRRVRIEHWQNAQHQGTAAGRAMLGIREPFDGVPWFWSDQFGLNLQVAGFPDRADRVVVRGRLEGDRFAAFYLAGPTLVAALGVGCAGEVHLSRRLIAARAHVDPQRLTDEHSDLRDALLASDVPTA

SEQ ID NO: 33072 - protein, 124 aa, Arabidopsis thaliana
MSQSLFNLKSLSRSINNTIRMRRYIVITKASQRAYTIGSSQEKPSWASDPDTGYFRPETAAKELDPYIAKTSQVQGKMMRGEELWWMPDPQTGYYRPDNFARELDAVELRSLHFNKNQKTYVVS

SEQ ID NO: 33073 - protein, 413 aa, Arabidopsis thaliana
MDGVSSLPNELLCHILSFLTTKEAALTSILSKRWRNLIAFVPNLYIDDTVFLHPEEGKRDRPEIIQSFMDFVDRILALQGNYPIKKCSLKCLTEVDSVRVDAWISNVLARGVTDLDLLIILDCESDDNYRLSPKCLQSSTLVSLKIDGGIDIARVDNFDILLLALPALEELALVDVIWKDEDDYPLVNMKNLFDARIIFMLQLPGAREPDDDHWFDQNVALRYSNVWKLFLGLQNVPNLYLSPDTLKVLSLYCESMPVFKNLKSLAIKSGKERGWQAIPVLLRNCPHLETLVIEGVLHNVTDKCGDACDCISREDKGRSLTSCPVKMLEIRGFRGTMKEMTMMKHFLDYFLCLKAMNIYVEENDPTELRFPEVSKCIMQMMEEYNKLSSCNVELLVTDYFYFSEKWTAKGRIL

SEQ ID NO: 33074 - protein, 457 aa, Arabidopsis thaliana
MDSEKMDLFSKLPDEVISHILSSLPTKEAASTSVLAKKWRYLFAFVPSLDFNDSDFLHPQEGKREKDGILRSFMDFVDRVLALQGASPIKKFSLNVKTGVDPDRVDRWICNVLQRGVSHLALFMDFEEEYSLPYEISVSKTLVELKTGYGVDLYLWDDDMFLPMLKTLVLESVEFGRGQFQTLLPACPVLEELMLLNMEWKDRNVILSSSSLKNLKITSEDGCLGTLSFDTPNLVFLDYYDYVAEDYPIVNLKNLVEVGINLVLTADRINRARDNVWNLIHGIQNAEIFHISPVTFEVLSLSCEAMPVFKNLTTLNIRTVMQQGWQAMPLLLKNCPNLETLYLGGLLHTVTNKCGDVCDCIPRKKKGRSLMACPVNKIQIQGFRGTIREVHMIKHFLDFCPSLKEMEIIVETKEPTLFEIPKWLEIVEDTLMQYNEMSSCTINYRVLAPLYWRWTRK

SEQ ID NO: 33075 - protein, 454 aa, Arabidopsis thaliana
MVDLVSSLPDDLLGHILSLLTTKEAALTSILSKRWRYLIAFVPYLEFDDSAFLNPEEGKQTREGTRQSFIDFVDRVLALHGDSPIRKFSLKCKTGVDLDLLNQWICNVLQRGVLLIDLSMDLGHRCMFIEIFMSRTLVELKLGSGCRIAFGPEHISALPMLKTLTLDSVSWSDSGQLERLLSACPALEALNLANVHGSYPNATVSIASLKTLTIKSVSLSGPAHVFSFDTPNLLCLNYTALFEDDYPLVNLEYLVEAQIKFVLTDRLIKLVSVRKNGLLMLSEVQKLIRGISSVRKLYLSPGTLQVLGQCSQAMPVFNNLTFLVIESSMDIRWQAMPVLLKNCPRLETLVIKGGLVHCVAADCGDACTCISREEKGRSLASCPVKRLEIREFQGTLREMEMIKHFYYCFLCLKEMEIYVKDGRPQFLAPLASDSNPFKHLLGRNVIIKVHGSLT

SEQ ID NO: 33076 - protein, 470 aa, Arabidopsis thaliana
MDRISNLPNEIICHIVSFLSAKEAAFASVLSKRWQNLFTIVQKLEFDDSVKNQGSLMDFVNGVLALPVTTRISKFSLRFDSFLKRKLETGLVIGPHVVNRCLCNVLKRGVLDLKLEIYGEDGYLLPSEVFTCKTIVDLKLTSCIFAESYVIDVIPENAFLPGLESLFLKSIWFSDLRGCAFQTLLSACPVLKTLTIYDVQWEKWKWSRTVSSATLERLIIQRTEFTYFNGSDFKSITFDTPSLTYLKYIDFVPEEYPVVNLDSIVEAKLHLILTGNQDYPVRYLGREDDPITSNPTNLIKGLRNVEILHLSTATAQMLCFFPRETLPEFVNLHHLTIGPTYYECFNWRLLPILLKKTPNLKTLMIKGPLHLYYRDFNDDEEEEEPEYYCECSSGCNCLLSCHMEVLEISHYRGTTKELEKLKHFLGKLSCLEHVKLGVWASSDKEKLSITTDLLMLPRASVNCKIQINFS

SEQ ID NO: 33077 - protein, 455 aa, Arabidopsis thaliana
MDRVSNLPDGVRGHILSFLPAKHIALTSVLSKSWLNLWKLIPILDIDDSEFLHPEEGKAERLEIRQSFVDFVDRVLALQDDSPIDRFSLKCITGIHPDHVNRWICNVLQRGVSDLDLFIDFSYEDTQEDEDMLPQEMFVSKTLVKLKIRNDRCVDWWCGKGGTSLPMLKSLYIDSDLILWGKMKRFLSSFPVLEELRMASMEWKESHETVSSASLRKLSILGTGCEDYVNPKSISFDTPSLLYLNYSDLVAEDYPLVNMGKLLEARINLIVKDDQIKRVREPNNDLLQDDAGNVVLQFGNVVKLMNGIQNIQILYLTADTLEVLSLCCESMPVFNNLKTLGIKSEEGRGWQAVPALLRNCPHLEYLIIEGLLHNVTDKCGDACDCISREDKGRSLASCPVKKEMGIFPEEEGPTNFENPGAFEYVEKILKLYNEISNCDVYFLVWGYMRRKWTTQ

SEQ ID NO: 33078 - protein, 417 aa, Arabidopsis thaliana
MDLFSSLPDEVLCHILSFLTTKEAALASVVSKRWRNQFALVPNLDIDEEGKREREEILLSFMDFVDNVLALQADSPIKKFSLKCKTGVHPRRLDAWARLGPVLPMLKTLIIDSAWIRCDTIETFLPTFPVLEELSMSINEWPDWDETVTSASLRKLSIFTIGCENFSNPKSISFDIPSLVYFEYYDMVAEDYPKVNLTSVVEARISLLLDQDQIKRGRAPNNDEDDVLLRLRNGWKLMSGIRNVQKLYISLDTLQVLSLCCKSMPVFNNLKLLSVKTAENEGWEGMPVLLRNCPHLETLVFEGLRHFVTNKCGDACDYVSREDKGRSLVSCPVKKLQIKGFRGTIRELEMIKHFLYSFRCLEKVEIYAEEKGRTRTDLEVPGMFELIARMLRLYNEFYSCDVQFLVRSSLDKKWTAQ

SEQ ID NO: 33079 - protein, 209 aa, Oryza sativa
MAANLEDVPSMELMTELLRRMKCSSKPDKRVILVGPPGCGKGTQSPLIKDEFCLCHLATGDMLRAAVAAKTPLGIKAKEAMDKGELVSDDLVVGIIDEAMKKTSCQKGFILDGFPRTVVQAQKLDEMLAKQGTKIDKVLNFAIDDAILEERITGRWIHPSSGRSYHTKFAPPKTPGLDDVTGEPLIQRKDDTAAVLKSRLEAFHVQTKP

SEQ ID NO: 33080 - protein, 427 aa, Arabidopsis thaliana
MDCLPDDLLVQILYLLPTKEAVSTSVLSKRWRTLFTRSDNLDFHDPISGRPEDILKSFNDFVDSSLAFQGGKHIKKFSLHTKIKTFEYHVLDRWICNALEHGVSELHLHLMHESWPWLFSIPSKVFNSSTLVKLSLGSRLYCPSFPPDTSLPALKVLLLDSILFRDDQLSNVFLAACPALEDLTIHHTYHPCVISSKSIKKLSLSVNSGYYGAGYILTLDTPSVVDLYYSDSPRHNAPLFHLDSLAKVTLDLHFIENNNREVQNDADVKNLIREICNVKTLHLTCSTVEVISVYCKGGLPMFNNLVELVFSSKKEGWRVLLPLLLENSPNLETLVLSDLHRYTFGRRHRFVGIPIPPNNQIKVLRIMQYQGSATVLKHISHFLLNMDCLEVMKVNVAAALDDPKKMQLTEDLLKLPTASCKLKIQVL

SEQ ID NO: 33081 - protein, 387 aa, Arabidopsis thaliana
MEQLNPASMDCLPDELLVEILSSLTTKQAVSTSLLSKRWKTLYSLVHNLDIDDYILFHREDGYHRYRPDIQKSFEDFVERTLAFRGHIKTFSLKSRELYAFGLGVDVVNRWICNALERGVSELHLCINSQFELPYKFFTSTTLVMLSLGRGLVCSKIPPETSLPVLKILFLYSIWFKDLTRHVVDLYYSDLPRRKAPHCHLDSLAKVTLDLHYLRYGYQKVQNYANVKNIISEIRNVKTLHLTSSAVEVISVCRKDGLPVFNNLVELMFSSRKRHRKVLPLLLERSPNLETLILSDLYRYTYGRRHRFVGIQIPANNKIKMLSFMQYQGSATELKHISHLLLKMECLEVVKVYLATEMNDLKKMQLTEDEVKLPAASSKVKIQVMGS

SEQ ID NO: 33082 - protein, 449 aa, Arabidopsis thaliana
MNNSKSNLLDTEHGDKVAEQMNLASMDCLPDDLLVQILYFLPTKEAISTSLLSKRWRTLYSLVHNLDLDDYIFWHHEDGYNQYFSNDIQKSFEEFMERTLALLGGGHIKTFSLISDEIYRFDHVVDSIRPWLYYNLQKDSLWQFGFPYKVFTSTKLVKLSLGTRLACPRIPQDTSLPVLKVLLLEYIWFEDNQLSDVFLAACPALEDLTIHHMFRPFLISSKNLKKLSVTINFSYYVDRSTILTLDTPNVVDLYYSDFPRPIAPHCHLDSLAKVELDLHSLEDDSRQVQNDADVKNLISEIRNVKTLHLTYSAVELMLSSKKRDWKVLPLLLERSPNLKTLVLSGLNRYTFGRRHRFVGIQIPSSNKIKMLSIKQYQGSATELKHISHLLLKMECLELVKVYLATEMDDLKKMQLTEDVVKLPAASSKIVEKLKAFGAKAVLERVSFLD

SEQ ID NO: 33083 - protein, 202 aa, Arabidopsis thaliana
MTFTVGYVTHWNMVSPSFMYVISNKTIKKLSVTCLNCRYYGTVPRNISFDTPNVVDFNYSDYLRRESPQCHLDSLAKATLDLHFFEDDKRADVTDLISGLHNVKTLHLTSSTVEVISVCCKGGLPVFNNLVDLVFSSKKEGWKVLLPLLIERSPNLKNLVLSCLEVVKVYVAAEMDDTKKMQLTEDLLKFPAASSKLKIQVM

SEQ ID NO: 33084 - protein, 193 aa, Streptomyces coelicolor A3(2)
MRARPRDPGKIQTAPPSILCMTSAPNTRNDDNLPLDVEIGALQGGAADLSQYAGRVVLVVNVASKCGLTPQYAGLERLHERYAEQGFTVLGVPCNQFMGQEPGSADEIAEFCSATYGVTFPMTGKAEVNGEGRHPLYDRLTGFADAEGHSGDIRWNFEKFLIGRDGKVAARFSPQTEPEAAEVVAAVEERLAG

SEQ ID NO: 33085 - protein, 323 aa, Streptomyces coelicolor A3(2)
MTHTEQQPLNSPFSAATTAEDVMAGHDLSGVTAVVTGGYSGLGLASTRALTAAGARVLVPARRPDIARAALRDVKGSEVVPMDLTDLDGVRSAAAHIGDRIDRIDLLMAAAGVMATPERRVGPGWEFQLAANHFGHFTLACELYPLLAAAGGARVVAYSSAGHAMTDIRRHDPHFRTGYDRWLAYGQAKTANALFAVHLDALGKDDGIRAFALHPGKIITGLQREMPLQEQIDAGWVDEHGNVVAADFKTASQGAATGLWAATSPLLDGRGGLYLADCDVARVFPPDTPMDDNGVRPYAVEPANAARLWEMSLAATGATPPTR

SEQ ID NO: 33086 - protein, 504 aa, Streptomyces coelicolor A3(2)
MTAETSSSGSVPASTGTVTTAVPARLDRLPWSRWHWMIVIGLGTVWILDGLEVTIVGNVAGRIAEDGSGLDISSAQITGLAAALYVAGACSGALFFGWLTDRHGRKKLFMLTLVVYLAATALTAVSFESWWFFLFRFLTGFGIGGEYAAINSAIDELIPSHYRGRVDLIINGSYWLGAIGGALLSIVMLDTDIFAKDVGWRLSFALGVVLGLVVLLVRRHVPESPRWQFIHGQGEKADTLVSSVEREIEREKGAKLPPPAGEITIHQRKSIGFGLIAKTVFRRYPRRAVLGLSLFIGQAFLYNAITFGFGTILITFFDVPTGSTGYYFAVIAAGNFCGPLLLGHLFDTVGRRIMISSTYLLSGVLLFGTAWLFDRGSLTATTMTACWCVVLFFASAGASSAYLTVSEIFPMETRAMAIAFFYALGTAAGGISGPLLFADLTESGVVGDTVLAFQIGAGLMCAAGLVAAFLAVKAERRSLEDIAEPLSTAVPETPGTAGPGAKTA

SEQ ID NO: 33087 - protein, 165 aa, Spinacia oleracea
MSRNGNFIDKTFSVVANILLQIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQALTLTPGNYIEAHNWLKITGRFE

SEQ ID NO: 33088 - protein, 203 aa, Capsicum annuum
MNPEYDYLFKLLLIGDSGVGKSCLLLRFADDSYLDSYISTIGVDFKIRTVEQDGKTIKLQIWDTAGQERFRTITSSYYRGAHGIIIVYDITDQESFNNVKQWLSEIDRYASENVNKLLVGNKSDLNDNRAVSYDTAKAFADEIGIPFMEASAKSATNVEQAFMAMAAEIKNRMATQPASNNAKPPTVQIRGQPVNQKSGCCSS

SEQ ID NO: 33089 - protein, 398 aa, Pneumocystis carinii
MQSEAYQTNLQCSGETSHKLGIKEAKSTSKTSLIDQIPILTLSIPSRRSIPHIFDATRITDNSDNSHNENQDFKGILEENGSPDPFSYNRSYFTKIMLDEVWQRSAHSDEIIELEKLGEGISGSVSKCILKNTGTLFALKTILVDTNPEIQQQILRELSINRTCSSEYIVQYYGTFVDEASSNISMAMEYCAGGSLDRLYKKVRANGARIGEYPILKIAENALKGLNYLHTRKIIHRDIKPSNILMTLEGQAKLCDFGVSGELVSSMAKTFTGTSYYMAPERIKGETYSITSDIWSLGLTLMEISQNRFPFPPEGPPLVPIELLNYIVNISNFELVDEPDNKIKWSEDFKHFLKTCLERDGAKRPNSQRMLEHPWVMKHSIIKIDMAKWIKQILELPL

SEQ ID NO: 33090 - protein, 313 aa, Arthrobacter sp. Q36
DPGADFAGRVVVVPIGIEDSLPWPALRRLETADLATLLPRPARRAHKYSRGVLGVVAGSPAYPGAAVLACRGALAAGVGMVRYVGPPEVADLIRHSCPEVVCSIGTVAETHVQAWLVGSGMDGKDEEEMQRVRDAVDSGLPAVADAGALPVLPDVLAPQVVLTPHAGELATLLQRLGADLDREAVEASTLPAVRRAACLTEATVLLKGASTLVASPYQDFYSQSEGTPWLATAGSGDVLSGIIGALLAQVGSDVGRFRAVGIDPDERWAAIAAMGASLHGLAGAAAAAGGPLTAGRISDVLPEIWGKVSTLSN

SEQ ID NO: 33091 - protein, 191 aa, Yarrowia lipolytica
MQTIKCVVVGDGAVGKTCLLISYTTNKFPSEYVPTVFDNYAVTVMIGDEPYTLGLFDTAGQEDYDRLRPLCYPQTDVFLVCFSVTSPASFENVKEKWFPEVHHHCPGVPCLIVGTQVDPRSDRMILDKLSRHKLRPMTTEQGYQLARELGAVKYVECSALTQKGLKDVFDEAIVAALEPPVVKKNKKCIVL

SEQ ID NO: 33092 - protein, 389 aa, Euphorbia esula
MEDASATTTAPSDSLNNHQLPPTAGIENIPATLSHGGRFIQYNIFGNIFEVTAKYRPPIMPIGKGAYGIVCSALNSETGEHVAIKKIANAFDNKIDAKRTLREIKLLRHMDHENVVAIRDIMPPPQREVFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTAAIDVWSVGCIFMELMDRKPLFPGRDHVHQLRLLMELIGTPSEEELGFLNENAKRYIRQMSVFRRQSFTEKFPTVHPAAIDLVEKMLTFDPRQRITVEDALAHPYLTSLHDISDEPVCMTPFSFDFEQHALTEEQMKELIYREALAFNPEYQQQ

SEQ ID NO: 33093 - protein, 153 aa, Euphorbia esula
MDTGAKLKKGAGERKGGGPKKKPVSRSVKAGLQFPVGRIGRFLKKGRYAQRVGSGAPVYLAAVLEYLAAEVLELAGNAARDNKKNRIIPRHVLLAVRNDEELGKLLAGVTIAHGGVLPNINPVLLPKKAEKAAAAATKEPKSPAKATKSPKKA

SEQ ID NO: 33094 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFGSNA

SEQ ID NO: 33095 - protein, 454 aa, Asparagus officinalis
MGPPDVVPSEHVEFDFSDVFGPSPTPTSTGVNVFASDGSTPAASDDIVYTEPAVILARSHSLVGPTALVCQSPRLRKHILHEADLELVECPSGVEGEQDKPFSCVAEEHEVPSSENVERVGLEDFDFLKVVGQGAFGKVFQVMKKGTSEIYAMKVVRKDTILEKNHSEYMKAERDILTKIDHPFIVQLRYSFQTKYRLYLVLDFVNGGHLFYQLYHQGLFREDLARIYTAEIVSAVSHLHANGIMHRDLKPENILLDADGHVMLTDFGLAKEFEENTRSNSLCGTIEYMAPEIIQGKGHDKVADWWSVGILLFEMLTGKPPFIGGNRDKIQQKIVKDKLKLPAYLTSEAHSLLKGLLQKEASKRLGGGPAGSNEIKNHKWFKLINWRKLEAREIQPSFKPNVAGKICVANFEERWTSMPLTVSPVASPVAGSGNFSGFTYVKPSVFLQKPSPLG

SEQ ID NO: 33096 - protein, 466 aa, Streptomyces coelicolor A3(2)
MSESDPVPGGRPGEVERATALSGELTGQGVHGVVLAYVDTAGIARVKTVPTAKLAAAAAWGVGMSPVFDTFLADDSIVGTDVLGSPDGDLRLYPDLDRLTMLAAQPGWAWAPVDRITQEGAPHPACGRTVLRRIVAGAAERHGITFRAAVEVEWVVGRGDAGGDAFVPAVSGPAYGAARQVELSDCAADLLAALAAQGVDVEQFHPEYAAGQFEVSVGALGPVAAADHSVLVRQTIRAVSARHGLRVSFAPAVLGQGVGNGGHLHLSAWRDGTNLHAGGTARCGMTAEAESFVAGVLGHLPALTALTAPSPASRLRLRPSQWAGVFTAWGRETREAALRIVTGTAGIRDRAANLEVKPVDLAANPYLALASVIAAGLDGLASSAPLPEEITGDPARLDPAAAAARGVRRLPVTLTESVAAFRTDGVLREALGPVLADAVIAVRLGEAGSVEGLDDDGVAAAYRWKY

SEQ ID NO: 33097 - protein, 511 aa, Streptomyces coelicolor A3(2)
MATLSVAAVLAENARRRPDKEALVEGDLRLTFAEVWRRALARAGALVGLDVRPGDRVALMAPNTADFPVAYYAAAAAGAVVVPVHLLLSPAEVEHVLRDSGATLLLCHPAQAETGAAAARQAGVRTITLGEEFDRLAADAEPLPSYVTRDADDPAVVFYTSGTTGVPKGAVLSHFNLVMNATVNAFDANDIRPDDVALGALPLFHAFGQTVSLNSTWRAGATLVLLPRFDAARAIELMVKEGVNTFHGVPTMFVALAAAAAGAAALPELRVCISGGASLPVAVLERFEEAFGAKIYEGYGLSETSPAAAVNQPVFGARPGTIGHPLWGVDVEIARAEVEDAVELLPPGELGEVVVRGHNVFSGYLGRPEATAQALVDGWFRTGDLGTKDEDGFLRIVDRKKDVIIRGGYNVYPREVEEVLMRHPGIAQVAVIGLPDELHGEEVCAVVVRAPGTTPDAVPDAAGVTEWSKQHLGRHKYPRRVEFTDELPLGPSMKVLKRELRAVYTDHRGPR

SEQ ID NO: 33098 - protein, 320 aa, Streptomyces coelicolor A3(2)
MAESVPRFDLITMGRIGVDLYPLQTGVPLAEVETFGKFLGGSASNVAVAAARLGRATAVITRTGDDPFGGYLHDALKEFGVDDRWVTPVAAYPTPVTFCEIFPPDDFPLYFYRRPKAPDLEIHPEELDLDAIRAASIFWMTGTGLSEEPSRTATLSALAHRAKSGTTVFDLDWRPMFWADPDQARPYYAEALAHATVAVGNLDECEIATGVREPRACAEALLAAGVELAVVKQGPKGVLAAHRDGRSAEVPPVPVEVVNGLGAGDAFGGSLCHGLLSGWELERIMRYANAAGALVASRLACSSAMPTEAEVDDLLARATP

SEQ ID NO: 33099 - protein, 325 aa, Streptomyces coelicolor A3(2)
MRTESTANNEHDEHLGADPTGDRSARRAVTVFPVLVLLAGALGLLLPGSFTGWSEAVPYLLGVVMFCMGITMTPEDFRGVVKRPWAVALGLVAHYVIMPGLGWAIAHLLDLPPQLAAGVILVGCAPSGTASNVVTYLARGDVALSVSVATVSTLVAPLVTPPLTLLLAGEYLPVDAGSMVTDILKTVLLPVLAGVVVRLLAGRYVQRALPALPWLSALTISVIVAVVVAGSADAIKSAAGLVFVAVVLHNGLGLALGYGAGRLGRLGEPGSRAMAFEVGMQNSGLAASLATAHFSPLAALPAAVFSVWHNVSGAVVAAWLSRRGR

SEQ ID NO: 33100 - protein, 314 aa, Fragaria x ananassa
MAVASTSLASQLSGPKSLSQPYSGLRRSCPKLDQSHSSLFQHLSLSSSSRKASRAVVAMAGTGKFFVGGNWKCNGTKDLISKLVSDLNSAKLEPDVDVVVAPPFLYLDQVKSSLTDRIEISGQNSWVAKGGAFTGEISVEQLKDIGRKWVILGHSERRHVIGEDDQFIGKKAAYALNEGLGVIACIGEKLEEREAGKTFDVCYEQLKAFADAVPSWENIVVAYEPVWAIGTGKVASPQQAQEVHVAVREWLKKNVSAEVASKTRIIYGGSVNGGNSAELAKEEDIDGFLVGGASLKGPEFATIVNAVTSKKVAA

SEQ ID NO: 33101 - protein, 486 aa, Arabidopsis thaliana
MKHGTYTSDVAEFNMVMETTKAGTHNSEACLQEGTCLPLGGYSVWSSLPPISVSSSNNRKPVVLTVASMDTASFFRDKSFGADSPISGLVALLGAVDALSRVDGISNLKKQLVFLVLTGETWGYLGSRRFLHELDLHSDAVAGLSNTSIETVLEIGSVGKGLSGGINTFFAHKTRVSSVTNMTLDALKIAQDSLASKNIKILSADTANPGIPPSSLMAFMRKNPQTSAVVLEDFDTNFVNKFYHSHLDDLSNINSSSVVAAASVVARTLYILASDNKDTSNSALGSIHVNASFVEELLTCLLACEPGLSCNLVKDYISPTNTCPGNYAGVILGEPSSKPYLGYVGDVSRFLWNFLADKTSVQKGNTTSVCSKGVCSKTDEVCIKAESNKEGTCVVSTTRYVPAYSTRLKYNDGAWTILPQNSSDSMGMVDPVWTESNWDTLRVHVYTVQHSAYDNAVLVAGITVTTLAYIGILAAKSIITKALKQD

SEQ ID NO: 33102 - protein, 451 aa, Arabidopsis thaliana
MEQGESLRIRVVMGKDRISELPDGLLLKILSSLPTNIVVATSVLSKQWRSLWKLVPNLEFDSDDYESEHYTFSEIVCKSFLSHKAPVLESFRLKFVNFNPVDIGLWVGIAFSRHLRELVLDFYPAELGKGVTFTFPSSLCTCNTLETLKLVLCILVDIPSPVLMKSLRTLHLEFVRYKDESSVRNLLSGCPGLEELRLYRGDDSDIKVFTIEVPSLQRLTIHDNNDGPEFWGYVINAPFLKYLLIEELRCPEFCLNAPELVEANIAEVTSITIEKFLGSFTSVSRLLLNLSPLKITYPTGSMFYQLVSLEMYTREAEWWNLLTLMLENSPKLQVLKLTDRSQNFHKDGLVSGKWNEPKDVPECLLSQLETFVWRRFDWGREEEKEIATYILKNGRRLKKATFSTNPIESEELNKLKERRKVLNGLDGVVRASNSCQLVFKFDPSYLGSDSP

SEQ ID NO: 33103 - protein, 455 aa, Arabidopsis thaliana
MNLFWNTGFCVIVLVVARVGHWWYQWSNPKSNGKLPPGSMGFPIIGETLDFFKPYGFYEISPYLKKKMLRYGPLFRTNILGVKTVVSTDKDVNMEILRQENKSFILSYPDGLMKPLGKDSLFLKIGNIHKHIKQITLHLLSSEGLKRKILKDMDRVTREHLSSKAKTGRLDVKDAVSKLIIAHLTPKMMSNLKPQTQAKLMGIFKAFTFDWFRTSYLISAGKGLYNTLWACREGMREIKDIYTMRKTSEEKYDDFLNTAIEESEKAGELLNENAIITLIFTLSCVTQDTTSKAICLAVKFLLENPKVLAELKKEHEVILESREDKEGGVTWEEYRHKMTFTNMKSGYTIPAGWIVMIIPSVVHFDPEIYENPFEFNPWRWEGKELRAGSKTFMVFGTGLRQCAGAEFARLQISVFLHHLVTTYNFSLHQDCEVLRVPAAHLPNGISINISKCPKK

SEQ ID NO: 33104 - protein, 379 aa, Arabidopsis thaliana
MATWNASSPAASPCSSRRRTKAPARRPSSESPPPRKMKSMAEIMAKSVPVVEQEEEEDEDSYSNVTCEKCGSGEGDDELLLCDKCDRGFHMKCLRPIVVRVPIGTWLCVDCSDQRPVRRLSQKKILHFFRIEKHTHQTDKLELSQEETRKRRRSCSLTVKKRRRKLLPLVPSEDPDQRLAQMGTLASALTALGIKYSDGLNYVPGMAPRSANQSKLEKGGMQVLCKEDLETLEQCQSMYRRGECPPLVVVFDPLEGYTVEADGPIKDLTFIAEYTGDVDYLKNREKDDCDSIMTLLLSEDPSKTLVICPDKFGNISRFINGINNHNPVAKKKQNCKCVRYSINGECRVLLVATRDISKGERLYYDYNGYEHEYPTHHFL

SEQ ID NO: 33105 - protein, 461 aa, Streptomyces coelicolor A3(2)
MQFHDSMISLVGNTPLVRLNSVSKGIRATVLAKVEYFNPGGSVKDRIALRMIEAAEKSGELQPGGTIVEPTSGNTGVGLAIVAQQKGYKCIFVCPDKVSTDKINVLRAYGAEVVVCPTAVDPEHPDSYYNVSDRLVRETPGAWKPDQYSNPNNPLSHYHSTGPELWEQTEGKITHFVAGVGTGGTISGTGRYLKDASDGAVTVIGADPEGSVYSGGSGRPYLVEGVGEDFWPTAYDREVADEIVAVSDKDSFQMTRRLAKEEGLLVGGSCGMAVVAALEVAARLGEDDVVVVLLPDSGRGYLSKIFNDEWMADYGFLEDTGPSARVAEVLNHKEGGHIPSLVHMHPDETVGQAIEVLREYGVSQMPIVKPGAGHPDVMAAEVVGSVVERELLDALFAKRASLEDPLEKHMSAPLPQVGSGEPVADLMSVLGGADAAIVLVEGKPTGVVSRQDLLSFLAKVK

SEQ ID NO: 33106 - protein, 330 aa, Nicotiana tabacum
ISDEKLKELFSPYGTITSCKVMRDPSGVSKGSGFVAFSNPEEASRALSEMNGKMVVSKPLYVALAQRKEERRARLQAQFSQMRPIAMASSVAPRMPMYPPGGPGLGQQIFYGQPQPAMLPPQAGFGYQQQLVPGMRPGGGPMPNFFMPMVQQGQQGQRPGSRRGGAVPLQQGQQPVPLMQQQMFPRGRGYRYPPGRGLPDVAFPGVGGGMFSIPYDMGGMPVRDAGIVQPIPVGALATALANSSPTEQRTMLGENLYPLVEQLEPETAAKVTGMLLEMDQTEVLHLLESPEALKAKVAEAMEVLRNVSQQQSSNPADQLASLSLNDGLVS

SEQ ID NO: 33107 - protein, 479 aa, Nicotiana tabacum
AQGAIDKLNGMLMNDKQVYVGHFLRKQERESTTGMTKFQNVYVKNLSESTTDDGLKKVFGEFGNITSAVVMRDADGKSKCFGFINFETAEDAAKAVESLNGKKFDDKEWYVGKAQKKSEREQELKSKFEQTAKEAVDKYQGLNLYVKNLDDTIDDEKLKELFSEFGTITSCKVMRDPSGISRGSGFVAFSTSEEASRALSEMNGKMIVSKPLYVALAQRKEERRAKLRAQFSQLRPVAMPPSLAPRMPIYPPGAPGIGQQLFYGQGPPAMIPPQAGFGYQQQLVPGMRPGGAPMPNFFMPLVQQGQQGQRPGGRRGAGPVQQTQQPMPLMQQQMLPRGRMYRYPPGRNGPEGPMPGVPGGMLSVPYDMGGMLPRDSAMGQPMPISTLASALANAPPEQQRTMLGESLYPLVDQLEHEHAAKVTGMLLEMDQTEVLHLLESPEALKAKVAEAMEVLRNVQQTTNPADQLASLSLNDNLVS

SEQ ID NO: 33108 - protein, 270 aa, Methanothermobacter thermautotrophicus str. Delta H
MSGAKSMSYAEMFRRADGCAFVPFVVAGDPDMETSLEIIRTLVDAGADALEVGFPFSDPIADGTSVQGADLRALRAGMTTEKCFQLIERVREFTSIPIGLLVYYNLIYRMGVDEFYRRAAEAGVTGILAADLPPEEASDALRAAEKYDIDQIFIVAPTTGSERLKRISEVSSGFHYLVSVMGVTGARSRVEDATIELIKRVKAEGSLPVMVGFGVSRPEHVRMLRDAGADGVIVGSAIIDVISGNLGDRELMLQRIHEMAGTLKAAGGSG

SEQ ID NO: 33109 - protein, 281 aa, Methanocaldococcus jannaschii
MIMKLAEKFEELKNKGEKAFVAFYVGGDPNLEISEKALEVICKHADIVEIGIPFSDPVADGITIQKADVRALNSGMNPLKAFELAKKLNEKAPNVPKVFLTYYNIIFKMGEEEFVKKCKEAGVSGIIVPDLPIEEADSLYNYCKKYGVDLIFLVAPTTPDERLKKILEKCSGFVYVVSVTGITGAREKVAEETKELIKRVKKFSKIPACVGFGISKREHVEEITEIADGAIVGSAIVKIVEKHLDENGQIKDEEKFLKELEEFVKNLKEGTKKKAKVAIKN

SEQ ID NO: 33110 - protein, 246 aa, Cynodon dactylon
AIGDKPGPNITATYGSKWLEARATFYGSNPRGAAPDDHGGACGYKDVDKPPFDGMTACGNEPIFKDGLGCRACYEIKCKEPVECSGEPVLVKITDKNYEHIAAYHFDLSGKAFGAMAKKGQEDKLRKAGELTLQFRRVKCKYPSGTKITFHIEKGSNDHYLALLVKYAAGDGNIVAVDIKPRDSDEFIPMKSSWGAIWRIDPKKPLKGPFSIRLTSEGGAHLVQDDVIPANWKPDTVYTSKLQFGA

SEQ ID NO: 33111 - protein, 314 aa, Cicer arietinum
FCESFKSSFSSFMKSTITGISMGLGPDGELRYPSHHDIPSNSKTQGIGEFQCYDQNMLSSLKQHAESSGNPLWGLGGPHDVPTYDQSPYSNSFFKDGGSWESSYGDFFLSWYSSQLIKHGDCLLSLASSTFSDTGVSIFGKIPLMHSWYGTRSRPAELTAGFYNTAKRDGYEQVATMFAKNSCKIILPGMDLSDANQPNETRSSPELLLAQTMKAFRNHGVKVSGQNSSEFGSPGGFEQIKKNISGDNVLDLFTYQRMGAYFFSPEHFPSFTELVRSVNQPKLHFDDLPTEEEEGGGGETAVMSQESSVSMQAA

SEQ ID NO: 33112 - protein, 469 aa, Podophyllum peltatum
TKASAGFKAGVKDYKLTYYTPDYVTKDTDILAAFRVTPQPGVPPEEAGAAVAAESSTGTWTTVWTDGLTSLDRYKGRCYHIEPVAGEDNQYICYVAYPLDLFEEGSVTNMFTSIVGNVFGFKALRALRLEDLRIPTAYVKTFQGPPHGIQVERDKLNKYGRPLLECTIKPKLGLSAKNYGRAVYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGIHFRVLAKALRMSGGDHIHAGTVVGKLEGEREITPGFVDLLRDDFIEKDRSRGIYFTQDWVSLPGVLPVASGGIHVWHMPPLTEIFGDDSVLQFGGGTLGHPWGNAPGAVANRVALEACVQARNEGRDLARQGNEIIREACKWSPELAAACEIWKEIKFEFEAMDTL

SEQ ID NO: 33113 - protein, 502 aa, Brassica rapa subsp. pekinensis
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIATGSRAQKPNIPGHELAITSDEALSLEEFPKRAIVLGGGYIAVEFASIWRGMGATVDLFFRKELPLRGFDDEMRALVARNLEGRGINLHPQTSLAELIKTDDGIKVISSHGEEFVADVVLFATGRIPNTKRLNLEAVGVELDQAGAVKVDEYSRTNIPSIWAVGDATNRINLTPVALMEATCFANTVFGGKPAKADYTNVACAVFCIPPLAVVGLSEEEAVEKATGDILVFTSGFNPMKNTISGRQEKSLMKLIVDEKTDKVIGASMCGPDAAEIMQGIAIALKCGATKAQFDSTVGIHPSSAEEFVTMRTVTRRIAYKAKPQTSL

SEQ ID NO: 33114 - protein, 269 aa, Buchnera aphidicola
MNRYQTLQKKLVPFKKGCFIPFIILGDPSIEMSLKIIDVLIENGADGLELGFPFSDPLSDGKTIQKAHLRAFSSKMNIYLCFEMLQKIRKKYNTIPIGLLLYANLIFKFGINNFYLKCFNVGIDSVLIADLPVEESNDFRKCAIANNISSVFVCPHDAKKNVIKKISLYSTGYIYLLSRSGVTGTDKKIIVPSLNLIKNLKKITEKLLIQGFGISNSKQIQKIILSGISGVICGSVIIKLIENHFQNEKKMLKNIKRLSRSLKQSTIIF

SEQ ID NO: 33115 - protein, 389 aa, Lycopersicon esculentum
MASTKQYFSAAGKPIRCKAAVARKAGEPLVIEEVIVAPPKAHEVRVKIICTSLCHTDITLWKLKEFPGCFPRILGHEAFGVVESVGEDVDELKEGDSVVPIFLPDCMDCVDCKSKKSNLCSKFPIQVSPLLHRNDTSRFSNAAGETLHHFLYISSFSEYTVVDVVNVTKIDPEIPPNRACLLSCGVSTGVGAAWKTANVEPGSTVVIFGLGSIGLAVAEGARLCGATRIIGVDINSNKFEIGKQFGITEFVNSKSCVDKPISQVIIEMTDGGADYCFECVGLATLVQEAFTCCRKGWGKTVVLGVDKPDAHLNLNSFEVLQSQKTLTGALFGGLKPKSDVPILVKRYLDKELQLNKFVTHEVNFEDINKAFDLLIQGKSLRCVIWMDKL

SEQ ID NO: 33116 - protein, 390 aa, Lycopersicon esculentum
MASTVQSGISKTAGKPIRCRAAVARKAGEPLVIEEVIVAPPKAHEVRLKIICTSLCHTDITLWKLKEFPGCFPRILGHEAFGVVESVGEDVDHLKEGDSVVPIFLPDCMDCVDCKSKKSNLCSKFPIQSSLLLHRDDTSRFTNADGETLHHYLYISSFSEYTVVDVVNVTKIDPEIPPNRACLLSCGVSTGVGAAWKTANVEPGSTVVIFGLGSVGLAVAEGARLCGATRIIGVGRNSDKFEIGKQFGVTEFVNSKSCGDKPVSQVIIEMTNGGADYCNECVGLGRVVQEAFACCRKGWGKTIVLGVDKPDARLNLNSFEVLQSNKTLMGSFFGGLKPKSDVHTSLKRYLDKELELDKFVTHEVNLEDINKAFDLLIQLKTLRCVIWMEK

SEQ ID NO: 33117 - protein, 180 aa, Echinochloa phyllopogon
PSGASTGIYEALELRDRPSDYLGKGVLKAVDNVNSIIGPAIYGKEPTEQVDIDNLMVQQLDGTSNEWGWCKQKLGANAILAASLAAVKAGSMVKIPLYQHIANLAGNKKIVLPVPALNVINGGSHAGNKLAMQEFMILPTGVSSFKEPMKMGVEVYHNLKSIIKKKYGQDATNVGDEGGF

SEQ ID NO: 33118 - protein, 370 aa, Aspergillus awamori
MPSAKPLFCLATLAGAALAAPAPSRATDFNKRSTCTFTDAATASESKTSCSDIVLKDITVPAGETLNLKDLNDGTTVTFEGTTTWEYEEWDGPLLRISGKDITVTQSSDAVLNGNGAKWWDGEGTNGGKTKPKFFYAHDLDDSKISGLYIKNTPVQAISVESDNLVIEDVTIDNSDGDSEGGHNTDGFDISESTYITITGATVKNQGDCVAINSGENIYFSGGTCSGGHGLSIGSVGGRDDNTVKNVTFIDSTVSDSENGVRIKTVYDATGTVEDITYSNIQLSGISDYGIVIEQDYENGDPTGTPSNGVTISDVTLEDITGSVDSDAVEIYILCGDGSCTDWTMSGIDITGGETSSDCENVPSGASCSQ

SEQ ID NO: 33119 - protein, 425 aa, Schizosaccharomyces pombe
MSVLGKTLQEKVNLLAQYPQTGLSLKQLVYFGKNPTPGTLFRAGLFLRDELPIRLARRIQDLQNLSPMLRSMKRISSVKAAYGRSMEEIIELKGVELPKCLPKHARYHNAPKWRSSLMDSEILHNPSLANTHLDSSKGRYFETDFSDQDNGVDCNWPESLLKFNSNFAYLLNTIRTRHDNVAVEIALDIQEYRRKTNQIDNSIQIFLDRFYMSRIGIRMLLGQYIALVSEPPRENYVGVISTRANIYQIIEGAAENAKYICRLAYGLFEAPEIQIICDPSLEMMYVESHLNHAVFEILKNSLRATVEFHGVDSDFFPPIKVIVAKGQEDITIKISDEGGGISRRNIPLVWSYMFTTASPTLTDDPHDIVSANSTTPMAGFGFGLPLARLYTRYFGGDLELISMEGYGTDVYIHLNRLCESAEPLQ

SEQ ID NO: 33120 - protein, 434 aa, Beta vulgaris
MDRYKLLKELGDGTCGTVYKAVNRESYEIVAVKKMKRKFYFWEECVNLREVKSLPSIESSHIIKLKEVVRENNDLFFIFEYMQYNLYQIMKDRHRPFTEEEIRNFLTQVLQGLAHMHRNGYFHRDLKPENLLVTNDVIKIADFGLAREVSSIPPYTEYVSTRWYRAPEVLLKSSLYTPAIDMWAVGAVLAELFTSCPIFPGESETDQLYKICCVLGAPDWAVFPEAKNISQLTSISYSQMLPANLSEIIPNANWEAIDLISQLCSWDPLKRPTAEQALHHPFFHVALRVPRPIHDPFHSKPDYTKTKPNLELNLWDFDSKADDCFLGLTLAVNPGVSSLEMGPRVSGSTRQDVYFCSSFQDHPEQSVFWSLFSPCRNGATPPVDPSLSLSFSSITHPRIAVPHSGGFGLAALQPGILDGPLLVVSSPHQPSHYL

SEQ ID NO: 33121 - protein, 362 aa, Chondrostereum purpureum
MPSLSSILKGLGDVTLFASVATVTAVPKRASCTVASVSDAANISGCTSVTIKSFTVPSGQTLVLNPSDGTTVAMVGDVTFAKTTSSGPLFTIDGSNIKFKGAGHKFDGNGAKYWDGQGTNGGVTKPHPFLKFKGSGQYSSFTVLNSPAQAISIGNSDGLTFDTVTVDNSAGDSGSLGHNTDGFDVSADNVTIQNSVVKNQDDCIAINDGSNIVFQNNQCSGGHGISVGSIASGKHVSGVAIKGNTVTNSMYGMRVKVKAAATSASVSAVTYSGNTISAIAKYGFLVSQSYPDDASTPGTGAPISGINFSGDTTNIKVNSGAKRVTVDCRSCTGTWNWSKLTATGGSAGTISSDKAKISGGSY

SEQ ID NO: 33122 - protein, 403 aa, Chondrostereum purpureum
MTSFSSLFKLLILVSVTAAAPSKRATCTVKSVDDAKDIAGCSAVTLNAFTVPAGKTLVLNPDKGATVTMAGDITFAKTTLDGPLVTIDGTSINFVGADHKFDGNGALYWDGLGTNNGTHKPHPFLKIKGSGTYKKFEVLNSPAQAISVGPTDAHLTFDGITVDDFAGDTKNLGHNTDGFDVSANDVTIQNCIVKNQDDCIAINDGKNIRFENNQCSGGHGISIGSIATGKHVSNVVIKGNTVTRSMYGIRIKAQRKATSASVSGVTYDGNTISGIAKYGLLISQSYPDDVGTPGTGAPFSDVNFTGGATTIKVNTAAKRVTVECGNCSGNWDWSKLTVTGGKAGTIKSDKAKITGGQYLADQPAGNDIEEMPAQDPNDPEDPDTAMQEAEAEEAAAGDLTPSD

SEQ ID NO: 33123 - protein, 362 aa, Chondrostereum purpureum
MSSISSLLKLLALSSVVAAMPSRESKRATCTVKSVADSSDIAGCSVVTIDSFTVPAENTVIMKPDSGATVTMTGDITFDKTTLDGPLFTIQGTDIKFDGGNHKFDGNGTVYWDGLGGNGGTHKPHPFLKFKGSGSYSNFEVLNSPAHAISVGPTTGNILFDTVTIDNSAGDVDSLGHNTDGFDVSADNVTIQNCIIKNQDDCIAINNGKNIQFLNNQCSGGHGISVGSIGTGKHVSSVTIKGNTVTNSTNGLRVKVQASATNASVSGVTYDNNTLSGITKYGLLITQSYPANEGEAGTGGPISDINFTGGATNINVTSKAKRVSVNCAACTGNWDWSQLTVTGGKAGTINSDQAQINGGQYV

SEQ ID NO: 33124 - protein, 367 aa, Chondrostereum purpureum
MSSFSSLIKHLALLSLVAAAPSKRATCTVKSVADSNDIAGCAAVTIDSFTVPAGSTIDMKPDSGATVTMAGDLTFAKTTLDGPLFTIEGTNIKFVGANHKFDGNGAMYWDGLGTNNGTHKPHPFLKFKGSGNYANFEVLNSPAQAISIGNTNGNIVFDTVTVDDSAGDTNSQGHNTDGFDVSADNVTIKNCIVKNQDDCIAINDGKNIQFLNNQCSGGHGISVGSIATGKHVSSVTIKGNTVTNSMYGLRVKVQASATNASVSGVTYDGNTLSGITKFGLLVSQSYPADEGKAGTGGPISGIDFTGGATNIKVNTGSKRVSVNCAACSGTWDWSQLTVTGGKAGTINSDQAKISGGKFADDDDSETS

SEQ ID NO: 33125 - protein, 487 aa, Pasteurella multocida
MLRVIKEALTFDDVLLVPAHSTVLPNTADLSTQLTKTIRLNIPMLSAAMDTVTETKLAISLAQEGGIGFIHKNMSIERQAERVRKVKKFESGIVSDPVTVSPTLSLAELSELVKKNGFASFPVVDDEKNLVGIITGRDTRFVTDLNKTVADFMTPKARLVTVKRNASRDEIFGLMHTHRVEKVLVVSDDFKLKGMITLKDYQKSEQKPQACKDEFGRLRVGAAVGAGPGNEERIDALVKAGVDVLLIDSSHGHSEGVLQRVRETRAKYPDLPIVAGNVATAEGAIALADAGASAVKVGIGPGSICTTRIVTGVGVPQITAIADAAEALKDRGIPVIADGGIRFSGDISKAIAAGASCVMVGSMFAGTEEAPGEIELYQGRAFKSYRGMGSLGAMSKGSSDRYFQSDNAADKLVPEGIEGRIPYKGFLKEIIHQQMGGLRSCMGLTGCATIDELRTKAQFVRISGAGIQESHVHDVTITKEAPNYRMG

SEQ ID NO: 33126 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLVALKVFVQPMKAATRS

SEQ ID NO: 33127 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLTHLVAKLKEYNAAPPLQGFGISSPDQVKAAIDAGAAGAISGSAIVKIIEQHINEPEKMLAALKAFVQPMKAATRS

SEQ ID NO: 33128 - protein, 268 aa, Escherichia coli
MERYESLFAQLKERKEGAFVPFVTLGDPGIEQSLKIIDTLIEAGADALELGIPFSDPLADGPTIQNATLRAFAAGVPPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPKKMLAALKAFVQPMKAATRS

SEQ ID NO: 33129 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPVEESAPFRQAALRHNVAPIFICPPNADDDLLRQIASYGRGYTYLLSRAGVTGAENRAALPLNHLVTKLKEYNAAPPLQGFGISAPDQVKAAIDAGAAGAISGSAIVKIIEQHINEPEKMLAALKAFVQPMKAATRS

SEQ ID NO: 33130 - protein, 268 aa, Escherichia coli
MERYESLFTQLKERKEGAFVPFVTLGDPGIEQSLKIIDTLIEAGADALELGIPFSDPLADGPTIQNATLRAFAAGVTPAQCFEVLALIRQKHPTIPIGLLMYANLVFNKGIDEFYAECEKVGVDSVLVADVPVEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKAFVQPMKAATRS

SEQ ID NO: 33131 - protein, 318 aa, Saccharomyces cerevisiae
RAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVKAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 33132 - protein, 230 aa, Methanocaldococcus jannaschii
  misc_feature (1)..(1): Xaa can be any naturally occurring amino acid
  misc_feature (70)..(70): Xaa can be any naturally occurring amino acid
  misc_feature (111)..(111): Xaa can be any naturally occurring amino acid
  misc_feature (175)..(175): Xaa can be any naturally occurring amino acid
  misc_feature (222)..(222): Xaa can be any naturally occurring amino acid
XEDIKIKEIFENIYEVDLGDGLKRIATKSIVKGKKVYDEKIIKIGDEEYRIWNPNKSKLAAAIIKGLKVXPIKRDSKILYLGASAGTTPSHVADIADKGIVYAIEYAPRIXRELLDACAERENIIPILGDANKPQEYANIVEKVDVIYEDVAQPNQAEILIKNAKWFLKKGGYGXIAIKARSIDVTKDPKEIFKEQKEILEAGGFKIVDEVDIEPFEKDHVXFVGIWEGK

SEQ ID NO: 33133 - protein, 170 aa, Saccharomyces cerevisiae
  misc_feature (71)..(71): Xaa can be any naturally occurring amino acid
  misc_feature (120)..(120): Xaa can be any naturally occurring amino acid
VTSIKLVLLGEAAVGKSSIVLRFVSNDFAENKEPTIGAAFLTQRVTINEHTVKFEIWDTAGQERFASLAPXYYRNAQAALVVYDVTKPQSFIKARHWVKELHEQASKDIIIALVGNKIDXLQEGGERKVAREEGEKLAEEKGLLFFETSAKTGENVNDVFLGIGEKIPLK

SEQ ID NO: 33134 - protein, 322 aa, Salmonella typhimurium
SKIYEDNSLTIGHTPLVRLNRIGNGRILAKVESRNPSFSVACRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEGILAGISSGAAVAAALKLQEDESFTNKNIVVILPSSGERYLSTALFADLFTEKELQQ

SEQ ID NO: 33135 - protein, 412 aa, Sulfolobus acidocaldarius
MKIYLVEHAIGSFGYDESGKLIDFVPNSKDIGKVTEALIENEKGTPLPSAIELINKLKPDQVVVENDAEVPALQKLGIKASSEIRNMGTEIFRENLVNVAIQTKIVNSEDELYNFLYELSMEYTRRKLRGAASKRDLLAIQAIRAIDDIDKTINLFSERLREWYSIHFPELDKLIEDHWLYASIISKFGHRDNLSDTGLEEIGLNKEKIEKIMNAAKNSIGADITDVDIKSVKTLSDIILKLYEERLELTDYTESVMREVAPNVTSLVGPTLGARLLSLAGSLEDLAKMPASTIQVLGAEKALFRALRKGGRPPKHGVIFQYPAIHNSPRWQRGKIARALAAKLAIAARVDYFSGKFIGNKLNEELKKRIDEIREKYAQPPPRKQEQKVEQKGKKERKNKKDKRRGKKEGRR

SEQ ID NO: 33136 - protein, 231 aa, Sulfolobus acidocaldarius
MSEIEKVTKTQFDNVYECIFNDGTTRLCTKNLSPGHNVYGERLIKYGGVEYREWNAFRSKLAGAIVKGLKYNPIVKGSKILYLGAASGTTPSHISDIVELQGKVYSVEFSPRVIRELLLVAQYRPNMFPILADARFPQYYKSLVENVDIVYVDIAQPNETEIAMYNARFFLKKNGYMMIAIKSRSIDVTKDPREIYNAEAKKLEDAGFDIREVLELDPYDKDHAMIVVKYK

SEQ ID NO: 33137 - protein, 341 aa, Sporothrix schenckii
MDNYQKLEKVGEGTYGVVYKARDLTAGGRIVALKKIRLEAEDEGVPSTAIREISLLKEMRDPNIVRLYNIVHAEGHKLYLVFEFLDLDLKKYMDSLPVSDGGRGKALPEGTGTRLHTLGLGDDIIKKFMSQLCAGIRYCHSHRILHRDLKPQNLLINKEGNLKLADFGLARAFGVPLRTYTHEVVTLWYRAPEILLGGHQYSTGVDMWSVGCIFAEMAMRKPLFPGDSEIDEIFKIFRLLGTPTEDVWPGVTTYPDFKASFPRWVQDTETPICPTLDPMGQELLELMLVYDPASRLSAKQACNHPYFDDLEKALPGTAAAAARQHTTTAAAGGAYNGSGYH

SEQ ID NO: 33138 - protein, 1798 aa, Streptomyces coelicolor A3(2)
MPATRRTARVRRVAAVTVTALAAALLPPLAARADTPPAPPSDAKLAKTAARHDLTREQFYFVLPDRFANGDAGNDRGGLTGTRLTTGYDPTDKGFYQGGDLKGLTERLDYIKGLGTTSIWMAPIFKNQPVQGTGKDASAGYHGYWITDFTQVDPHFGTNKDLKNLISKAHAKGMKVFFDVITNHTADVVDYEEKSYDYLSKGAFPYLTKDGQPFDDADYADGERRFPRVDSGSFPRTPTVPAAKKNLKVPSWLNDPAMYHNRGDSTWAGESATYGDFNGLDDLWTERPEVVGGMEKIYQRWVEDFAIDGFRIDTVKHVDMEFWTQWATALDAYAAKKGRDDFFMFGEVYSADTSVTAPYVTQGRLDSTLDFPFQDAARAYASQGGSARKLAAVFGDDYKYTTDKANAYEQVTFLGNHDMGRIGTFLKQDAPEAGDAELLKKDRLANELMFLSRGNPVIYYGDEQGFTGAGGDKDARQPMFASRTADYLDDDQLGTDRTHAEAAYDTSAPLYRQISALAELRKANPALADGVQTERYAADGAGIYAFSRTDAKTGTEYVVAFNNAGTEKSAAFATGSAGMTFRGLYGTDATVKSGADSKVTVTVPARSAVVLKAAGRLAAPAAEPTISLHAPDPGATGTVELSADVAGGQLNRVVFAAQTGDGKWRTLGTADHAPYKVTHTVDADTPAGTALRYKAVVVDSAGRTASATAASTTGTPPAEEVPTAASRDYAVVHYKRADGNYDDWGLYAWGDLADGEATTWPGTHPFTGRDAYGAFAYVKLKPGASTVGFLVIDKDGNKDVAADRTIDVTETGEVWIEQGEEQLVTERPEYPAQDTTKAVLHYKRADGNYDGWGLHVWGDAANPTDWAKPLQPVRTDPYGAVFEVPLTDGASSLSYIVHKGDEKDLPTDQALDLKADGHEVWLLSGQEDHLLPQPAGSAAAVDLTTSKAVWIDRNTVAWNGSDGAASTQLLASRTGSITAEGGRLTGDDQQWLRLTKSALTDAQKAKFPHLKESTAWSVDPRDRDRVREALRGQVVAAQRTATGALLAATGVQTAGALDDLYADRATRADLGPVFRHGRPTLSVWAPTAQDVKLEIGDRTVRMRRDDATGVWSVTGPKSWKGKAYRYAVKVWAPTAGEVVTNKVTDPYSLALTTDSERSLVVDLDDRSLAPRGWEHYRKPEAVPLQDAQIQELHIRDFSVADRTADADHRGTYLAFTDKKSDGSRHLRELAEAGTSYVHLLPAFDIATIPERKSEQTTPDCDLAALPAGSEKQQECVTKAAAKDAFNWGYDPYHYTVPEGSYATDPDGTERTVEFRKMVKALNEDGLRVVMDVVYNHTAASGQAKTSVLDRIVPGYYQRLLADGSVANSTCCSNTATENAMMGKLVVDSVVTWAKEYKVDGFRFDLMGHHPKANILAVRKALDELTLRKDGVDGKKIVLYGEGWNFGEVADDARFVQATQKNMAGTGIATFSDRARDAVRGGGPFDEDPGVQGFASGLYTDPNSSTANGTEAEQKARLLHYQDLIKVGLTGNLADYSFTDTHGKEVKGSEVDYNGAPAGYAAAPGDALAYADAHDNESLFDALTFKLPKDTSADDRARMQVLAMATATLSQGPALSQAGTDLLRSKSLDRNSYDSGDWFNALHWNCADGNGFGRGLPPAADNQDKWPYAKPLLGAVEVGCPQITGASAAYRDLLRIRSGEQDFSLATAARVQSRLSFPLSGEDETPGVITMRLGDLVVVFNATPERQEQRVGAAAGTGYRLHPVQAAGADAVVKESAYAAKTGTFTVPARTVAVFQRAG

SEQ ID NO: 33139 - protein, 437 aa, Streptomyces coelicolor A3(2)
MPSETSGADLGRHLIRYSGHAPFSPEVVVRAAGTSVFTESGRELLDFTSGQMSAILGHSHPAIVSTVREQVAHLDHLHSGMLSRPVVELARRLAGTLPAPLEKALLLTTGAEANEAAVRMAKLVTGRHEIVSFARSWHGMTQAAANATYSAGRKGYGPAAPGNFALPVPDRYRPSVVGADGELDWRRQLDLGFEMIDAQSVGSLAACLVEPILSSGGVVELPPGYLAALADKCRERGMLLILDEAQTGLCRTGDWYAFEHEGVVPDILTLSKTLGAGLPLAAVLTSAEIEQRAHERGFLFFTTHVNDPLPAAVGNTVLDVLVRDRLDERARRLGAALREGLDKLAARHEVVGDVRGRGLLLGMELVGDQVLGEGGADRLGAAVTRRCFELGLHMNIVQLPGMGGIFRIAPPLTASDDEIARGVAVLDQALTDAADAL

SEQ ID NO: 33140 - protein, 353 aa, Neurospora crassa
MPQFEIPEQQWAQVVEKKGGPVVFKQIPVQKPGPDEVLINVKYSGVCHTDLHAMKGDWPLATKMPLVGGHEGAGVVVAKGELVTEVEVGDHAGIKWLNGSCLACSFCMQADEPLCPHALLSGYTVDGSFQQYAIAKAAHVAKIPKGCDLETTAPVLCAGITVYKGLKESGVRPGQCVAIVGAGGGLGSMAIQYANAMGLHAIAIDGGEEKGKNCRELGAQAYVDFTTTKDLVADVKAATPDGLGPHAVILLAVSEKPFHQAVDYVRSRGTIICIGLPAGAKFQAPVFDTVIRMITIKGSYVGNRQDTQEALDFFARGLIKVPIKTVGLSKLQEVYDLMEEGKIVGRYVVDTSK

SEQ ID NO: 33141 - protein, 399 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 33142 - protein, 464 aa, Arabidopsis thaliana
MVDSKRMDSGSKDMINDLPDALLCHVLSYLTTKEAASTSLLSRRWRYLLAFVPNLEFDDSAYLHRDKRVKNPLHEKGLVGFVLTVDDKRKKLSTSFPDFVDRILDLQGNSPLDKFSLKMVDDHDPVDPDCVAPWIHKVLVRGVSDLHLVIDMNEWTSLPAKIFLTETLVKLTLKIRDGPPIDVKHVHLPKLKTLHLESVMFDEEDIGFSKLLSGCPELEELVLHHIWSCVWTSCSVSVATLKRLTFCCNNMKFCGMHEENPNNVSFDTPNLVYLEYAEVIANNYPKVNFDSLVEAKIDIWMTNDQLDEVRIRDIYEKNVMVGNATDLIVGIRNVRVLCLSADTLEVLTYCCKQIPIFNNLTHVTIQSTPKVGWKSLLKLLKNSPKLQTLVFQGLLHRDTKEEGVAIIKIEKQIEKVKHFLETMPHLEQLVLHYDSSIDGDMKQLLMLSSLASPKCKVQLIPLVT

SEQ ID NO: 33143 - protein, 473 aa, Arabidopsis thaliana
MDSVSKDMINVLPDALLCHILSFLTTKEAASTSLLSRRWRYLLAFVPNLEFDDSVYLHRDKRVKNTLHEKGFVGFVLLVNNKRKKLSTSFPDFVDRILALQGNSPLDKFSLKMVDGHDPVDPDSVVPWIHKVLVRGVSDLHLVVDMNEWTSDPLPSRIFLSETLVKLTIKIRDGPFIDVKHVHLPKLKTLYLQSVMFDENDIGFRKLLSGCPVLEELVLDGMGSCVWTSFTVSVATLKRLTFCCQKMSSFGYMHDDENPNNVSFDTPNLVYLEYAQVIANNYPKVNFDLLVEAKIDIWMTVDQIREVRLRKNEVNCMVGNATDFIVGLRNVRVLYLSPETLEVLTYCCKQIPIFENLSHLTIKSDPNVGWKPLTKLLKNSPKLETLVFQGLLHRDNKEDVAISSSSVKVLKIFLSGDKLKKQIEKVKHFLKTMPRLEQLVFYYDVKVLSQLHMLSRLASPKCKIHLIPSRESV

SEQ ID NO: 33144 - protein, 491 aa, Arabidopsis thaliana
MDDCSKDIINCLPDNLLCQILSNLSTKEAALTSLLSKRWRYLFALVPNLDFDVLPSLHPEVAMQDQDQTSFIDFVDRVLKLRGKDHINKFSLKCGDGIEDEDVFPWILNTLRHGVSDLSLHVSPSLVYWLPSKVFASKTLVRLKIGPKDGPRVKLRNVCLPKLKTLNLDSVVFEEGKIGFAKLLSGCPVLEELSLLNLAWDRWDSCSVSSKILKRLTLYCAHSSRNPKSVSFDTPNVVYFEYSDNIANKYPKVNFDSLVEASIGIRMTKVQKANARYVSDVDEETEMVGNATDLLMGICNVKTLYLSYDTLETLNLCCQVIPVFNNLTHLTIESHPELGWESLPNLLKSCPNLGTLVFQGLLHKATDRCGDVCMCQGLENSHSCLSSSPVKCLKILKFGETNDDDDMEIEMEQIKNFLEKMPNLEQLIIYYESSIDNDLVRVSSQLQEVPTVASLKCKIQNLTGFVELVMRSCLDYHLEAIYGCAHGYKYL

SEQ ID NO: 33145 - protein, 491 aa, Arabidopsis thaliana
MNSKKLNIGPKDIINSLPEALIYHILSFLSTKEAAITSLLSRKWRYFFAFVPNLDFDDPVRMQPDMGNQEETEIHTSFMDFVDRVLALRGNSHVNKFSLKCGNGVDGVGVTRWILNTLELSVSELDLSIASDTTYLFPSKVFVSKSLVRLRIEARNGLAFGSLVIDVGDVSLPKLKTLYLDSVELDYQIICLAKLLSGCHVLEELVMIDVVWNFWESCSASIPTLKRLTFFTEEGWNNPPPSVTFDNPALVYFEYTDTVALKYEKVNFDSLVEARLGLRVGYEESENPIQVPFGFPFPLIEYAMVGDATDLLMGIRNVQVLYLYASTVEVLTFRCKAIPIFNNLTRLTIESNTKVGWDSLPNLLKNCPNLKTLVFQGLLHKATDRCGDMCPCKPPENIHTCLSSSPVKVLEILKFGEINDKTELEQTKHFLELMPHLEQLNIYYDTSVDDNLVKVSKQLQEIPGVASAKCKVQVISDNLTLSVTLPSSSSI

SEQ ID NO: 33146 - protein, 504 aa, Arabidopsis thaliana
MDDICCKDIISDLPEALICHLLSFVPTKEAALTSLLSEKWRYLFAFAPILDFDDSVWMQSPLVYMNEVHRKFMDFVDRVLGLQGNSTLVRFSLNCRNGIDRECIFRWISNVIERGVSDLDLGGNFVSNRSMPSSVFVSKSLVKLRIRTENCTIIDLEDVFLPKLKTLDLSSIWFRDGDTCLLKLISGCQVLEDLTMSDLWWDGYWNRSMSSKTLKRLTVHCSDWDRSPGSISFDTPNLVYFEYFDLVADKYEVVNFDSLVEASIGLRMRHHQRAHASYGDLVVNATNLFMGISNVRILQLFSNALEVLTFCCAPIPVFKKLIHLTVETDKDVGWESLPALLKNCPNLETLVFKGLHHRSTSKCQDTDGCLCKSSKDIRSCLSSSPVKVLKILKFGEVASYFGDEEKQLELVKYFLETMPNLEQMILHYNTRISEGVKSQLDWLVPRVSSSKCSVQLICDNAPTYPFYGGIICDNFITPAPTYPFFGDPLHGMVIPYMGDQPHFI

SEQ ID NO: 33147 - protein, 425 aa, Arabidopsis thaliana
MDIGPKDKISNLPEALICHILSFLPIEDSALTSVLSKRWRYLFAFRPNLVFDDSVCLRPPCGHGVIPDYVTSWILNVLERGVLDLDLQVNVNGVRLPSKVFVSKSLVRLRIESGNVRGIDVDDVFLPKLKSLYLHTIMLGKGEDCFEKLTSGCHVLEELVLNNVYSNVWNRSVSSKTLKRLTLWCTESYDKNPHSVLFDTPNLVYLKYSDYVAAKYPKVNFSSLVDATIGLAMTSDQDANASYDALVGNATDFLMGICNVQILCLSANSLAVLTFCCESIPVFNNLIQLTIKTNQSVGWESLPALLKNCPILETLVFEGLLHMYTIKCGDVDGCLCKYSGEVPSCLSSSPVKVLKILRFGEYGIVNQIEMIKIFLETMPHLEQLTVYYNTPIGGDLIEEVSSQLKNFAREASPNCEIQVIPDVLS

SEQ ID NO: 33148 - protein, 339 aa, Arabidopsis thaliana
MGFDLKEIRTKKTLIGLGLGQLLSLLATSNGFTSSELARKGINVPTSQCFLNYVLLAIVYGSIMLYRRSDIKAKWYYYFLLAFVDVEANFLVVKAYQYTSLTSVMLLDCWAIPCVLVLTWFYLKTKYRLMKISGVFICIVGVFMVVFSDVHAGDRAGGSNPVKGDFLVLAGATLYAVSNTSEEFLVKNADTVELMTFLGFFGAIISAIQALTSLVHRSILERDELKAIHWSTGAVFPFLRFTLTMFLFYPLVPVLLKTNGATMFNLSLLTSDMWAVLIRTFGYHEKVDWLYFLAFATTATGLIIYSMKEKDQEEHRFEEVGDEAAMQRKLLGEDDEPGT

SEQ ID NO: 33149 - protein, 330 aa, Arabidopsis thaliana
MAMGFDFNEMNKTKKTLIGLGLGQILSLLCTSNAFTSSELARKGINAPTSQTFLSYTLLAVVYGGIMLYRRPTIKGKWYHYFLLALVDVEGNFLVVKANQYTSITSIMLLDCWAIPCVLVLTWMFLKTKYRLMKISGVFICIAGVVMVLFSDVHAGSRAGGSNPVKGDFLVLAGATLYAVSNTTEEFLVKNADTVELMTFMGLFGAIISAIQPYSNKFKVSTLSRFQVFPFLRFAITMFLFYSLLPILLRTNGSTMFTLSLLTSDMWAVLIRIFAYHEKVDWLYYLAFATTAIGLIIYSMKEKDEEEEREEQRKKLLDEEEGQSLPDTSL

SEQ ID NO: 33150 - protein, 446 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIAELAVGLATGQIKTGAPCRSERLAKYNQLLRIEEELGAAAVYAGAKFRAPVEPY

SEQ ID NO: 33151 - protein, 384 aa, Leptosphaeria maculans
MVALTLGFVATALVASSVAAPAPEIDGAHNAPVTAKRADSCTFTGANGAAEASKASKSCTTMVLDNLAVPAGTTLDLSSLADGTTVIFQGTTTWGYKEWAGPLLSIGGNKITVKGASGSLLNPDGARWWDGKGGNGGKDKPKFFAAHSLTDSTITDVNIKNTPVQAVSIASCDGLTITGMTIDDSEGDANELGHNTDAFDIGTSKNIMIDGAKVHNQDDCVAVNSGTNITFQNGLCSGGHGLSIGSVGGRADNTVDTVTFNNNVVTKSTNGIRVKAKVGATGKINNVVYSKTTLSSISKYGVLVEQNYDGGDLHGTPDTGIPITGLVLSDVKGEGAVAANGFNVVVTCGSETSCTGWKWDNVVITGGSKVYGNCTNVPSVTKCS

SEQ ID NO: 33152 - protein, 467 aa, Sterigmapetalum guianense subsp. ichunense
SVGFKAGVKDYKLTYYTPDYETKDTDILAAFRVTPQPGVPPEEAGAAVAAESSTGTWTTVWTDGLTSLDRYKGRCYHIEAVVGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPVVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTLD

SEQ ID NO: 33153 - protein, 466 aa, Carallia brachiata
SVGFKAGVKDYKLTYYTPDYETKDTDILAAFRVTPQPGVPPEEAGAAVAAESSTGTWTAVWTDGLTSLDRYKGRCYHIEAVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33154 - protein, 466 aa, Crossostylis biflora
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFIFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33155 - protein, 466 aa, Pellacalyx saccardians
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33156 - protein, 466 aa, Kandelia candel
SVGFKAGVKDYKLTYYTPDYETKDTDILSAFRVTPQPGVPAEEAGAAVAAESSTGTWTTVWTDGLTSLDRYKGRCYHIEAVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHAGTVVGKLEGEREITAGFVDLLRDDVIEKDRSRGIYFTQDWVSLPGVLPVASGGIHVWHMPALTEIFGDDSVLQFGGGTLGHPWGNAPGAVANRVALEACVQARNEGRDLAREGNEIIREARKWSPELAAACEVWKEIKFEFPAMDTL

SEQ ID NO: 33157 - protein, 466 aa, Rhizophora stylosa
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVCARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33158 - protein, 466 aa, Rhizophora mangle
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVCARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDYIEKDRSRGIYFTQNWVSLPGVLPVASGGIQVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33159 - protein, 466 aa, Rhizophora mangle
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTSYIKTFQGPPHGIQVERDKLNKYGRPLLGCTIKPKLGLSGKNYGRAVYECLRGGLDFTKDDENVNSQPFMRWRDRFLFCAEAIYKAQAETGEIKGHYLNATAGTCEEMMKRAVCARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33160 - protein, 466 aa, Rhizophora racemosa
SVGFKAGVKDYKLTYYTPDYETKDTDILAAFRVTPQPGVPPEEAGAAVAAESSTGTWTTVWTDGLTSLDRYKGRCYHIEAVAGEENQYIAYVAYPLDLFEEGSVTNMFTSIVGNVFGFKALRALRLEDLRIPTSYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYFNATAGTCEEMMKRAVCARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKENKFEFPAMDTL

SEQ ID NO: 33161 - protein, 473 aa, Combretocarpus rotundatus
  misc_feature (2)..(2): Xaa can be any naturally occurring amino acid
QXETKASVGFKAGVKDYKLTYYTPDYQTKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPIAYLKTFQGPPHGIQVERDKLNKYGRPLLGCTIKPKLGLSAKNYGRAVYECLRGGLDFTKDDENVNSQPFMRWRDRFLFCAEALFKAQVETGEIKGHYLNATAGTCEEMIKRAVFARELGVPIIMHDYLTGGFTANTSLAHYCRDNGLLLHIHRAMHAVIDRQKNHGMHFRVLAKALRMSGGDHVHSGTVVGKLEGEREITLGFVDLIRDDFIEKDRSRGIYFTQEWVSIPGVLPVASGGIHVWHMPALTEIFGDDSVLQFGGGTLGHPWGNAPGAVANRVALEACVQARNEGRDLAREGNEIIREAPKWSPELAAACEVWKEIKFEFAAVDTLE

SEQ ID NO: 33162 - protein, 473 aa, Hydrogenophilus thermoluteolus
MRHTKIVATLGPASSDPATLERLLLAGVDVVRLNFSHGTADEHRARASLVRALAQQTQRPVGILGDLQGPKIRIGRFTTNAVTLSKGQRFRLDCDLAPGDATRVGLDYPELIDDVEVGDILLLDDGKIRLQIVEKCADALITQVLVGGTLSNHKGINKLGGGLSAPALTAKDRAVPISRSLPKSASITVAVSFVKHAEEMHEARHLARAAGSRARLIAKIERVEAIANLDAILEASDGVMVARGDLAVEVGDAAVPALQKRILRRAREMNRLSITATQMMESMVHSPVPTRAEVSDVANAVLDGTDAVMLSAETAAGQYPVEAVEAMARVCAEADASNDAHLDQELLGRRFHRVDEAIAVSAVWSGYHLGVKAIVALTQSGATALWMSRIASILPIYALTPDPVTFGHLTLFRQVTPVRFDLNPASDPAMLLTQIRTLLVSNGWAAPGETIAVTFGEPMGQPGGSNTLKIVTL

SEQ ID NO: 33163 - protein, 459 aa, Neisseria gonorrhoeae
MSQYDVVVIGAGPGGYVAAIRAAQLGFKTACVDAGVNKAGNAPALGGTCLNVGCIPSKALLQSSEHFHAAQHDFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLRAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALELTKTGTALPRPGPKGTIP

SEQ ID NO: 33164 - protein, 285 aa, Arabidopsis thaliana
MSSSPDIAGILDNTKELDRLRKEQEEVLVEINKMHKKLQAKRIVIADSIYRFICYAPEIVEKPGDISLSKLKNLYIQAKELSESEVTVSNILLTQLDSLLPSGPTGQQRRKLEGNEQKRKRMKVDTDVTRVSPSMRNQIEAYASLKGEQVAARVTAEDAEKDEWFVVKVIHFDRETKEVEVLDEEPGDDEEGGGQRTYKLSMSCILPFPKRNDPSSTQEFIPGKHVLAVYPGTTALYKATVISTPRKRKSDEYLLEFDDDEEDGALPQRTVPFHKVVALPEGHRQ

SEQ ID NO: 33165 - protein, 168 aa, Arabidopsis thaliana
MDFGLQRDSEMNRLSFCIGFSQSKFGVVICRMKANAGALTNFELLDFLNSRGASKDTTRVIAPIARSEYKVYDYLVETAASTQTRESVNKSADKCKDFKLAKAEILNIINLWPSSIVELLPIIENLDDREIDTDGILELVKDLLPPLPTAESPKDNDEEEETENGEQS

SEQ ID NO: 33166 - protein, 171 aa, Actinidia chinensis
RKVRVSDITCGPGHGISIGSLGYGNSEAHVPDVVVNGAKLCGTTNGVRIKTWQGGSGSASNIKFQNVEMHNVENPIIIDQNYCDQDKPCQEQSSAVQVKNIFYKNIKGTCASNVAITFDCSKRFPCQGIVLEDVDLEIEGGAAAKALCNNVELSETGVVSPHCPEGEEEAS

SEQ ID NO: 33167 - protein, 171 aa, Actinidia chinensis
RKVRVSDITCGPGHGISIGSLGYGNSEAHVSDVVVNGAKLCGTTNGVRIKTWQGGSGSASNIKFQNVEMHNVENPIIIDQNYCDQDKPCQEQSSAVQVKNIFYKNIKGTCASNVAITFDCSKRFPCQGIVLEDVDLEIEGGAAAKALCNNVELSETGVVSPHCPEGEEEAS

SEQ ID NO: 33168 - protein, 164 aa, Actinidia chinensis
QKVRANDITCGPGHGISIGSLGSGKSEAYVSDVVVNGAKLFGTTNGVRIKTWQGGSGSASNITFQNLEMHNVANPIIIDQNYCDQNKPCPQQSSAVQVKNIVYQNIKGTSASDVAVTFDCSKRFPCQGIVLEGVDLEREGGAAAKALCNNVKLSETGVVSPHCP

SEQ ID NO: 33169 - protein, 113 aa, Actinidia chinensis
AKPSNGFVRGVLFQHATMVNVQNPIIIDQNYCPDNKNCPNQVSGVKISDVTYQDIHGSSATQVAIKFNCGKKYPCSKITLEDVNLTYNNQPAQSTCSNAGGSASGLVKPSSCL

SEQ ID NO: 33170 - protein, 113 aa, Actinidia chinensis
AKPSNGFVRGVLFQHATMVNVQNPIIIDQNYCPDNKNCPNQVSGVKISDVTYQDIHGSSATQVAVKFNCSKKYPCSKITLEDVNLTYNNQPAQSACSNAGGGASGLVKPSSCL

SEQ ID NO: 33171 - protein, 463 aa, Actinidia chinensis
MALQRHFFQFVIITLLIPSFILGYTSAVHEDPPHDYHLEEYGYDFKAYPSYITTIGDNDFGSSMSHENGIFGLRKVDYGMDRVLDASKTVNVDDFGAKGDGSDDTKAFEKAWKAVCSSTSSAVLLVPQKNYLVRPITFSGPCKSDLTMQIYGTLEASDDRSDYSKDGRHWLVFDSVQNLRVEGGGTINGNGQIWWQNSCKTNKTLPCKDAPTALTFYKSKHVIVKNLKIENAQQIHVSFDNCVNVQASNLMVTTPENSPNTDGIHVTGTQNIHISSCVIETGDDCISIVSGGQKVRVNDITCGPGHGISIGSLGYGNSEAHVSDVVVNGAKLCGTTNGVRIKTWQGGSGSASNIKFQNVEMHNVENPIIIDQNYCDQDKPCQEQSSAVQVKNIFYKNIKGTCASNVAITFDCSKRFPCQGIVLEDVDLEIEGGAAAKALCNNVELSETGVVSPHCPEGEEEAS

SEQ ID NO: 33172 - protein, 203 aa, Neurospora crassa
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMTDKKVVEYTVAKEFADSLGIPFLETSAKNASNVEQAFLTMARQIKERMGSSIATNNTKASVNVSPGHGVSNNSSGGCC

SEQ ID NO: 33173 - protein, 175 aa, Solanum tuberosum
MADVEYRCFVGGLAWATTDQTLSDAFSQYAEVVESKIINDRETGRSRGFGFVTFKDEQAMRDAIEGMNRQDLDGRNITVNEAQSRGGVEAGGGRGGGGYGGGRREGGGGGYGGYGGGRREGGGGGGYSGGGGGYGGGRREGGYGGGGGGYGGGDRYSDRSSRGGGGGSSDGNWRN

SEQ ID NO: 33174 - protein, 509 aa, Bacillus sp.
MSQWWKEAVVYQIYPRSFYDSNGDGFGDLQGVIQKLDYIKRLGADVIWLCPVFDSPQDDNGYDISDYRSIYEKFGTNDDMFQLIDEVHKRGMKIIMDLVVNHSSDEHAWFAESRKSKDNPYRDYYFWKDPKADGSEPNNWGAIFSGPAWSAMSTAQYYLHYFSKKQPDLNWENEAVRREVYDLMTFWMDRGVDGWRMDVIGSISKFVDFPDYETDDSRPYVVGRYHSNGPRLHEFIQEMNREVLSRYDCMTVGEAGGSDVEEAKKYTDPSRHELNMIFTFEHMDIDTKQHSPNGKWQMKPFDPIALKKTMTRWQTALMNVGWNTLYFENHDQPRVISAGAMTRELRKQSRQSISNSSARHEGNPFIYQGEEIGMTNSEMPLEMYDDLEIKNAYRELVIENKTMTEEDFRKAVAKKGRDHARTPMQWDDGKYAGFTDGEAWLAVNPRYQEINVKESLADEDSIFYYYQKLIGLRKQNKVIVYGDYRLLLEEDPRIFAYIREYRGEKLLVP

SEQ ID NO: 33175 - protein, 396 aa, Brucella melitensis biovar Abortus
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKPAVDALKDGDVLLLENTRFHKGEEKNDPEFVQALAANGDLYVNDAFSAAHRAHASTEGLANVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAVVGWHFAADTPHQTYGVDSVPGDAMILDAGELSTDLIASAIDDAATLVWNGPLGAFELSPFDTATVKVARHVAKRTKEGKLVSVGGGGDTVAALNHAGVADDFTYISTAGGAFLEWMEGKPLPGVDVLKK

SEQ ID NO: 33176 - protein, 279 aa, Vitis berlandieri x Vitis rupestris
MSKEVSEEGQSHGKDYVDPPPAPLIDIAEIKLWSFYRAVIAEFIATLLFLYITVATVIGYKKQSDPCGGVGLLGIAWAFGGMIFILVYCTAGIAGGHINPAVTFGLFLARKVSLIRALAYMVAQCLGAICGVGLVKAFMKSFYNSLGGGANSVAAGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 33177 - protein, 262 aa, Saccharomyces cerevisiae
MCGIFGYCNFLIEKTRGEIIDTLIEGLQALEYKEYDSSGISIQGDELESLNIYKQTGKISSLKEEIDLYNLNKNLPFISHCGIAHTRRATHGGLRRANCHPHNSDPSNEFVVVHNGVITNFANLKALLMAKGYVFKSDTDTECIPKLYKHIYDTSIELGYNLDFHVLTNLVLKELEGSYGLLCTSSHFPDEVVAARKGSPLVIGVKGKTDMDVNFVEVEYLDQEEDYLKLNTQTKSSGNVLAAAPVKYNTCLRKSPPFVHNT

SEQ ID NO: 33178 - protein, 135 aa, Phaseolus vulgaris
TSVANNGGRVQCIQVWPTVGKKKFETLSYLPPLTKQQLAKEVDYLLRKGWVPCLEFELEHGFVYREHNKSPGYYDGRYWTMWKLPMFGCTDSSQVLKELYEAQTAHPDGFIRIIGFDNVRQVQCISFIAYKPPGY

SEQ ID NO: 33179 - protein, 450 aa, Escherichia coli
MTKHYDYIAIGGGSGGIASINRAAMYGQKCALIEAKELGGTCVNVGCVPKKVMWHAAQIREAIHMYGPDYGFDTTINKFNWETLIASRTAYIDRIHTSYENVLGKNNVDVIKGFARFVDAKTLEVNGETITADHILIATGGRPSHPDIPGVEYGIDSDGFFALPALPERVAVVGAGYIGVELGGVINGLGAKTHLFEMFDAPLPSFDPMISETLVEVMNAEGPQLHTNAIPKAVVKNTDGSLTLELEDGRSETVDCLIWAIGREPANDNINLEAAGVKTNEKGYIVVDKYQNTNIEGIYAVGDNTGAVELTPVAVAAGRRLSERLFNNKPDEHLDYSNIPTVVFSHPPIGTVGLTEPQAREQYGDDQVKVYKSSFTAMYTAVTTHRQPCRMKLVCVGSEEKIVGIHGIGFGMDEMLQGFAVALKMGATKKDFDNTVAIHPTAAEEFVTMR

SEQ ID NO: 33180 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 33181 - protein, 128 aa, Lilium longiflorum
MISSANNKGAGTSRRKLRSEKAALQFSVSRVEYSLKKGRYCRRLGATAPVYLAAVLENLVAEVLEMAANVTEKHKRIVIKPRHIMLAVRNDVEVNKLFHGVTISASGVVPKTRKELDRRKRRSTSQAD

SEQ ID NO: 33182 - protein, 371 aa, Eriobotrya japonica
MGKGGMSDGDHADRCCGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNVLVVGAGPIGLVTLLAARAFGAPRIVIADVNDERLSIAKSLGADEVVKVSTNIEDLAEEVATIQKVLENGVDVSFDCAGFDKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 33183 - protein, 230 aa, Escherichia coli
RPVDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 33184 - protein, 289 aa, Lycopersicon esculentum
GTRVVGVVTEVGSKVEKFKVGDKVGVGCMVGSCRKCENCSVDLENYCPRQIPTYNGYSLDGTLTFGGYSDVMVSDEHFVVRWPENLSMDAAPLLCAGITTYSPLKYFGLDKPGMHIGVVGLGGLGHMAVKFAKAFGTKVTVISTSANKKKEAIERLGADSFLISRDPEQMKAAMNTLDGIIDTVSVVHPILPLLMLMKSHGKLVMVGAPEKPVELPVFPLLMGRKLVAGSCIGGMKETQEMLDFAAKHNITPDIEVVPMEYVNTALERLLKSDVKYRFVLDIGNTLNKK

SEQ ID NO: 33185 - protein, 1315 aa, Pseudomonas putida
MATTTLGVKLDDPTRERLKAAAQSIDRTPHWLIKQAIFNYLEKLEGGATLTELNGHASNPADDAGEVQADHSHQCFLEFAESILPQSVLRSAITAAYRRPEQEVVPMLLEQARLSAPLADATNKLAASIAEKLRNQKSVGGRAGIVQGLLQEFSLSSQERRGVCLAEALLRIPDKGTRDALIRDKISTGNWQPHLGNSPSLFVNAATWGLLLTGKLVSTHNETGLTSSLTRIIGKSGEPMIRKGVDMAMRLMGEQFVTGETIAEALANASRFEAKGFRYSYDMLGEAALTEHDAQKYLASYEQAIHSIGKASHGRGIYEGPGISIKLSALHPRYSRAQYERVMEELYPRLLSLTLLAKQYDIGLNIDAEEADRLELSLDLLERLCFEPSLAGWNGIGFVIQAYQKRCPYLINYFFDLAKRTPHRLIIRLLKGAYWDSEIKRAQVEGLEGYPVYTRKVYTDVSYVACARKLLAVPEAIYPQFATHNAHTLSAIYHIAGQNYYPGQYEFQCLHGMGEPLYEQVVGKIADGKLNRPCRVYAPVGTHETLLAYLVRRLLENGANTSFVNRIADHSISIQELVADRWPASIAWVPRKGSIGLPHPRIPLPRDLYGTERAKLAGIEMANEHRLGLLSCAMVATAHKQWEAAPLLACAARESAAAPVLNPADHRNVVGHVQEATVAKFDNAIHCALNPAPIWQATPPAERAAILERTADLMEAEIHPLMGLLIREAGKTFPNAIAELREAVDFLRYYAVQALNDFSNDAHRPLGPVVCISPWNFPLAIFTGQVAAALAAGNPVLAKPAEQTPLIAAQAVRLLLEAGIPEGVLQLLPGRGETVGAGLVGDERVKGVMFTGSTEVARLLQRNVAGRLDNQGRPIPLIAETGGQNAMIVDSSALTEQVVIDVVSSAFDSAGQRCSALRVLCLQEDSADRVIEMLKGAMAESRLGCPDRLAVDIGPVIDAEAKAGIEKHIQGMREKGRPVYQVAIADAAEIKRGTFVMPTLIELDSFDELKREIFGPVLHVVRYNRRNLDQLIEQINNSGYGLTLGVHTRIDETIAKVVETATPATCRHRNIVGAVVGVQPFGGEGLSGTGPKAGGPLYLYRLLSTRPADAIGRHFQQQDGEGTPDRTLHEQLVKPLHGLKAWAENNQLADLAALCSQFASQSQSGIARLLPGPTGERNSYTILPREHVLCLADNETDLLAQFAAVLAVGSSAVWVDGEPGKALRARLPRELQAKVKLVADWNKDEVAFDAVIHHGDSDQLRGVCQQVAKRAGAIVGVHGLSSGDHQIALERLVIERAVSVNTAAAGGNASLMTIG

SEQ ID NO: 33186 - protein, 194 aa, Magnaporthe grisea
MVVATIKCVVVGDGAVGKTCLLISYTTNKFPSEYVPTVFDNYAVTVMIGDEPYTLGLFDTAGQEDYDRLRPLSYPQTDVFLVCFSVTSPASFENVREKWFPEVHHHCPGVPCLIVGTQVDLRDDPSVREKLSKQKMQPVRREDGERMAKELGAVKYVECSALTQYKLKDVFDEAIVAALEPPTPKRKSKKCLIL

SEQ ID NO: 33187 - protein, 168 aa, Marchantia polymorpha
MPRSQKNDNFIDKTFTIVADILLRIIPTTQREKEAFTYYRDGVMSAQSEGEYAEALQNYYEAMRLEIDPYDRSYILYNIGLIHTSNGEHAKALEYYFQALERNPSLPQAFNNMAVICHYRGEQAIQQGDPEASETWFDQAAEYWKQAILLAPSNYIEAHNWLKMTGRF

SEQ ID NO: 33188 - protein, 167 aa, Marchantia polymorpha
MPRSQKNDNFIDKTFTIVADILLRIIPTTQREKEAFTYYRDGMSAQSEGEYAEALQNYYEAMRLEIDPYDRSYILYNIGLIHTSNGEHAKALEYYFQALERNPSLPQAFNNMAVICHYRGEQAIQQGDPEASETWFDQAAEYWKQAILLAPSNYIEAHNWLKMTGRF

SEQ ID NO: 33189 - protein, 102 aa, Rhizobium leguminosarum bv. trifolii
AGVATISGGNLERCRAQGKLVNLEMRLEQQPLNGMIGIGHTRWATHGAPTERNAHPHIVDGIAVVHNGIIENFAELKAELEATGADFETSTDSEVVAHLLAK

SEQ ID NO: 33190 - protein, 145 aa, Arabidopsis thaliana
MASKALVLLGLEAVLLVVSEVAAASSATVNSESKETVKPDQRGYGDNGGNYNNGGGYQGGGGNYQGGGGNYQGGGGNYQGGGGRYQGGGGRYQGGGGRYQGGGGRQGGGGSRGSYCRHGCCYRGYNGCSRCCSYAGEAVQTQPGH

SEQ ID NO: 33191 - protein, 508 aa, Arabidopsis thaliana
MGRSNEQDLLSTEIVNRGIEPSGPNAGSPTFSVRVRRRLPDFLQSVNLKYVKLGYHYLINHAVYLATIPVLVLVFSAEVGSLSREEIWKKLWDYDLATVIGFFGVFVLTACVYFMSRPRSVYLIDFACYKPSDEHKVTKEEFIELARKSGKFDEETLGFKKRILQASGIGDETYVPRSISSSENITTMKEGREEASTVIFGALDELFEKTRVKPKDVGVLVVNCSIFNPTPSLSAMVINHYKMRGNILSYNLGGMGCSAGIIAIDLARDMLQSNPNSYAVVVSTEMVGYNWYVGSDKSMVIPNCFFRMGCSAVMLSNRRRDFRHAKYRLEHIVRTHKAADDRSFRSVYQEEDEQGFKGLKISRDLMEVGGEALKTNITTLGPLVLPFSEQLLFFAALLRRTFSPAAKTSTTTSFSTSATAKTNGIKSSSSDLSKPYIPDYKLAFEHFCFHAASKVVLEELQKNLGLSEENMEASRMTLHRFGNTSSSGIWYELAYMEAKESVRRGDRV

SEQ ID NO: 33192 - protein, 180 aa, Daucus carota
MAERGTYAHQVQVHPQQTANQPGGVKSLLPKNSPSTSQVLAVVTLLPVGGTLLFLAGITLVGTLIGLAVATPLFLLFSPVLVPAALTIGLAVTGFLGSGAFGLTGLSSLSWVLSYFRQASQRVPDQIELAKKRAQEMAAYAGQKTKEVGDTIQSKAAQAQDTTATTGRDTRSTARDTSRT

SEQ ID NO: 33193 - protein, 1245 aa, Neurospora crassa
MKFGRNLPRNQVPEWAAFYINYKGLKKLIKAAQGAAKNGEPVDLAEFFFALDRNLEDVDSFYNKKYAEAYRRLKVLQDRYGKTPEIVSNLDDDEVEELMGALLELRSQFRKLQWFGEINRRGFVKITKKLDKKVPNTKSTQHNYISTKVDLLPFAKDTAISLLLTEINKWLSKLGDAQNIDETKSERSTLSLGRASAKAMLNIPSALFDKLDQAIRKDEVAALEKGLKEGNLASSEGSSPLQQPLLLNLLQRSISSRSRDCIVFLLKQVNSLDEPDDINERNCIHRLVIHIGRTKTASLLSSEPEAESYPFPRTGVHYAQPYLTPATSPLSAPRGTTLKESKLLGHDDEAIQLLKYLLENLRPDQRVALVAKDGFGRIPLHYAAQFGFVVVCQIIMRKMQDWGQFNVENGIDAPEWQDKDGNAPLHLSVIGGHPLTTKALLQGENWKGVNDHQAEMRRAISKSSAVLALATKANSKDIVELLVNAGVDINWQDNSGETALHVAARFGHDECARVLLKGTEQQKANLELAEKNFAWTPLHIAAVDGHLGVAQLLVDAGADVDKLDSSGWTAKEHAALRGHLDIARLLSAHSQAPEDEGGSSSDGDDEKSSTTTPYPETDNNTLSASLGDRRSNATSRPAEPVKTFGHRYLKDESLVLVSLGSMDMRKGIEAIKLDKVPLAEAHTTQLDTALSVVVSAQGAKGDPTMIDLPVHENISTEPILFTTRDAAKVRLFFDIVPTYSGNEKNKVGRGVALLSSVRPTVGTKRMNLQGDISVPIMGSNFEVIGTVNFNFLVITPFSHPKMEVTSQQTYWKKLDSTMVIGHRGLGKNVVANKSLQLGENTIPSFIAAANLGAQYVEFDVQLTKDHVPVIYHDFLVSETGFDAPVHTLTLEQFLHINPDSSRSGTHHHHHHHHHGHHGHHGQPGQQAQHRQLKKFRSNSPGPRQRSMSMDFPGDGKDLMEERMKHTRDFKEKGYKGNSRGNFIQAPFATLEDLFRKLPESVGFNVEMKYPMLHETEEHEMDTYAVELNSFCDTVLQKVYDMAGQRHIIFSSFNPDICLCLSFKQPNIPILFLTDAGTCPVGDVRASSLQEAIRFASRWNLLGIVSNAEPLINSPRLVRVVKQSGLVCVSYGSQNNDPSLVQKQVKEGIDAVIVDSVLAIRKGLTRDQGNVNGSGGSNAKELQQRVREVEEAINKEERIEEEGSSAEGSSYGDSNGNGNGTEIRMTTNAGGDPKTEIKETMRALRT

SEQ ID NO: 33194 - protein, 2116 aa, Neurospora crassa
MGAIEDFDDRQVHLETEKEQYHPYEYQTENNSSWAGALPVKQGLYDPELEKDACGVGFACHIKGKPSHKIVSDARNLLCNMTHRGAVGSDARDGDGAGVMTSIPHKFFVKNFARDVGVTLPPLGQYAVGNLFFKPDPETLQESKRQLEEIAESLGLRVLGWREPPVDSTLLGPAALSREPSILQPFVVLASAYGPGNEPETTDPEKFDERLFERQLYVLRKRATHTIGLQNWFYICSLSNKNIVYKGQLAPIQVYQYYNDLVNYDYEAHFALVHSRFSTNTFPSWDRAQPLRWAAHNGEINTLRGNKNWMRAREGVMQSDVFGDELELLYPIVEAGGSDSAAFDNVLELLTINGVLSLPEAVMLMVPEAWQGNQSMDPKKAAFYEWAACQMEPWDGPALFTFADGRFCGANLDRNGLRPCRYYVMDDDRIICASEVGTIPVEPEKIIQKGRLQPGRMLLVDTRAGRIIDDSELKAAVSSREDFRSWLDNELITMPQVLETLSGSQSIELAAKPDNTKIQEDPLLHAFGYTFEQVSLLLGPMASDEKEALGSMGNDAPLACLSDAPKLLYEYFRQLFAQVTNPPIDPIRESIVMSLECYVGPQGNLLEMDSSQCGRLLLPSPILSIPEFNALKNMSTIHPEWTVKTIDLTFPKKEGIEGYIRHLDYICMEATAAIEASDRIIVLSDRNTSKDRVAVSALLAGGMVHHHLVSNKWRAMAAIVAETAEAREVHHMCVLLGYGVDAINPYLAMECIIKLNKEKLIKKKLTDDELIYNYKHSCDGGILKVMSKMGISTLASYKGAQIFEALGVDDSVVERCFKGTASRIKGITFELIAEDAFRLHERGFPSRYTVAVPGLPESGEYHWRDNGEAHVNDPTSIANIQDAVRTKNDKSYEAYSLSEYEQIKSCTLRGMLDFNFEDCSPIPIDQVEPWTEIVRRFCTGAMSYGSISLESHSTLAVAMNRLGGKSNTGEGGEDPERSQRLPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSETGVGIVASGVAKAKADHILISGHDGGTGASRWTGIKYAGLPWELGLAETHQTLVLNDLRGRVVVQTDGQLRTGRDVAIACLLGAEEWGFATTPLIAMGCIMMRKCHLNTCPVGIATQDPELRKKFTGTPEHVINFFYYVANELRAIMARLGFRTINEMVGHVEVLKVREDLRTKKTSNIDLSLILTPAHKLRPGVATFNVRKQDHKLYVRLDNKLITEAELTLDKGLPSRIECDIVNTDRAMGTSLSYQISKRYGEKGLPDDTVHVNIKGSAGQSFGAFLAPGVTLELEGDANDYVGKGLSGGRLIVYPPRSAVFKAEENIIVGNVCLYGATSGTCFFRGVAAERFAVRNSGATAVVEGVGDHGCEYMTGGRVVILGSTGRNFAAGMSGGIAYILDIQGDFLTKLNTEMVEASTLEEAEPEEIAFIRSLVEDHHHYTGSELAARILVDFSRALKRFIKVLPVDYKRVLEEEKAKAVKQAAETKRAEYSLPAAARKEKDPHAPKLQDIEESITDNAISKKKALVLDKTRGFMKYQRRAEKYRKPATRVKDWAELSQRLDEDELKYQSARCMDCGVPFCQSDSGCPISNIIPKWNELVFQGQWRDALNRLLMTNNFPEFTGRVCPAPCEGACVLGINEQPVGIKSIECAIIDRGFEMGWMVPEPPKIRTGKNVAIIGSGPAGLAAADQLNKAGHNVTVYERADRLGGLLMYGIPNMKLDKRIVKRRTDFMAAEGVQFKTGVAIGEDITLVDLKKQNDAVIIATGATVARDLPIKNRNLEGIHFAMEFLHKNTKSLLDSELADGSYISAKDKHVIVIGGGDTGNDCIGTSVRHGAKSVINFELLPKPPPARGRDNPWPQWPRVYRVDYGHDEVKQHTGKDPREYCIMSEEFVDDGNGKVRGINTIRVEWTKSASGGWDMKKIEGSQQFFPADLVLLSMGFLGPEARVLGDEIEKDPRKNVKTPPGKYSTNVEGVFAAGDCRRGQSLIVWGINEGRQAAREVDLYLEKSTCLPVTGGIVKRTAEEVFAAAAAA

SEQ ID NO: 33195 - protein, 343 aa, Streptomyces coelicolor A3(2)
MASAGGDMGIEVVVEGLTKSFGKQSIWRDVSLTLPAGEVSVMLGPSGTGKTVFLKSLIGLLKPEKGRVLINGVDMVNSPERDIYETRKLFGLMFQDGALFGSMSLFDNIAFPLREHTRKKESEIRRIVMERIEVVGLLGAEGKLPGEISGGMRKRAGLARALVLDPQIILCDEPDSGLDPVRTAYISQLLIDLNAQLDATMLIVTHNLDIAATVPDNMGMLFLRQLVTFGPREVLLTSDEPVVAQFLGGRREGPIGMSEEKDAATLAAEADAAPAAPAAPRVIVPQLEPSPGLPPRRAVARRRKRVMGMIDTLPPAARSAIRDTYARDSEAATLPMPAAGSGA

SEQ ID NO: 33196 - protein, 291 aa, Streptomyces coelicolor A3(2)
MELGLVGLGKMGGNMRERIRRAGHTVVGYDRNPDLADVHSLEELVGKLSAPRVVWVMVPAGEATQATVDRLGELLEPGDVVVDGGNSRWTDDEKHAEELAAKGIGFVDCGVSGGVWGLENGYALMYGGDAENVAKVQPVFDALKPEGDFGAVHAGKVGAGHFAKMVHNGIEYAMMQAYAEGWELLEKVDSVENVREVFRSWQEGTVIRSWLLDLAVNALDDDEHLDGLRGYAQDSGEGRWTVEAAIDNAVPLPAITASLFARFASRQDDSPQMKMIAALRNQFGGHAVEKK

SEQ ID NO: 33197 - protein, 307 aa, Pinus banksiana
ATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDEAPKEGCHHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFP

SEQ ID NO: 33198 - protein, 378 aa, Streptomyces coelicolor A3(2)
MRTTVGWQATGPTLRRAPLERRDLRPDDLAVRVDYCGVCHTDLHAVRAGAADGSGPRPLVPGHEFTGVVTETGTAVTRFRPGDPVAVGNIVDSCGTCAMCRIGQENFCHSFPTLTYGGTDRRDGSTTLGGYSREYVLGERFAYALPAALDPAAAAPLLCAGITVWEPLRALGAGPGTRVAVAGLGGLGHLAVKLAVALGADTSVISRSPDKAEDARRLGARELVVSTDPERLAAARERFDIVVDTVSAPHDLGAYLRLVALDGTLSHLGHLGPVTVETLDLLIGRKKLSSAGSGGRKGTAEMLAFCAEHGITADIELLPSARVNEALDRLDRGDVRHRFVLDLSDLDHSGLPDLGLSDPSDPDLRGPDRSGPQDPAAG

SEQ ID NO: 33199 - protein, 376 aa, Streptomyces coelicolor A3(2)
MTVTPAEAATRAAQLLARPATINGLTVPNRIAMAPMTRMFSPGGVPGEDVVSYYSRRAAAGVGLIVTEGTYVGHDSAGQSDRVPRFHGEEQLAGWAKVAEAVHAAGGTIVPQLWHIGMVRKAGEQPFPDAPAVGPSGLRIGEDEPTGRAMTQRDLDDVIGAFAESAAAAERIGFDGVEIHGAHGYLVDQFLWSGTNRRTDAYGGDPVARTRFAAEIVAAVRETVSADFPVIFRYSQWKQEAYDARLAETPEELEAILTPLASAGVDAFHASTRRYWLPEFEDSDLNLAGWTKKLTGKAAITVGSVGLDGDFNRAFQGEGAPVGSLDNLLDRLERDEFDLVAVGRALLHDPRWAQKVLDGRFDELAPYDAASLKTLS

SEQ ID NO: 33200 - protein, 485 aa, Streptomyces coelicolor A3(2)
MSTSASAKVPPSPESPEDRRPPQNGLDRYFKISERGSTLPREIRGGFATFFAMAYIIVLNPIILGSAKDMYGHQLDNGQLVTATALTAAFTTLLMGVIGNVPIALAAGLGVNSVVALQLAPRMSWPDAMGMVVLAGFVVMLLVATGLRERVMNAVPYSLRKAIAIGIGLFIMIIGLVDSGFITRMPDAAQTTVPIQLGTGGHLTGWPVLVFVLGVLLTLALIVRKTPGAILISIVVMTGVALIINAVADIPSWGLTTPEWPGNPVATPDFGLVGEVSLFGGFEKAGVLTGVLFVFTVLLSCFFDAMGTIMGISDEAKLTDGEGQMPGINKVLFVDGVAVAVGGASSASATTCFVESTAGVGEGARTGFANIVTGTLFALALFLTPVATMVPSQAATPALIAVGFLILAGSIKEIDWSDFTVAIPAFVTMLMMPFTYSITNGIGMGFITFSVLRLAAGRGREVPVAMHVVSAVFAFYYLMPALGLT

SEQ ID NO: 33201 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 33202 - protein, 170 aa, Oryza sativa
MPRSRINGNFIDKTFSIVANILLRIIPTTSGEKRAFTYYRDGMLAQSEGNYAEALQNYYEATRLESDPYDRSYILYNIGLIHTSNGEHTKALEYYFRALERNPFLPQAFNNMAVICHYRGEQAILQGDSEIAEAWFDQAAEYWKQAIGLTPGNYIEAQNWLKITKRFEFE

SEQ ID NO: 33203 - protein, 138 aa, Triticum aestivum
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVEVEEVKKEYPDAYVRIIGFDNMRQVQCVSFIAFKPPGCEESGKA

SEQ ID NO: 33204 - protein, 273 aa, Pyrus pyrifolia
GEIVFGGVDSSHFKGEHTYVPVTQKGYWQFDMGDVLIDGESSGFCANGCSAIADSGTSLLAGPTTVVTQINHAIGASGVVSQECKTVVEQYGKTIIEMLMAKSQPQKICSQIGFCTFDGTRGVSPGIESLVDQNPEKQSDGVHDATCAACEMPVVLMQIRLRKNQTEEQILDYVNQLCERLPSPSGESVVQCDSLSSLPSVSFTIGGKVFDLAPEQYVLKVGEGVAAQCISGFIALDVAPPRGPLWILGDIFMGRYHTVFDYGNLSVGFAEAA

SEQ ID NO: 33205 - protein, 101 aa, Pyrus pyrifolia
KIPGTGGGRRDDDPYSTNAQTGTGMTGTGYGTTDAPYTGGEYEERGMMDKVKDKMPGTGQRDETHSSQTTTTTPYGGTTGEHQEKKGAMDKIKEKLPGGRH

SEQ ID NO: 33206 - protein, 202 aa, Streptococcus mutans
DPVADGPVIELAGQRSLVKGTSLASIIARLQEKKTQVPLVIMTYFNPVFQYGVETFVADLQNTSVKGLIIPDLPHEQESFIKPYLENLDLALVPLVSLTTGLERQKELIEDAQGFVYAVAINGVTGKTGNYRDDLDKHLKHLTEIAQIPVLTGFGVSTLADIKRFNQVSDGVIVGSKIVKGLHEGMQEEIKDFIYAGSHYQK

SEQ ID NO: 33207 - protein, 388 aa, Avena sativa
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 33208 - protein, 163 aa, Lycopersicon pennellii
MYPTVGYNLGLMKQPYVPPHYVSAPGTTTARWSTGLCHCFDDPANCLVTSVCPCITFGQISEILNKGTTSCGSRGALYCLLGLTGLPSLYSCFYRSKMRGQYDLEEAPCVDCLVHVFCEPCALCQEYRELKNRGFDMGIGWQANMDRQSRGVTMPPYHAGMTR

SEQ ID NO: 33209 - protein, 438 aa, Rhodobacter capsulatus
MSAVKKALDLMKAEEVEYVDIRFCDPRGKLQHVTLIADLVDEDFFEEGFMFDGSSIAGWKSIDQSDMKLIPDASSVYIDPFYAEKTMCVHCNVVEPDTAEAYSRDPRIALKAEAYLKASGIGDVAYFGPEAEFFIFDDVRYSVTPAKVAYQIDAEAAAWNTDAEVEMGNLAHRAGHKGGYFPVNPVDEAQDLRGEMLSTMKRMGMKVDKHHHEVATCQHELGLIFGGLTEQADNILKYKYVIHNVAHAYGKTVTFMPKPMKGDNGSGMHVNMSIWKDGKPLFAGDKYADLSQEALYFIGGILKHAKALNALTNPGTNSYKRLIPGFEAPVLRAYSARNRSGCVRIPWTESPKAKRVEARFPDPSANPYLAFAALLMAGLDGIKNKIDPGPASDKDLYDLPPEELAAIPTVCGSLREALTELEKDHDFLLAGDVFTKDQ

SEQ ID NO: 33210 - protein, 216 aa, Cucurbita moschata
MDNKEREAREKLGGEVKLGHCLDVILKNADVALHYPSFVKLYDQLVAGILLNKGAIRYIFDKKSNSNWYFIFARALSIAWIEDKRYWKWGSCIKIAELIEVSWLDIRGKINESMLSPNIVYEVALQVQLNDRASGWDAPLNIELKKPDGSKIVRQECLLGKPRNQWFEIVVEFKVGNHGCGSSGEIEFAFYEHGGHWKRGLLVKGVRIGAKGCGCS

SEQ ID NO: 33211 - protein, 470 aa, Lactobacillus casei subsp. casei ATCC 393
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 33212 - protein, 433 aa, Lycopersicon esculentum
MAEKSFKYVIVGGGVSAGYAAREFAKQGVKPGELAIISKEAVAPYERPALSKAYLFPEGAARLPGFHVCVGSGGERQLPEWYAEKGISLILSTEIVKADLASKTLVSAAGESFKYQTLVIATGTTVLKLSDFGVQGADSKNIFYLREIDDADQLVEALKAKKNGKAVVVGGGYIGLELSAVLRLNNIEVNMVYPEPWCMPRLFTEGIAAFYEGYYKNKGVNIIKGTVAVGFDTHPNGEVKEVKLKDGRVLEADIVVVGVGARPLTTLFKGQVEEEKGGIKTDAFFKTSVPDVYAVGDVATFPLKMYNEIRRVEHVDHSRKSAEQAVKAIFASEQGKSVDEYDYLPYFYSRAFDLSWQFYGDNVGETVLFGDADPNSATHKFGQYWIKDGKIVGAFLESGSPEENKAIAKVAKVQPPATLDQLAQEGISFASKI

SEQ ID NO: 33213 - protein, 408 aa, Pseudomonas sp. B4
MIDTIAIIGAGLAGSTAARALRAQGYEGRIHLLGDESHQAYDRTTLSKTVLAGEQPEPPAILDSAWYASAHVDVQLGRRVSCLDLANRQIQFESGAPLAYDRLLLATGARARRMAIRGGDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRGPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 33214 - protein, 349 aa, Emericella nidulans
MCIPTMQWAQVAEKVGGPLVYKQIPVPKPGPDQILVKIRYSGVCHTDLHAMMGHWPIPVKMPLVGGHEGAGIVVAKGELVHEFEIGDQAGIKWLNGSCGECEFCRQSDDPLCARAQLSGYTVDGTFQQYALGKASHASKIPAGVPVDAAAPVLCAGITVYKGLKEAGVRPGQTVAIVGAGGGLGSLAQQYAKAMGIRVVAVDGGDEKRAMCESLGTETYVDFTKSKDLVADVRHGRGCLGAHAVILLAVSEKPFQQATEYVRSRGTIVAIGLPPDAYLKAPVINTVVRMITIKGSYVGNRQDGVEALDFFARGLIKAPFKTAPLKDLPKIYELMEQGRIAGRYVLEMPE

SEQ ID NO: 33215 - protein, 421 aa, Emericella nidulans
MSLTSKLSITDVDLKDKRVLIRVDFNVPLDKNDNTTITNPQRIVGALPTIKYAIDNGAKAVILMSHLGRPDGKKNPKYSLKPVVPKLKELLGRDVIFTEDCVGPEVEETVNKASGGQVILLENLRFHAEEEGSSKDADGNKVKADKDAVAQFRKGLTALGDITINDAFGTAHRAHSSMVGVDLPQKASGFLVKKELEYFAKALEEPQRPFLAILGGSKVSDKIQLIDNLLPKVNSLIITGGMAFTFKKTLENVKIGSSLFDEAGSKIVGNIIEKAKKHNVKVVLPVDYVTADKFAADAKTGYATDEQGIPDGYMGLDVGEKSVESYKQTIAESKTILWNGPPGVFEMEPFAKATKATLDAAVAAVQNGATVIIGGGDTATVAAKYGAEDKISHVSTGGGASLELLEGKELPGVAALSEKSK

SEQ ID NO: 33216 - protein, 154 aa, Pseudomonas aeruginosa
GTTAKPHVLIATSLGEIEVELDPAKAPISVKNFLEYVDSGYYDGTLFHRVIPGFMVQTGGFSAGMQEKKTRAPIKNEADNGLLNERGTLAMARTGVVDSATSQFFINLTDNDFLNHGARDFGYAVFGKVVRGMGVVDQIAKVPTTRRNGFASLP

SEQ ID NO: 33217 - protein, 471 aa, Solanum tuberosum
MACSLSLKQPFSSLPTNTTTQGKLPVNFPVTFGCMNGKGTLIEQKFQLNCSRDKEMDLTASALIDSAAAECMDEMGTMELPPQVEAREAKEPSVSTMLMNFSNDFDPYGALSTPLYQTSTFKQPSATENGQYDYTRSGNPTRDALEKLLAELEKADRAFCFTSGMAALAAVTRLVKAGEEIVAGDDIYGGSDRLLSQVVPKAGIVVKRVDTTNLDEVASVIKPWTKLIWLESPTNPRQQICDIRKIAKIAHAHGALVLVDNSIMSPVLSHPLELGADIVMHSATKFISGHSDLMAGVLAVRGESLAKEVYFLQNAEGAGLAPFDCWLCLRGIKTMALRVEKQQENAQKIAEFLSSHPRVKKVNYPGLLDHPGRSLHFSQATGAGSVLSFLTGSLALSKHVAEATKYFSITVSFGSVKSLISLPCFMSHASIPVEVREARGLTEDLVRISVGIEDVNDLIDDLDYALKTGPA

SEQ ID NO: 33218 - protein, 309 aa, Pinus banksiana
DGATDRTYCFSEVELISRKVAAGLAKLGLQQGQVVMLLLPNCIEFAFVFMGASVRGAIVTTANPFYKPGEIAKQAKAAGARIIITLAAYVEKLADLQSHDVLVITIDEAPKEGCHHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFP

SEQ ID NO: 33219 - protein, 369 aa, Pinus armandii
LHSYCFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITIDDAPKEGCKYISVLTEADETQCPVVKIHPDDVVALPYSSGTTGLPKGVMLTHKSLVSSVAQQVDGENPNLYFHSEDVILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 33220 - protein, 371 aa, Pinus armandii
LPLHSYCFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITVDDAPKEGCKHISVLTEADETQCPIVKIHPDDVVALPYSSGTTGLPKGVMLTHKSLVSSVAQQVDGENPNLYFHSEDVILCVLPLSHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 33221 - protein, 365 aa, Pinus armandii
CFERVAEFADRPCLIDGATDRTYSFAEVELISRKVAAGLAKLGLQQGQVVMLLLPNCIEFAFVFMGASVRGAIVTTANPFYKPWEIAKQAKAAGARIIVTQAAYVEKLADLQSHDVLVITIDDAPKEGCKHISVLTEADETQCPVVKIHPDDVVALPYSSGTTGLPKGVMLTHKSLVSSVAQQVDGENPNLYFHSEDAILCVLPLFHIYSLNSVLLCALRAGAATLIMQKFNLTTCLELMQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEI

SEQ ID NO: 33222 - protein, 373 aa, Picea smithiana
DHLSLHSYCFERVAEFADRPCLIDGATDKTYCFAEVELISRKVAAGLANLGLQQGQVVMLLLQNCIEFAFVFMGASVRGAIVTTANPFYKPAEIAKQAKAAGVRIIVTQSAYVDKLTDLQSDDLIVITIDGAPKEGCKHISVLTEADETQCPSVEIQPDDVVALPYSSGTTGLPKGVMLTHKGLVSSVAQQVDGENPNLYFHSEDVILCVLPLFHIYSLNSVLLCALRAGAATLIMQKFNLTTCLELIQRYKVTVAPIVPPIVLDITKSPNFSQYDVSSVRIIMSGAAPLGKELEDALRERFPKAIFGQGYGMTEAGPVLAMNLAFAKEAFPVKSGSCGTVVRNAQIKILDTETGQSLPHNQAGEICIRGPEI

SEQ ID NO: 33223 - protein, 371 aa, Cathaya argyrophylla
LSLHSYCFERVAEFADRPCLIDGATNKTYCFAEVELISRKVAAGLANLGLQQGQVVMLLLPNCVEFAFVFMGASVRGAIVTTANPFYKPGEIAKQAKAAGARIIVTQAVYVEKLAELRSDDVIVITIDDAPKEGCKHISVLTEADERQCPSVEIHPDDVVALPYSSGTTGLPKGVMLTHKSQVSSVAQQVDGENPNLYFHSEDVILCVLPLFHIYSLNSVLLCALRAGAATLIMQKFNLTTLLELVQRYKITVAPIVPPIVLEITKSPIVSQFDVSSVRMIICGSAPLGKELEDALRDRFPKAIFGQGYGMTEAGPVLAMNLAFAKKPFPVKAGSCGTVVRNAQIKILDTETGRSLPYNQAGEICIRGPEI

SEQ ID NO: 33224 - protein, 308 aa, Pseudotsuga menziesii
DGATDKTYNFAEVELISRKVAAGLAKLGLKKGQVVMLLLQNCIEFAFVFMGASILGAIVTTANPFYKPGEIAKQAKAADARIIVTQAAYADKLADLQRDDVTVVTMDGVPKEGCQHISVLTEADETQCPSVEIHPDDVVALPYSSGTTGLPKGVMLTHKSLVSSVAQQVDGENPNLYFHSEDVILCVLPLFHIYSLNPVLLCALRAGAATLIMQKFNLTMLLELIQRYKVTVAPIVPPIVLDITKNPIVSQYDVSSVRIIMSGAAPLGKELEDALRERFPKAIFGQGYGMTEAGPVLAMNLAFAKEPF

SEQ ID NO: 33225 - protein, 315 aa, Pseudotsuga menziesii
IDGATDKTYNFAEVELISRKVAAGLAKLGLKKGQVVMLLLQNCIEFAFVFMGASILGAIVTTANPFYKPGEIAKQAKAADARIIVTQAAYADKLADLQRDDVTVITMDGVPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQGYGMTEAGPVLAMNLAFAKEPFPVKSGS

SEQ ID NO: 33226 - protein, 311 aa, Pseudotsuga sinensis
IDGSTNKTYNFAEVELISRKVAAGLAKLGLKKGQVVMLLLQNCIEFAFVFMGASVLGAVVTTANPFYKPGEIAKQAKAADARIIVTQAAYVDKLADLQSEDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLDITKNPIVSQYDVSSVRIIMSGAAPLGKELEDALRERFPKAIFGQGYGMTEAGPVLAMNLAFAKEPFPV

SEQ ID NO: 33227 - protein, 309 aa, Pseudotsuga sinensis
GATDKTYNFAEAELISRKVAAGLAKLGLKKGQVVMLLLQNCIEFAFVFMGASILGAIVTTANPFYKPGEIAKQAKAADARIIVTQAAYADKLADLQSDDVIVITMDGAPKEGCQHISVLTEADETQCPSVEIHPDDVVALPYSSGTTGLPKGVMLTHKGLVSSVAQQVDGENPNLYFYSEDVILCVLPLFHIYSLNSVLLCALRAGAATLIMQKFNLTTLLELIQRYKVTVAPIVPPIVLDITKNPIVSQYDVSSVRMIISGAAPLGKKLEDALRDRFPKAIFGQGYGMTEAGPVLAMNLAFAKEPFPV

SEQ ID NO: 33228 - protein, 317 aa, Pseudotsuga sinensis
LIDGSTNKTYNFAEVELISRKVAAGLAKLGLKKGQVVMLLLQNCIEFAFVFMGASVLGAVVTTANPFYKPGEIAKQAKAADARIIVTQAAYVDKLADLQSEDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLDITKNPIVSQYDVSSVRIIMSGAAPLGKELEDALRERFPKAIFGQGYGMTEAGPVLAMNLAFAKEPFPVKSGSC

SEQ ID NO: 33229 - protein, 317 aa, Nothotsuga longibracteata
CLIDGATGKTYCFAEVELISRKVAAGLVNLGLQQGQVVMLLLQNCVEFAFVFMGAALRGAIVTTANPFYKPGEIAKQAKAAGARIIVTQAAYVDKLADLRSDNVIVITIDGAAKDGCQDISVLTEADETQCPSVEIQPDDVVALPYSSGTTGLPKGVMLTHKGLVSSVAQQVDGENPNLYFHSEDVIMCVLPLFHIYSLNSVLLCALRAGAATLIMQKFNMTSFLELIQKYKVTVAPIVPPVVLDITRSPAISQYDVSSVRIIMSGAAPLGKELEDALRDRFPQAIFGQGYGMTEAGPVLSMNLAFAKEPFPVKSGS

SEQ ID NO: 33230 - protein, 316 aa, Tsuga canadensis
LIDGATGKTYCFAEVELISRKVAAGLVNLGLQQGQVVMLLLQNCVEFAFVFMGAAPRGAIVTTANPFYKPGEIAKQAKAAGARIIVTQAAYVEKLADLQSDNVIVITIDGAPKDGCKDISVLTEADETQCPSVEIQPDDVVALPYSSGTTGLPKGVMLTHKGLVSSVAQQVDGENPNLYFHSEDVVMCVLPLFHIYSLNSVLLCALRAGAATLIMQKFNMTSFLELIQKYKVTVAPIVPPIVLEITRSPAISRYDVSSVRIIMSGAAPLGKELEDALRDRFPQAIFGQGYGMTEAGPVLSMNLAFAKEPFPVKSGS

SEQ ID NO: 33231 - protein, 318 aa, Tsuga canadensis
PCLIDGATGKTHCFAEVELISRKVAAGLVNLGLQQGQVVMLLLQNCVEFAFVFMGAALRGAIVTTANPFYKPGEIAKQAKAAGARIIVTQAAYVEKLADLQSDDVIVITIDGAPKDGCKDISVLTEADGTQCPSVEIQPDDVVALPYSSGTTGLPKGVMLTHKGLVSSVAQQVDGENPNLYFHSEDVVMCVLPLFHIYSLNSVLLCALRAGAATLIMQKFNMTSFLELIQRYKVTVAPIVPPVVLEITKSPIVSQYDISSVRIIVSGGAPLGKELEDAIRDRLPHAIFGQGYGMTEAGPVLAMNLAFAKEPFPVKSGS

SEQ ID NO: 33232 - protein, 307 aa, Cedrus atlantica
TGKNYSFAETELISRKVAAGLANLGLQQGRVVMLLLQNCIEFALVFMGASVRGAIVTTANPFYKPGEIAKQAKAADARIIVTQAAYVEKLADLQNDNVIVITVDDAPKEGCRHISVLTEADETKCPSVEIQPDDVVALPYSSGTTGLPKGVMLTHKGLVSSVAQQVDGENPNLYFHSEDVILCVLPLFHIYSLNSVLLCDLRVGAATLIMQKFNLTSFLELIQRYKVTVAPIVPPVVLDITKSPIVSQYDVSSVRIIMSGAAPLGKELEDALRDRFPQATFGQGYGMTEAGPVLAMNLAFAKEPFPV

SEQ ID NO: 33233 - protein, 325 aa, Pyrococcus horikoshii
MHPKIFALLAKFPRVELIPWETPIQYLPNISREIGADVYIKRDDLTGLGIGGNKIRKLEYLLGDALSKGADVVITVGAVHSNHAFVTGLAAKKLGLDAILVLRGKEELKGNYLLDKIMGIETRVYDAKDSFELMKYAEEIAEELKREGRKPYVIPPGGASPIGTLGYVRAVGEIATQSEVKFDSIVVAAGSGGTLAGLSLGLSILNEDIRPVGIAVGRFGEVMTSKLDNLIKEAAELLGVKVEVRPELYDYSFGEYGKITGEVAQIIRKVGTREGIILDPVYTGKAFYGLVDLARKGELGEKILFIHTGGISGTFHYGDKLLSLL

SEQ ID NO: 33234 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 33235 - protein, 435 aa, Sclerotinia sclerotiorum
MPSILQAFYALALLNLVLAAPHPAQKRSFKVERVANPNYVGRTPGAGTRALIKAYNKHSMTLPSSLVEALNSDTNPAFPEGNSKAATGSTTAVAAAASGSGTAGTTGLVVAMPETGDTEYLSQINIGGQTMTMDFDSGSSDLWSLVFKLANRFSIWSTKTLNPSKSKSFKMMQGANWSISYGDGSGAAGNVGTDTVNIGGATVTGQAIEMATAVSRSFVADTQSNGLVGLAFSKLNTVKPAQQKTFFDNAMSQGLAMPVFTADLRKASAGSYEFGNIDSSKFNGSLSWAAVNTTQGFWQFSSTKFTVGGGAATAVPNGQAIADTGTTLMLADPNIVNGYYSKVQGAVNDQSVGGVTFPCSAKLPDLAVDVWRNYMAVVRGDDINYAPVDNTGKTCFGGLQATTSNLQIYGDIMFKSQFVVFNGGNNTLGMAPHQG

SEQ ID NO: 33236 - protein, 382 aa, Schizosaccharomyces pombe
MNDRGELFKPIKVGNMLLQHRIVHAPMTRLRATDYGKITGLMVEYYSQRSMIPGTLLIADATFVGEKSGGFPNNPRCFTKEQAESWIPLVEAVHKNKSFLFIQFWPLPGDLKDEYRNDLEKMQKITYSDCPQDPGGLPAGIHSFDAVQGVEVYKKKYMSKRDIQEHIQDFVNAADLAVNIAKADGVEIHQVNGFLLDRFVLGGFGDQCDPEYRGSIENRCRFPLEVLEAVTRKIGQERVGYRISPFSGWMQKIDFMEVNIYLMSEIAKRFPKLAYIHAIEPRKYWSGHKLVSSEQNTSFLQKYWKGPFITAGGYDPETAVQAANERGVLVAFGRNFIANPDLVFRIKHHIPLNKWDRSSFYLPKTEKGYTDYPFSKEFLQSK

SEQ ID NO: 33237 - protein, 392 aa, Schizosaccharomyces pombe
MAVQKLYESQSKLFQPIKVGNMQLQHRMVHAPATRLRCLDNGLVMTDLVKEYYKQRSSIPGTLLITESLFSGAKSGGFSNIPCLYNDEHVEAWKPIVQAIHDNDCFVFIQFWNLPGELKVDYLEDQERLEKVTQGECPMDPTGLPAALGSAYSICGEELYVDKFMTKQDIQEHITTYTEAAKRAVFGCGADGVEVHQVNGFLLDKFVLNGYGDKCDPEYCGSLENRARFCLELLESVVNAIGQERVGYRISPFSDIWKDKDSFEAHVFMIKKIKERFPNLAYLHAIEPRQYWNGHVHITQEKNTLIYKNLWGDPFITAGGHDRDSAIQMAEQENTLVAFGRYFLSNPDLPFRLKYNLPLNKWDRATFYTKMSPKGYIDYPFSKEFLDTKKVE

SEQ ID NO: 33238 - protein, 461 aa, Streptomyces coelicolor A3(2)
MTVESVNPETRAPAAPGAPELREPPVAGGGVPLLGHGWRLARDPLAFMSQLRDHGDVVRIKLGPKTVYAVTNPELTGALALNPDYHIAGPLWESLEGLLGKEGVATANGPLHRRQRRTIQPAFRLDAIPAYGPIMEEEAHALTERWQPGKTVDATSESFRVAVRVAARCLLRGQYMDERAERLCVALATVFRGMYRRMVVPLGPLYRLPLPANRRFNDALADLHLLVDEIIAERRASGQKPDDLLTALLEAKDDNGDPIGEQEIHDQVVAILTPGSETIASTIMWLLQALADHPEHADRIRDEVEAVTGGRPVAFEDVRKLRHTGNVIVEAMRLRPAVWVLTRRAVAESELGGYRIPAGADIIYSPYAIQRDPKSYDDNLEFDPDRWLPERAANVPKYAMKPFSAGKRKCPSDHFSMAQLTLITAALATKYRFEQVAGSNDAVRVGITLRPHDLLVRPVAR

SEQ ID NO: 33239 - protein, 303 aa, Lycopersicon pimpinellifolium
MRSKDSKETTYISDTTSYRFPVESSQIPFAALQEATNNFNCNSLIGLGGFGTVYRGVLCDGTKVALKRCKLESSQGIEEFQTEIEMLSHFRHPYLVSLIGYCDENNVTILIFKYMENGSLSSHLYGSYLPTMTWEQRLEICIGAARGLYYLHKNAVIHRDVKSANILLDENFVAKTTDFGVSKTRTELDQTHVSTVVKGTLGYLDPEYVIRGKLTEKSDVYSFGVVLFKVLCARSAIVHYISKGLVTLAAWAMDSHKKGQLEQIVDPNLASKIRPKYLNKFGETAVKCLADSGVDRPSVGDVL

SEQ ID NO: 33240 - protein, 319 aa, Lycopersicon pimpinellifolium
MGSKYSKATNSISDASNSRYGVPFENYRVPLVDLEEATNNFDDNFFIAEGGFGKVYRGVLRDGTKVALKRHNCDSQQSIEEFRTEIEILSRRSHPHLVSLIGYCDGRNEMILIYDYMENGNLKSHLYGSDLPSMSWEQRLEICIGAARGLHYLHTNGVMHRDVKSSNILLDENFVPKITDFGLSKTRPQLYQTHVSTDVKGTFGYIDPEYFIKGRLTEKSDVYSFGVVLFEVLCARSAIVQSLPSEMVNLAEWAVESHNNGQLEQIIDPNLAAKIRPESLRKFGETAVKCLALSSEDRPSMGDVLWKLEYALRLQESVI

SEQ ID NO: 33241 - protein, 323 aa, Lycopersicon pimpinellifolium
MGTNYSKPTTSINDASNLSNRVPFESFRVPFVDLQEATNNFDDKFLIGVGIFGKDYRGVLRDGTKVALKRHKPESPQGIEEFRTEIEILSHCSHPHLVSLIGYCDERNEMILIYEYMENGNLSKRLYGSDLCLPTMSWEQRLEICIGAARGLHYLHNSAVIHCDVKSTNILLDENFVAKITDFGISKTTPEFDQTHLSTVVQGSIGYIDPEYFIRGQLTKKSDVYSFGVVLFEVLCARPAIGRSHMISLAEWAVETQKMGQLEQIVDPTIVAKIRPESLRMFGETAVNCLASSSENRPSMGDVLWKLEYALRLQEPIIQDNPE

SEQ ID NO: 33242 - protein, 318 aa, Lycopersicon pimpinellifolium
MGSKYSKATNSINDASNLSYGVPFENYRVPFVDLEEATNNFDDNFFIGEGGFGKVYRGVLRDGTKVALKKHKPESSQGIEEFETEIEILSFCSHPHLVSLIGFCDERNEMILIYDYMENGNLKSHLYGSDLPSMSWEQRLEICIGAARGLHYLHKNAVIHRDVKCTNILLDENFVPKITDFGISKTMPELDQTHLSTVVRGNIGYIAPEYALWGQLTEKSDVYSFGVVLFEVLCARPALDRSEIMSLDDETQKMGQLEQIVDPTIAAKIRPESLRMFGETAIKCLAPSSKNRPSMGDVLWKLEYALCLQEPTIQDDPE

SEQ ID NO: 33243 - protein, 303 aa, Lycopersicon esculentum
MRSKDSKETTYISDTTSYRFPVESSRIPFAALQEATNNFNCNSLIGLGGFGTVYRGVLCDGTKVALKRCKLESSQGIEEFQTEIEMLSHFRHPYLVSLIGYCDENNVTILIFKYMENGSLSSHLYGSYLLTMTWEQRLEICIGAARGLHYLHKNAVIHRDVKSANILLDENFVAKTTDFGVSKTRTELDQTHVSTVVKGTLGYLDPEYVIRGKLTEKSDAYSFGVVLFEVLCARSAIGHYISKGMVTLAAWAMDSHKKGQLEQIVDPNLAAKIRQEYLNKFGETTVKCLADSGVDRPSVGDVL

SEQ ID NO: 33244 - protein, 319 aa, Lycopersicon esculentum
MGSKYSKATNSISDASNSRYGVPFENYRVPLVDLEEATNNFDDNFFIAEGGFGKVYRGVLRDGTKVALKRHNCDSQQSIEEFRTEIDILSRRSHPHLVSLIGYCDERNEMILIYDYMENGNLKSHLYGSDLPSMSWEQRLEICIGAARVLHYLHTNGVMHRDVKSSNILLDENFVPKITDFGLSKTRPQLYQTHLSTVVQGTLGYLDPEYFIKGRLTEKSDVYSFGVVLFEVLCARSAIVQSLPREMVNLAEWAVESHNNGQLEQMVDPNLAAKIRPESLRKFGETAVKCLALSSEDRPSMGDVLWKLEYALRLQESVI

SEQ ID NO: 33245 - protein, 323 aa, Lycopersicon esculentum
MGTNYSKPTTSINDASNLSNRVPFESFRVPFVDLQEATNNFDDKFLIGVGIFGKVYRGVLRDGTKVALKRRKPESPQGIEEFRTEIEILSHCSHPHLVSLIGYCDERNEMILIYDYMENGNLSKRLYGSDLCLPTMSWEQRLEICIGAARGLHYLHNSAVIHRDVKSTNILLDENFVAKITDFGISKTTPEFDQTHLSTMVQGSIGYIDPEYFIRGQLTKKSDVYSFGVVLFEVLCARPAIGRSHMISLAEWAVETQKMGQLEQIVDPTIVAKIRPESLRMFGETAVKCLASSSENRPSMGDVLWKLEYALHLQEPIIQDNPE

SEQ ID NO: 33246 - protein, 311 aa, Lycopersicon esculentum
MGSKYSKATNSISDASNSFESYRFPLEDLEEATNNFDDKFFIGEGAFGKVYKGVLRDGTKVALKRQNRDSRQGIEEFGTEIGILSRRSHPHLVSLIGYCDERNEMVLIYDYMENGNLKSHLTGSDLPSMSWEQRLEICIGAARGLHYLHTNGVMHRDVKSSNILLDENFVPKITDFGLSKTRPQLYQTTDVKGTFGYIDPEYFIKGRLTEKSDVYSFGVVLFEVLCARSAMVQSLPREMVNLAEWAVESHNNGQLEQIVDPNLADKIRPESLRKFGETAVKCLALSSEDRPSMGDVLWKLEYALRLQESVI

SEQ ID NO: 33247 - protein, 320 aa, Lycopersicon esculentum
MGSKYSKATNSINDASNLSYGIPFENYRVPFVDLEEATNNFDDKFFIGEGGFGKVYRGVLRDGTKVALKKHKRESSQGIEEFETEIEILSFCSHPHLVSLIGFCDERNEMILIYDYMENGNLKSHLYGSDLPTMSMSWEQRLEICIGAARGLHYLHTNGVIHRDVKCTNILLDENFVPKITDFGISKTMPELDQTHLSTIVRGNIGYIAPEYALWGQLTEKSDVYSFGVVLFEVLCARPALYLSEMMSSDDETQKMGQLEQIVDPAIAAKIRPESLRMFGETAMKCLAPSSKNRPSMGDVLWKLEYALCLQEPTIQDDPE

SEQ ID NO: 33248 - protein, 205 aa, Arabidopsis thaliana
MALYRPLLLHHPTSPSVTTFLRNYPSKPIKFSSLPFLHRCRKSRVSSSSARCCSSMESPPEGYRRNIFTASRLDIPSAWQMPQGGIDEGEDPRVAVMRELKEETGVHSAEILAEAPHWITYDFPPDVREKLKVRWGSDWKGQAQKWFLLKFTGKDEEINLLGDGTEKPEFGEWSWTSPDQVVENAVEFKKPVYKEVMSAFASHLQ

SEQ ID NO: 33249 - protein, 270 aa, Prunus persica
CENWGFFELVNHGISHELMDTVEKLTKEHYKKCMEQRFKEMVASKGLEAVQSEIHDLDWESTFFLRHLPVSNISQIPDLDEDYRKVMKEFAVELEKLAEQLLDLLCENLGLEKGYLKKAFYGSKGPNFGTKVSNYPPCPKPDLIKGLRAHTDAGGIILLFQDDKVSGLQLLKDGQWIDVPPMHHSIVINLGDQIEVITNGKYKSVMHRVVAQPDGTRMSIASFYNPGDDAFICPATALLEKETENISAYPKFVFDDYMKLYSGLKFQAKE

SEQ ID NO: 33250 - protein, 434 aa, Aspergillus niger
MLPKDLQWGFAKAAYQIEGAVDQDGRGPSIWDTFCAQPGKIADGSSGVTACDSYNRTAEDIALLKSLGAKSYRFSISSRIPEGGRGDAVNQAGIDHYVKFVDDLLDAGITPFITLFHWDLLHQRYGGLLNRTEFPLDFENYARVMFRALPKVRNWNEPLCSAIPGYGSGSFAPGRQSTSEPWTVGHNILVAHGRAVKAYRDDFKPASGDGQIGIVLNGDFTYPWDAADPADKERLEFFTAWFADPIYLGDYPASMRKQLGDRLPTFTPEERALVHGSNDFYGMNHYTSNYIRHRSSPASADDTVGNVDVLFTNKQGNCIGPETQSPWLRPCAAGFRDFLVWTSKRYGSPPIYVTENGTSIKGESDLPNEKILEDDFRVKYYNEYIRAMVTAVELDGVNVRFGVTYVDYENGQKRFPKKSAKSLKPLFDELIAAA

SEQ ID NO: 33251 - protein, 328 aa, Capsicum annuum
MASQSFVPPIFENPFLNIEELAGDTIVRKPEPLTQANSDPNGTSLVVSKDVDLDINKKTWLRIYVPQRIITNHNDDEKLPVIFYYHGGGFVFFHANSFAWDLFCQGLAGNLGAMVISLEFRLAPENRLPAAYDDAMDGLYWIKSTQDEWVRKYSDLSNVYLFGSSCGGNIAYHAGLRVAAGAYKELEPVKIKGLILHQPYFSGKNRTESEEKLKDDQLLPLHAIDKMFDLSLPKGTLDHDHEYSNPFLNGGSKHLDDVIAQGWKILVTGVSGDPLVDNARNFANFMEEKGIKTFKLFGDGYHAIEGFEPSKAAALIGATKDFICATTN

SEQ ID NO: 33252 - protein, 257 aa, Allium cepa
GVFHIATPMDFESKDPENEMIKPTINGMLDILKSCVKAKVRRVVFTSSGGTVNVEATQKPVYDETCWSDLDFIRSVKMTGWMYFMSKILAEQAAWKYAAENNLDFISIIPPLVVGPFIMPSMPPSLITALSPITRTESHYTIIKQGQYVHLDDLCMSHIFLYENPKANGRYIASACAATIYDIAKMLREEYPEYNVPTKFKDYKEDMGQVQFSSKKLTDLGFEFKYGLKDMYTEAVETCRAKGLLPLSLEHHENGSA

SEQ ID NO: 33253 - protein, 200 aa, Streptomyces lividans
MRIVLVGPPGAGKGTQATRLAETLHIPHISTGDLFRANISQQTELGKLAKSYMDAGNLVPDEVTIAMDRTAWSSPTPRAFLLDGFPRNVSQAEALDELLETEDMKLDAVLDLEAPEDEVVKRIAGRRVCRNDSAHVFHVTYTPPKKEGVCDVCGGELYQRDDDSEETVRKRLEVYHTQTEPIIDYYKSQGLVATIAATGP

SEQ ID NO: 33254 - protein, 294 aa, Pinus contorta
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVSGLEPAGIDILSKMLCLEPSRRITARSALEHEYFKDLGFVP

SEQ ID NO: 33255 - protein, 499 aa, Arabidopsis thaliana
MGGQSSKIGTCCSHKTTALEAPDVENKENGEVNGVHSFREYSLEQLKIATSCFALENVVSEHGETAPNVVYQGKLENHMKIAIKRFSGTAWPDPRQFLEEARLVGQLRSKRMANLLGYCCEGGERLLVAEFMPNETLAKHLFHCKKKMPLINCLSIFFQDFLLRFAYHFYHLPGDTEPMKWAMRLRVALYISEALEYCSNNGHTLYHDLNAYRVLFDENSRDGKSYSTNLAFTPPEYLRTGEIDLHPPRSFGTLLLDLLTGKHIPPSHALDLIRDRNLQTLTDSCLEGQFSDSDGTELVRLTSCCLQYEARERPNIKSLVTALISLQKDTEVLSHVLMGLPQSGTFASPPSPFAEACSGKDLTSMVEILEKIGYKDDEDLSFMWTEQMQEAINSKKKGDIAFRRKDFSEAIEFYTQFLDLGMISATVLVRRSQSYLMSNMAKEALDDAMKAQGISPVWYVALYLQSAALSVLGMEKESQIALTEGSILEARKISASTQN

SEQ ID NO: 33256 - protein, 249 aa, Vitis berlandieri x Vitis rupestris
MPKIAFGRFDDSFSLASFKAYLAEFHSTILFVFAGVGSVMAYNKLTSDAALDPAGLVAVAVAHGFALFVAVAVSANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAFMYLGSDHQPLASSEF

SEQ ID NO: 33257 - protein, 444 aa, Arthrobacter sp. TM1
MDLLNEVRKAPMSRLQIRAVAVAIALMLIDGMDVAVAAYAAPALSKSWSLDPVTLGFLLSSGLFGMAAGSLFLTPFSDKIGRRRMMLVALVLVSAGMTLSVFAGDVVQLMAYRVLAGLGIGGMIANLNVFVSEYSSDKRRGSILGLYTSGFAIGATLGGFIAGPLIPQFGWRSVFAVGAAASILMLAVTWRFLPESLDYLISKRPRNALTQVNAILVQMHRPALSALPELPQDQQIGRGIKDLLTGRMAAQTVLLWVGYGLMISAYYFATTWTPKLIATSSGDDSLGVTMGLIVNFGGIIGCFIFSILAVFLRSRHLLLGSLLISALIYVAFGMTFTQTSLAIFIGAVLGLVTAANVAGFYATTPDLFPPAIRGTGIGWMIGIGRLVSFVSPIVVGYLLAGGWKAENIFMLFGLPMVVSALSMAVVWSLSTKTKPSTPLPTILS

SEQ ID NO: 33258 - protein, 408 aa, Vigna unguiculata
FGGGGGGGAGGGFGGGSGGGFGGGAGGGGGAGGGFGGGAGGGVGGGAGGGFGKGGGIGGGAGGGFGKGAGVGGGIGKGGGLGGGGGFGKGGGVGGGIGKGGGLGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGGGFGKGGGVGGGIGKGGGLGGGGGFGKGGGVGGGIGKGGGLGGGGGFGKGGGVGGGIGKGGGFGGGGGFGKGGGIGGGIGKGGGFGGGIGKGGGIGGGIGKGGGFGGGGGFGGGGGFGGGSGGGGGFGGGGGAGGGGGIGHP

SEQ ID NO: 33259 - protein, 398 aa, Pseudomonas putida
MRDSHNNTGFSTRAIHHGYDPLSHGGALVPPVYQTATYAFPTVEYGAACFAGEEAGHFYSRISNPTLALLEQRMASLEGGEAGLALASGMGAITSTLWTLLRPGDELIVGRTLYGCTFAFLHHGIGEFGVKIHHVDLNDAKALKAAINSKTRMIYFETPANPNMQLVDIAAVVEAVRGSDVLVVVDNTYCTPYLQRPLELGADLVVHSATKYLSGHGDITAGLVVGRKALVDRIRLEGLKDMTGAALSPHDAALLMRGIKTLALRMDRHCANALEVAQFLAGQPQVELIHYPGLPSFAQYELAQRQMRLPGGMIAFELKGGIEAGRGFMNALQLFARAVSLGDAESLAQHPASMTHSSYTPQERAHHGISEGLVRLSVGLEDVEDLLADIELALEACA

SEQ ID NO: 33260 - protein, 459 aa, Streptomyces coelicolor A3(2)
MSEYPGFPPGFVFGAATASYQIEGAATEDGRGPSIWDTYSRTPGLVVNGDTGDVACDHYHRYPEDVALLRDLGVDSYRFSIAWPRIVPDGSGAVNPKGLDFYSRLVDELLAAGIEPAATLYHWDLPQALEDRGGWRVRETAERFAEYTAVVAEHLSDRVPRWITLNEPWCSSFLGYSIGRHAPGAKEGRGALAAAHHLLVGHGLAVKALRAAGVREVGITLNLDRNLPATDSPADLAAVVRADTQHNLVWTEPILAGRYPATEEETWGELITGEDFRRDGDLELISQPLDFLGVNYYRPIVVADAPHRESDPARRVATDNRYEEVRHPGVRHTAMNWPVVPDSFTDLLVALKRQYGDALPPVHITENGSAEDDAAAADGTVHDTDRVAYLRDHLTALRAAIDAGVDVRGYYVWSLLDNFEWAYGYDKRFGIVRVDYDTQRRTPKDSYRWYREMIAANRG

SEQ ID NO: 33261 - protein, 213 aa, Arabidopsis thaliana
MTTVTTSFVSFSPALMIFQKKSRRSSPNFRNRSTSLPIVSATLSHIEEAATTTNLIRQTNSISESLRNISLADLDPGTAKLAIGILGPALSAFGFLFILRIVMSWYPKLPVDKFPYVLAYAPTEPILVQTRKVIPPLAGVDVTPVVWFGLVVAAAADAYEIVRFVAASTCAATKRTYAPAAMAAVEFATAAAACGDETNRLIIIESRFFKAIY

SEQ ID NO: 33262 - protein, 502 aa, Arabidopsis thaliana
MTVLWFVSLILLISILLVAVKHSKRRWVRQPPSPPGLPIIGNLHQLGELPHQSLCKLSKKYGPVMLLKLGRVPTVIVSTPETAKQVLKDYDLHCCSRPSLEGTRKLSYNYLDIAFSRFDDYWKELRKLCVEELFCNKRINSIQPIKEAEMEKLIDSIAESASQKTLVNLSDTFLSLNVNVICKAVFGVNFQGTVLNNDKFQDLVHEALEMLGSFSASDFFPYVGWIVDWFTGLHARRERSVRDLDAFYEQMIDLHLQKNREESEDDFVDLLLRLEKEEAVLGYGKLTRNHIKAILMNILLGGINTSAITMTWAMAELIRNPRVMKKVQSEIRAQIGKNNKTRIISLDEINHLSYLNMVIKETCRLHPVAPLLVPREVISEFKINGYTIQPKTRLHVNVWAIGRDPEIWKDPEEFLPERFMDCDIDVKGQDYELLPFGSGRRICPAVYMGITTVEFGLANLLYHFDWKLPEGVAVEDIYMDEASGLTSHKKHDLLLVPVKSLV

SEQ ID NO: 33263 - protein, 372 aa, Arabidopsis thaliana
MASNQQPPSNLQTYGVPIYAVDWILEEAVRSKITKDQDDDDDDGSSSSSYIVLSGGGGEGRSGIPNVILICRVDLHTNSLSEQPIGRRVIGTDLPYRMAIHPRQGGLICALPNSCRLFDWENIIEDDNEEESEKVVKELKDVGQQLSLSFNQDGTVLATGAEDGTLRVFEWPSMKTLLNESKTHASVKSLTFSESGKFLVSLGAPLCRVWDVNASAAIASLSKEKDEMFASCRFSVDNSGSEVLYVAANTQRGGSIITWDTTSWRRRSSKLIKRNNSISAFNVSADGKLLAVGTLEGDVLIIDSTKMQTNQIVKKAHLGLVTALTFSPDSRCLVSVSFDSRARLTVIKQKGEKRMYIYGFSYYLSISRTGSP

SEQ ID NO: 33264 - protein, 511 aa, Emericella nidulans
MLSPTLFSAYVLVGAIVAVLVNVIRQIFFRNTNEPPMVFHWVPFVGSTISYGMNPYNFFFSCREKYGDIYTFVMLGKKMTVYMGVKGNDFILNGKLKDLNAEEVYSPLTTPVFGSDVVYDCPNSKLMEQKKFIKFGLSQSALESHVPLIEKEVLDYIKTSPRFKGDSGVLDAPAAMAELTIYTAGSALQGKEVRKKLTAEFADLFHDLEMGFTPINFILPWAPLPQNRKRDIAHARMRETYMEIINQRRKNPDAQDHDMIWNLMHSTYKNGNPVPDKEIAHIMITLLMAGQHSSSSISAWILLRLASEPQILEELYQEQFANLKRDPRTGAFEPLQYKDLDLLPLHQNVIKETLRVHLSIHSILRKVKNPIPVPDTPYIIPTSHTLLASPGATALSDEYFPNANMWDPHRWENQRPDKEDEEGELIDYGYGAVAKRMSSPYLPFGGGRHRCIGEKFAYVNLGVIVATIVRNLKLYNVDGKTGVPATDYSSMFMGPMKPAVVGWERRFPARS

SEQ ID NO: 33265 - protein, 445 aa, Arabidopsis thaliana
MSNYQGDDAEYMEDVDDEMDEDDLDEDFRGDDMAASDSDVDEFDYSNNKIADTSADQARKGKDIQGIPWDRLSITRETYRQTRLEQYKNYENVPNSGESSGKLRNLVWATSKHDVYLMSQYLVSHYSTLTSGKHDVLNVQGHVSPSEVSFFLNDIRFLYKYLHQFNGCCLFLVWVQKHPGSLLEGFTKTQVSTLAVRDKFLVAGGFQGELICKHLDRPGVSFCSRTTYDDNAITNAIEIYNKPSGALHFTASNNDCGVRDFDMERYQLVNQFRFPWPVNHTSLSPDGKLLTIVGDNPESLLVDPNTGKTLATLSGHLDFSFASAWHPDGFTFSTGNQDKTCRVWDIRNLSKSVAVLRGNLGAIRSIRYTSDGKYMAMAEPADFVHVYDVSNGYETEQEIDFFGEISGISFSPDTEALFIGVWDRTYGSLIEYSRRHNYSYLDSFL

SEQ ID NO: 33266 - protein, 505 aa, Arabidopsis thaliana
MASLARRKAYFLTRNLSNSPTDALRFSFSLSRGFASSGSDENDVVIIGGGPGGYVAAIKASQLGLKTTCIEKRGALGGTCLNVGCIPSKALLHSSHMYHEAKHSFANHGIKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNDRFLSNVPGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 33267 - protein, 464 aa, Arabidopsis thaliana
MGICLSAQVKAESSGASTKYDAKDIGSLGSKASSVSVRPSPRTEGEILQSPNLKSFSFAELKSATRNFRPDSVLGEGGFGCVFKGWIDEKSLTASRPGTGLVIAVKKLNQDGWQGHQEWLAEVNYLGQFSHRHLVKLIGYCLEDEHRLLVYEFMPRGSLENHLFRRGLYFQPLSWKLRLKVALGAAKGLAFLHSSETRVIYRDFKTSNILLDSEYNAKLSDFGLAKDGPIGDKSHVSTRVMGTHGYAAPEYLATGKCRILFGQIFVFWNWLLHMNDHFTFSLGHLTTKSDVYSFGVVLLELLSGRRAVDKNRPSGERNLVEWAKPYLVNKRKIFRVIDNRLQDQYSMEEACKVATLSLRCLTTEIKLRPNMSEVVSHLEHIQSLNAAIGGNMDKTDRRMRRRSDSVVSKKVNAGFARQTAVGSTVVAYPRPSASPLVLGKTFAGHEVPISCPENGIWMYSFCLS

SEQ ID NO: 33268 - protein, 381 aa, Arabidopsis thaliana
MTCCFSCLNPRTKDIRVDIDNARCNSRYQTDSSVHGSDTTGTESISGILVNGKVNSPIPGGGARSFTFKELAAATRNFREVNLLGEGGFGRVYKGRLDSGQVVAIKQLNPDGLQGNREFIVEVLMLSLLHHPNLVTLIGYCTSGDQRLLVYEYMPMGSLEDHLFDLESNQEPLSWNTRMKIAVGAARGIEYLHCTANPPVIYRDLKSANILLDKEFSPKLSDFGLAKLGPVGDRTHVSTRVMGTYGYCAPEYAMSGKLTVKSDIYCFGVVLLELITGRKAIDLGQKQGEQNLVTWSRPYLKDQKKFGHLVDPSLRGKYPRRCLNYAIAIIAMCLNEEAHYRPFIGDIVVALEYLAAQSRSHEARNVSSPSPEISRTPRRDL

SEQ ID NO: 33269 - protein, 254 aa, Arabidopsis thaliana
MNKPFDHKDKCKRTKRVWFLFCPNFSLAKAKRFRLRSPSPIKSRSFYRKFSVIHTVRDFLYERIVADILKQSFGKISTLELGDLSIMGSEQNDSTSFSPSEPKLCVKGCGFFGSPSNMNLCSKCYRDIRATEEQTASAKAAVEKSLNPNKPKTQPQQSQEITQGVLGSGSSSSSTRGGDSAAAPLDPPKSTATRCLSCNKKVGVTGFKCRCGSTFCGTHRYPESHECQFDFKGVAREAIAKANPVVKADKVDRI

SEQ ID NO: 33270 - protein, 414 aa, Arabidopsis thaliana
MRGRSLTLSRVKLELARRSMSATSVPSMADFLTKKPYSPPSWASHLRPLPSHTFSLAHLPTPIHRWNLPGLPNGTELWIKRDDFTGMELSGNKVRKLEFLMAEAVDQHADTVITIGGIQSNHCRATATASNYLNLNSHLILRTSKLLADEDPGLVGNLLVERLVGANVHLISKEEYSSIGSEALTNALKEKLEKEGKKPYVIPVGGSNSLGTWGYIEAAREIEEQLNYRPDDLKFDDIVVACGSGGTIAGISLGSWLGALKAKLTDGSVKFPFIVQVHAFSVCDDPDYFYDFVQGLLDGLHAGVNSRDIVNIHNAKGKGYAMNTSEELEFVKKVASSTGVILDPVYSGKAAYGLINEITKDPKCWEGRKILFIHTGGLLGLYDKVDQMASLMGNWSRMDVSESVPRKDGVGKMF

SEQ ID NO: 33271 - protein, 365 aa, Arabidopsis thaliana
MVVYPNEEAENGSLRFVDFVNKTFALLGNSPIKKFSLRHEPRLYCVDAYLRWIFTAMEQERGLLELHLYADRYYYPVGIERELFTSNTLVKLTLSGRYDFQVETVFLPALKSLSLSSSFEIGFDKYCNLLDGFPALEELYIREAVSELSNALLSSGTFVKCASIKRLVVFTDCPKFKEDEDHQEPCFIAPSLVYLDYSSYLSENYDLIDLNSLVEARLNLRLLESFNNYGSSDNDGDVYGWDFNVPFDYYGDVTNLVAGITNITTLHLSPDSLEGFVHRVTSKCGDACACIPKKQRKIGKKEEISEYGGSFQELEQMRHFLGKLERLETVKVGVHAENNNNNEFLRANLLTLPRLSSKCNNIQFI

SEQ ID NO: 33272 - protein, 481 aa, Arabidopsis thaliana
MEKKKSMFVEQSFPEHEIGDTNKNFDEDGRDKRTGTWMTGSAHIITAVIGSGVLSLAWAIAQLGWVAGPAVLMAFSFITYFTSTMLADCYRSPDPVTGKRNYTYMEVVRSYLGGRKVQLCGLAQYGNLIGITIGYTITASISMVAVKRSNCFHKNGHNVKCATSNTPFMIIFAIIQIILSQIPNFHNLSWLSILAAVMSFCYASIGVGLSIAKAAGGGEHVRTTLTGVTVGIDVSGAEKIWRTFQAIGDIAFAYAYSTVLIEIQDTLKAGPPSENKAMKRASLVGVSTTTFFYMLCGCVGYAAFGNDAPGNFLTGFGFYEPFWLIDFANVCIAVHLIGAYQVFCQPIFQFVESQSAKRWPDNKFITGEYKIHVPCCGDFSINFLRLVWRTSYVVVTAVVAMIFPFFNDFLGLIGAASFWPLTVYFPIEMHIAQKKIPKFSFTWTWLKILSWTCFIVSLVAAAGSVQGLIQSLKDFKPFQAP

SEQ ID NO: 33273 - protein, 173 aa, Bartonella clarridgeiae
MDTIVDFKALPYRKCVGILVFNYEGKVWVGRRLMTVSHANVDMSKLWQLPQGGINQGEKPIDAARRELYEETGIQSVKLIKEAQDWFEYDFPQELMGHVLNNKYRGQTQKWFSFQFTGEISEITINPPPDGNKAEFDQWKWVDLEELPSIVVSFKKHVYTQVVKEFRNSFKYL

SEQ ID NO: 33274 - protein, 345 aa, Arabidopsis thaliana
MASSTGEKGLIVSFGEMLIDFVPTVSGVSLSESPGFLKAPGGAPANVAIAVSRLGGRAAFVGKLGDDDFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTENKTMDDKTAMSLWHPNLKLLLVTLGEKGCTYFTKKFHGSVETFHVDAVDTTGAGDSFVGALLQQIVDDQSVLEDEARLRKVLRFANACGAITTTKKGAIPALPTDIEALSFLKDQKKRQTNLKFSKWCCTASPC

SEQ ID NO: 33275 - protein, 421 aa, Escherichia coli
  misc_feature (252)..(252): Xaa can be any naturally occurring amino acid
MPILQDAPANIHASLDIQTYKNRNPDMADKKLDTQLVNAGRSKKYTLGAVNSVIQRASSLVFDSVEAKKHATRNRANGELFYGRRGTLTHFSLQQAMCELEGGAGCVLFPCGAAAVANSILAFIEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCXARCWEQLRENAYLMGQMVDADTAYITSRGLRTLGVRLRQHHESSLKVAEWLAEHPQVARVNHPALPGSKGHEFWKRDFTGSSGLFSFVLKKKLNNEELANYLDNFSLFSMAYSWGGYESLILANQPEHIAAIRPQGEIDFSGTLIRLHIGLEDVDDLIADLDAGFARIV

SEQ ID NO: 33276 - protein, 487 aa, Escherichia coli
MITEFVFIPIFAIAAGVAQSLQYLNRYHVIREPPEHILNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALA

SEQ ID NO: 33277 - protein, 476 aa, Escherichia coli
MKMSVFPESFLWGGALAANQSEGAFREGDKGLTTVDMIPHGEHRMAVKLGLEKRFQLRDDEFYPSHEATDFYHRYKEDIALMAEMGFKVFRTSIAWSRLFPQGDEITPNQQGIAFYRSVFEECKKYGIEPLVTLCHFDVPMHLVTEYGSWRNRKLVEFFSRYARTCFEAFDGLVKYWLTFNEINIMLHSPFSGAGLVFEEGENQDQVKYQAAHHQLVASALATKIAHEVNPQNQVGCMLAGGNFYPYSCKPEDVWAALEKDRENLFFIDVQARGTYPAYSARVFREKGVTINKAPGDDEILKNTVDFVSFSYYASRCASAEMNANNSSAANVVKSLRNPYLQVSDWGWGIDPLGLRITMNMMYDRYQKPLFLVENGLGAKDEFAANGEINDDYRISYLREHIRAMGEAIADGIPLMGYTTWGCIDLVSASTGEMSKRYGFVFVDRDDAGNGTLTRTRKKSFWWYKKVIASNGEDLE

SEQ ID NO: 33278 - protein, 472 aa, Escherichia coli
  misc_feature (450)..(450): Xaa can be any naturally occurring amino acid
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETXNVTLEHIERKLMAGEKLRNIGV

SEQ ID NO: 33279 - protein, 2216 aa, Arabidopsis thaliana
MSAASSSSVLHLRTNQQLLSLRSLKNSTSVASQLAVTSGVSRRRSCTARCSVKKPVIPESPFLGTRVRRSGSETLQFWRSDGPGRSAKLRTVVKSSFSAVPEKPLGLYDPSYDKDSCGVGFVAELSGETTRKTVTDSLEMLIRMTHRGACGCESNTGDGAGILVGLPHDFYAEAATELGFVLPSAGNYAVGMFFLPTVESRREESKNVFTKVAESLGHSVLGWRLVPTDNSGLGNSALQTEPIIAQVFLTPTTKSKADFEQQMYILRRVSMVAIRAALNLQHGAMKDFYICSLSSRTIVYKGQLKPDQLKDYYYADLGSERFTSYMALVHSRFSTNTFPSWDRAQPMRVLGHNGEINTLRGNVNWMRAREGLLKCNELGLSKKELKKLLPIVDVSSSDSGAFDGVLELLVRAGRSLPEAVMMMIPEAWQNDKNIDPSRKEFYEYLSALMEPWDGPALISFTDGRYLGATLDRNGLRPGRFYITHSGRVIMASEVGVVDVPPEDVMRKGRLNPGMMLLVDFEKHIVVDDDALKQQYSLARPYGEWLKRQKIELKDIIESVPEAERIAPSISGVVPLTFFLETKASNDDDSMESMGIHGLLSPLKAFGYTVEALEMLLLPMAKDGSEALGSMGNDTPLAVMSNREKLCFEYFKQMFAQVTNPPIDPIREKIVTSMECMIGPEGDLTETTEEQCHRLSLKGPLLKIEEMEAIKKMNYRGWRTKVLDITYAKERGTKGLEETLDRICDEANEAIKEGYTLLVLSDRAFSATRVAVSSLMAVGAVHHHLVKTLARTQVGLVVESAEPREVHHFCTLVGFGADAICPYLAVEAVYRLQVDGKIPPKSNGEFHSKEELVKKYYKASNYGMMKVLAKMGISTLASYKGAQIFEALGLSSEVIQKCFAGTPSRVEGATFEMLARDGLQLHELAFPTRGYAPGSAEASALTNPGNYHWRKNGEIHLNDPLAIAKLQEAARTNSVAAYKEYSKRINELNKQSNLRGLMKFKDADVKIPLDEVEPASEIVKRFCTGAMSYGSISLEAHTTLAMAMNKLGGKSNTGEGGELPSRMEPLADGSRNPKRSSIKQIASGRFGVSSYYLTNADELQIKMAQGAKPGEGGELPGHKVIGDIAITRNSTAGVGLISPPPHHDIYSIEDLAQLIHDLKNANPGARISVKLVSEAGVGVIASGVVKGHADHVLIAGHDGGTGASRWTGIKNAGLPWELGLAETHQTLVANDLRGRTVLQTDGQLKTGRDVAVAALLGAEEFGFSTAPLITLGCIMMRKCHKNTCPVGIATQDPVLREKFAGEPEHVINFFFMLAEEVREIMSGLGFRTVTEMIGRADMLELDREVVKNNDKLENIDLSLLLRPAAEIRPGAAQYCVQKQDHGLDMALDQELIALSKSALEKSLPVYIETPICNVNRAVGTMLSHEVTKRYHLTGLPKDTIHIKFTGSAGQSLGAFLCPGIMLELEGDSNDYVGKGLSGGKVVVYPPKGSSFDPKENIVIGNVALYGATSGEAYFNGMAAERFSVRNSGAKAVVEGLGDHGCEYMTGGTVVVLGKTGRNFAAGMSGGIAYVLDVDGKFNTRCNLELVDLDKVEDEEDKMTLKMMIQQHQRHTNSQLAQEVLADFENLLPKFIKVFPRDYKRVLSAMKHEEVSKQAIERASEEADETEEKELEEKDAFAELKNMAAASSKEEMSGNGVAAEARPSKVDNAVKNGGFIAYEREGVKYRDPNVRLNDWNEVMEESKPGPLLTTQSARCMDCGTPFCHQENSGCPLGNKIPEFNELVYQNRWQEALNRLLETNNFPEFTGRVCPAPCEGSCVLGIIENPVSIKSIECAIIDKAFEEGWMVPRPPLKRTGKKVAIIGSGPAGLAAADQLNKMGHLVTVYERSDRIGGLMMYGVPNMKTDKIDVVQRRVDLMTKEGINFVVNANIGKDPSYSLDGLKEENDAIVLAVGSTKPRDLPVPGRDLSGVHFAMEFLHANTKSLLDSNHEDGNYISAKGKKVVVIGGGDTGTDCIGTSIRHGCTNIVNLELLPQPPSTRAPGNPWPQWPRVFRIDYGHQEATTKFGKDPRTYEVLTKRFIGDDNGNVKGLELVRVSWEKDETGRFQFKEIEGSEEIIEADLVFLAMGFLGPEPTLAEKLGLECDNRSNFKAEYGRFSTTVEGVFAAGDCRRGQSLVVWAISEGRQAADQVDKFLTKTDDDEDAKLQQDLNQMKHNTITN

SEQ ID NO: 33280 - protein, 352 aa, Arabidopsis thaliana
MSISESYPPAFRRVTNDENPPATPVIVQGKDINIPVIDLERLDKEILREACKEWGIFRLENHGVPLALTSRLQEISESLLSLPFEKKRELFAAVKSPLSYFWGTPALNRSGDALKRGAQASNLTMLEGFNVPLSSLSSLSKLPTSTCCDDDAQEEPKLESFRVLMEEYGKHITRIAVSLFEAIAQTLNLELSGNRRSEYLSESTGLIRVYRYPQSSEEAAREALGMEVHTDSSVISILREDESGGLEIMKGEEWFCVKPVANTLIVNLGDMMQAISDDEYKSVTHRVKKRNRKTERHSVCYFVFPKRDCVIKSSNYKLFTYSDFEAQVQADVQSLGTKIGLPRFNPNSPLFL

SEQ ID NO: 33281 - protein, 380 aa, Malus x domestica
MSNTAGQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCLLSCGISTGLGATLNVAKPKKGSTVAVFGLGAVGLAAAEGARLSGASRIIGVDLHSDRFEEAKKFGVTEFVNPKAHEKPVQEVIAELTNRGVDRSIECTGSTEAMISAFECVHDGWGVAVLVGVPHKDAVFKTHPVNFLNERTLKGTFFGNYKTRTDIPSVVEKYMNKELELEKFITHKVPFSEINKAFEYMLKGEGLRCIIRMEE

SEQ ID NO: 33282 - protein, 369 aa, Escherichia coli
MKSRAAVAFAPGKPLEIVEIDVEPPRKGEVLVKITHTGVCHTDAFTLSGDDPEGVFPAVLGHEGAGVVVEVGEGVTSVKPGDHVIPLYTAECGECLFCKSGKTNLCVSVRATQGKGLMPDGTTRFSYKGQPLFHYMGCSTFSEYTVVAEVSLAKINPQANHEHVCLLGCGVTTGIGAVHNTAKVQPGDTVAIFGLGGIGLAAVQGARQAKAGRIFAIDTNPEKFDLARSFGATDCINPKDYDKPIQDVLIELTGWGVDHTFECIGNVNVMRSALEAAHRGWGQSVVIGVAGAGKEISTRPFQLVTGRVWKGSAFGGVKGRTQLPGMVEDAMKGEIDLAPFVTHTMGLEEINDAFDLMHEGKSIRTVIHY

SEQ ID NO: 33283 - protein, 471 aa, Saccharomyces cerevisiae
MSICPHIQQVFQNEKSKDGVLKTCNAARYILNHSVPKEKFLNTMKCGTCHEINSGATFMCLQCGFCGCWNHSHFLSHSKQIGHIFGINSNNGLLFCFKCEDYIGNIDLINDAILAKYWDDVCTKTMVPSMERRDGLSGLINMGSTCFMSSILQCLIHNPYFIRHSMSQIHSNNCKVRSPDKCFSCALDKIVHELYGALNTKQASSSSTSTNRQTGFIYLLTCAWKINQNLAGYSQQDAHEFWQFIINQIHQSYVLDLPNAKEVSRANNKQCECIVHTVFEGSLESSIVCPGCQNNSKTTIDPFLDLSLDIKDKKKLYECLDSFHKKEQLKDFNYHCGECNSTQDAIKQLGIHKLPSVLVLQLKRFEHLLNGSNRKLDDFIEFPTYLNMKNYCSTKEKDKHSENGKVPDIIYELIGIVSHKGTVNEGHYIAFCKISGGQWFKFNDSMVSSISQEEVLKEQAYLLFYTIRQVN

SEQ ID NO: 33284 - protein, 479 aa, Escherichia coli
  misc_feature (371)..(371): Xaa can be any naturally occurring amino acid
  misc_feature (426)..(426): Xaa can be any naturally occurring amino acid
MIVKKLTLPKDFLWGGAVAAHQVEGGWNKGGKGPSICDVLTGGAHGVPREITKEVLPGKYYPNHEAVDFYGHYKEDIKLFAEMGFKCFRTSIAWTRIFPKGDEAQPNEEGLKFYDDMFDELLKYNIEPVITLSHFEMPLHLVQQYGSWTNRKVVDFFVRFAEVVFERYKHKVKYWMTFNEINNQRNWRAPLFGYCCSGVVYTEHENPEETMYQVLHHQFVASALAVKAARRINPEMKVGCMLAMVPLYPYSCNPDDVMFAQESMRERYVFTDVQLRGYYPSYVLNEWERRGFNIKMEDGDLDVLREGTCDYLGFSYYMTNAVKAEGGTGDAISGFEGSVPNPYVKASDWGWQIDPVGLRYALCELYERYQXPLFIVENGFGAYDKVEEDGSINDDYRIDYLRAHIEEMKKAVTYDGVDLMGYTPWXCIDCVSFTTGQYSKRYGFIYVNKHDDGTGDMSRSRKKSFNWYKEVIASNGEKL

SEQ ID NO: 33285 - protein, 473 aa, Cunninghamella elegans
MNNFIFKRLNVKEFYEAETKKLVENGHEFHLRLERTGYVIHTCNPQAIKEILLKGDKFPKYDYNTSNNEDGSFFHEFVGFENVLMTNGSTWKKHRMIVNPAFKTALPSRLFGDCTRDLFKLWDNEYANEPFDSDIHNITERLTLQIIGKAAFDFDFNAILDEKSIWKQTYDGINKAASDPLFILFPILEEKFLWLFPKRQQSFKLLNEWKKMLLSIIEKKREAIQNNVDHGVEEAEKDLLTLMIESEHRGEGALSNEELLSDLIIFFIAGHDTTAFALSAAIYYLAKHPDIQEKARQEAISVLCPNGEVDEDIFPTTEDTKHFVYINQIMKETLRINGSVLFLLSPRLVTQDVNLSGVFIPKGSQINVNIHEVHHNPNVWHDPETFDPDRWASNGEAEQLAGKGMAWVPFSNGNRQCIGMNFSLLEQRVILGSLLRKYEWTLPEDSIHQDYMVNKFNLIPKPIDLKIRFKRRY

SEQ ID NO: 33286 - protein, 374 aa, Streptomyces coelicolor A3(2)
MSTDRQTGTGTTLDVDRSDASYRAWLKEAVRKVQADANRSADTHLLLFPLPEHWGIDLYLKDESTHPTGSLKHRLARSLFLYGLCNGWIRPDRPVIEASSGSTAVSEAYFAKLVGVPFIAVMPRTTSAEKIRLIEFHGGRCHFVDDSRRMYEESARLAAETGGHYMDQFTYAERATDWRGNNNIAESIFRQLRLERYPEPSWIVATAGTGGTSATLARYVHYMQYDTRVCVADPDNSCFFEGWTTGDPDVACDRGSRIEGIGRPRMEPSFVPGAIDRMMKVPDAASVAAVRSLERAIGRRAGGSTGTGLWSALKIVAEMVAAGERGSVVTLLCDPGDRYLDKYYSDAWLAEQGLDIEPYTAAIESLLRTGSLLD

SEQ ID NO: 33287 - protein, 431 aa, Euglena gracilis
MPVIKTVKARQILDSRGNPTVEVDVILDNGLLGRGAVPSGASTGEYEAVELRDGDKAVYLGKGVLKSVEAVNTIVAPKLVGLDPTEQLKIDNLMRELDGTPNKGKIGANGILGVSMAVCRAAALVKGVPLYRHIGDLHGNKTFQMPVPMCNIINGGKHADNKIDFQEFMVMPVGAANFSEGLRWCAEIFHHLKSILKKAGHVTSVGDEGGFAPNLDNDEALDFVIAAIKAAGFEPGKQIAIALDCASSELFDEGDRKGYKYWKSNPDRLFSAAEMIEKYAGWVAKYPIVSIEDPLDQNDWDGYVNMTKQLGGKIQIVGDDFFVTNPTRFKKGIELAACNSILIKVNQIGTVSETLECIKMAQAAGYTAVASHRSGETEDAFIADLAVGTAAGQIKTGSLSRTDRMAKYNQLIRIEEELGGEAKWTTAMLRK

SEQ ID NO: 33288 - protein, 485 aa, Euglena gracilis
FFSILPIMANNTADIQYLRQHNIPELVNDLIQQLVTTKPAQPVAFLRDVLSKRKAVIKVVKARQILDSRGNPTVEVDVILDNGVVGRGAVPSGASTGEYEAVELRDGDKKVYLGKGVLKSVNAVNTLVAPKLIGLDPANQREIDELMKQIDGTPNKGKIGANGILGVSMACCRAAALTQGIPLWKHIANLHGNKDNFQLPVPMCNIINGGKHADNKIDFQEFMIMPIGAKSFSEGLRWVTEIFHTLKALLKKAGHVTSVGDEGGFAPDLSNDEALEFVMKAIKAAGYTPGTQIGVALDCASSELFDEGGRKGYKFWKSNPSKLFSAQEMIDIFCRWCDEYPIVSIEDPLDQNDWDGYVNMTKKMGRRTQIVGDDFFVTNPARFSKGIGMNACNAILIKVNQIGTVSETLECIKMAQAHGYGSIASHRSGETEDAFIADLAVGTGCGQIKTGSLSRTDRMAKYNQLIRIEEELGAQAKWTTKHLVR

SEQ ID NO: 33289 - protein, 444 aa, Spinacia oleracea
MVTIKSVKARQIFDSRGNPTVEADIHLDDGTFARAAVPSGASTGIYEALELRDGGKDYMGKGVFKAVQNVNEIIGPALVGKDPTEQTAIDNFMVQELDGTTNEWGWCKQKLGANAILAVSLAVCKAGAQVKKIPLYQHIAEISGNKKMVLPVPAFNVINGGSHAGNKLAMQEFMILPTGASSFREAMKMGSEVYHHLKSVIKKKYGQDATNVGDEGGFAPNIQENKEGLELLKTAIEKAGYTGKVVIGMDVAAAEFYSKDKTYDLNFKEENNDGSQKISGDALKDLYKSFVSEYPIVSIEDPFDQDDWEHYGKLTAEIGDKVQIVGDDLLVTNPKRVEKAINGKSCNALLLKVNQIGSVTESIEAVKMSKRAGWGVMASHRSGETEDTFIADLSVGLSTGQIKTGAPCRSERLAKYNQLLRIEEELGDKAIYAGADFRAPVEPY

SEQ ID NO: 33290 - protein, 383 aa, Citrus sinensis x Poncirus trifoliata
MAIDCIKNIPTMLHQPKEEYKDEQKPLVFDASVLKHQTQIPKQFIWPDDEKPCVNAPELQVPLIDLGGFLSDDPVAAKEASRLVGEACRKHGFFLVVNHGVDSSLIADAHRYMDHFFELPLNEKQRARRKLGEHCGYASSFTGRFSSKLPWKETLSFRYSAEKSLSNNIVEDYLLNTMGDEFKQFGRVYQDYCESMSRLSLGIMELLAISLGVGRAHFKEFFEENDSIMRLNYYPPCQKPELTLGTGPHCDPTSLTILHQDQVGGLQVFVDNEWRSISPNFEAFVVNIGDTFMALSNGRYKSCLHRAVVNSQTTRKSLAFFLCPKNDKVVSPPSELVDTYSSPRIYPDFTWPMLLEFTQKHYRADMKTLEAFTNWLQQKKQLK

SEQ ID NO: 33291 - protein, 315 aa, Capsella rubella
MGTILKLPIIDLSSPEKLSTSSLIRQACLDHGFFYLTNHGVSEELMEGVLMESKKLFSLPLDEKMVMARRGFRGYSPLYEEKPHSSTLAKGDSKEMFTFGSSEGVLAQIYPNEWPREELLPLWRPTMECYYKTVMDVGKKLLGLVALALNLEENFFEQVGGFNAQAAVVRLLRYPGELNSSGEVTCGASAHSDYGMITLLATDGVPGLQVCRDKDKEPKVWEDVAGVKGAFVVNIGDLMERWTNGLFRSTMHRVVSVGKERYSVAVFVDPDPNCVVECLESCCSETSPPRFPPVRTKDYFHERFSQTLASYSGSG

SEQ ID NO: 33292 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYCHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 33293 - protein, 257 aa, Dianthus plumarius
GVFHIATPMDFESKDPENEMIKPTINGMLDILKSCVKAKVRRVVFTSSGGTVNVEATQKPVYDETCWSDLDFIRSVKMTGWMYFVSKILAEQAAWKYAAENNLDFISIIPPLVVGPFIMPSMPPSLITALSPITRTESHYTIIKQGQYVHLDDLCMSHIFLYENPKANGRYIASACAATIYDIAKMLREEYPEYNVPTKFKDYKEDMGQVQFSSKKLTDLGFEFKYGLKDMYTEAVETCRAKGLLPLSLEHHENGSA

SEQ ID NO: 33294 - protein, 506 aa, Rhodospirillum rubrum
MLYAAPGTADAIFAFKPRYDNFIDGTWQPPVRGEYFDNVTPITGKVFCKAARSTEEDITLALDAAHAAADRWGRTTAAERALILNRIADRLQDNLETLAYVESIDNGKPIRETLAADIPLAIDHFRYFAACIRAQEGSLSQIDETTIAYHFNEPLGVVGQIIPWKFPILMATWKLAPALAAGNCIVLKPAEQTPISILVLTELIADLLPPGVLNVVNGFGLEAGKPLASSKRIAKIAFTGETATARLIMQYASQNLIPVTLELGGKSPNVFFDDIASADDSFFDKAVEGFVMFALNQGEICTCPSRALIHESLYDRFIERALARVAVIKQGSPLDTETMIGAQASTEQMDKILSYMDIGREEGATVLAGGARAELGGELDGGYYVQPTVFKGNNSMRIFQEEIFGPVVAVTTFKDEDEALHLANDTHYGLGSGVWTRDGNRAFRFGRGIKAGRVWTNCYHLYPAHAAFGGYKQSGIGRENHHMMLDHYQQTKNLLVSYDPKAMGFF

SEQ ID NO: 33295 - protein, 1530 aa, Schizosaccharomyces pombe
MNQNSDTTHGQALGSTLNHTTEVTRISNSSDHFEDSSSNVDESLDSSNPSSNEKASHTNEEYRSKGNQSYVPSSSNEPSPESSSNSDSSSSDDSSVDRLAGDPFELGENFNLKHYLRAYKDSLQRDDIITRSSGVCMRDHSVYGVGSGYEFLKTFPDIFLQPYRAITEKQVVEKAILSHCHALANAGELVMVLGQPGSGCSTFLRSVTSDTVHYKRVEGTTHYDGIDKADMKKFFPGDLLYSGEHDVHFPSLTTAETLDFAAKCRTPNNRPCNLTRQEYVSRERHLIATAFGLTHTFNTKVGNDFVRGVSGGERKRVTISEGFATRPTIACWDNSTRGLDSSTAFEFVNVLRTCANELKMTSFVTAYQASEKIYKLFDRICVLYAGRQIYYGPADKAKQYFLDMGFDCHPRETTPDFLTAISDPKARFPRKGFENRVPRTPDEFEQMWRNSSVYADLMAEMESYDKRWTETTPASSEAPEKDNFGSDISATTKHELYRQSAVAEKSKRVKDTSPYTVTFSQQLWYCLARSWERYINDPAYIGSMAFAFLFQSLIIGSIFYDMKLNTVDVFSRGGVLFFSILFCALQSLSEIANMFSQRPIIAKHRASALYHPAADVISSLIVDLPFRFINISVFSIVLYFLTNLKRTAGGFWTYFLFLFIGATCMSAFFRSLAGIMPNVESASALGGIGVLAIAIYTGYAIPNIDVGWWFRWIAYLDPLQFGFESLMINEFKARQFECSQLIPYGSGYDNYPVANKICPVTSAEPGTDYVDGSTYLYISFNYKTRQLWRNLAIIIGYYAFLVFVNIVASETLNFNDLKGEYLVFRRGHAPDAVKAAVNEGGKPLDLETGQDTQGGDVVKESPDNEEELNKEYEGIEKGHDIFSWRNLNYDIQIKGEHRRLLNGVQGFVVPGKLTALMGESGAGKTTLLNVLAQRVDTGVVTGDMLVNGRGLDSTFQRRTGYVQQQDVHIGESTVREALRFSAALRQPASVPLSEKYGYVESVIKLLEMESYAEAIIGTPGSGLNVEQRKRATIGVELAAKPALLLFLDEPTSGLDSQSAWSIVCFLRKLADAGQAILCTIHQPSAVLFDQFDRLLLLQKGGKTVYFGDIGEHSKTLLNYFESHGAVHCPDDGNPAEYILDVIGAGATATTNRDWHEVWNNSEERKAISAELDKINASFSNSEDKKTLSKEDRSTYAMPLWFQVKMVMTRNFQSYWREPSILMSKLALDIFAGLFIGFTFYNQGLGVQNIQNKLFAVFMATVLAVPLINGLQPKFIELRNVFEVREKPSNIYSWVAFVFSAIIVEIPFNLVFGTLFFLCWFYPIKFYKHIHHPGDKTGYAWLLYMFFQMYFSTFGQAVASACPNAQTASVVNSLLFTFVITFNGVLQPNSNLVGFWHWMHSLTPFTYLIEGLLSDLVHGLPVECKSHEMLTINPPSGQTCGEYMSAFLTNNTAAGNLLNPNATTSCSYCPYQTADQFLERFSMRYTHRWRNLGIFVGYVFFNIFAVLLLFYVFRVMKLRSTWLGKKITGTG

SEQ ID NO: 33296 - protein, 336 aa, Arabidopsis thaliana
MGNCLKPLKEQPPSASPKPLTIPSSSVEPVKENLKEFRFAELNKATKRFRKYMVIKGNDNGFTRTFYEGCINETTFAPSRTGITVSVMECYQDNSQTLQDWKEEVKSLGRISHPNLVKLLGYCCEENKSFLVFEYLHKGSLNRYIFGKEEEALPWETRVKIAIGAAQSIAFLHWVKNSALYRELRMYNILLDEHYNTKLFYLGSKKLCLLEESVTTAFIGRTVYIPPEYVISGHLGTKSDVYTFGVILLEILTGLKASDGKKNENMQSLHVWTKPFLSDQSKIREIIDPRLGNDYPVNAATQMGKLIKRCIKLDTRKRPSMQQVFDGLNDIAEIKD

SEQ ID NO: 33297 - protein, 223 aa, Vigna radiata
MSLTIPTNLSKPAALRPKLGSKLRPTIVCSATPNNNSDNNNNISSDLKAFSAALALSSILLSAPLPAVADISGLTPCKESKQFAKREKQSIKKLESSLKLYAPDSAPALAIKASVEKTKRRFDNYAKQGLLCGADGLPHLIVSGDQRHWGEFITPGFLFLYIAGWIGWVGRSYLIAIRDEKKPTMKEIIIDVPLASRLLFRGFSWPVAAYRELINGDLIAKDV

SEQ ID NO: 33298 - protein, 508 aa, Candida tropicalis
MNLDFSQCFGDKGDIENITEADIISTVEFDHTGDFLATGDKGGRVVLFERNQSKKKQSCEYKFFTEFQSHDAEFDYLKSLEIEEKINKIKWLKSANDSLCLLSTNDKTIKLWKIQERQIKLVSENNLNGLNHLPSSNIGIESLKLPQLQLHDKLISAQPKKIYANAHAYHINSISVNSDQETYLSADDLRINLWNLGIADQSFNIVDIKPANMEELTEVITSAEFHPLQCNLFMYSSSKGTIKLSDMRSNSLCDSHAKIFEEYLDPSSHNFFTEITSSISDVKFSHDGRYIASRDYMTVKIWDLAMENKPIKTIDVHEHLRERLCDTYENDAIFDKFEVQFGGDNKSVMTGSYNNQFVIYPNAVNTGNDDKPKFKSAFKNSSKRSKKNGFSTRTTDDDDDDDDDDDDEEADDEFDEEVPATKNSPGSQLEDDDEQEEIILQADKSAFKSKKSGQHPMRRRMTSGVGSNLGREFDDVDFKKSILHLSWHPRENSVAIAATNNLYIFSTL

SEQ ID NO: 33299 - protein, 233 aa, Legionella longbeachae
MKMKLVTAAIMGLAMSTAMAATDATSLTTDKDKLSYSIGADLGKNFKNQGIDINPDVLAKGMQDGMSGAQLILTEEQMKDVLSKFQKDLMAKRSAEFNKKAEENKAKGDAFLSANKSKPGIVVLPSGLQYKIIDAGTGAKPGKSDTVTVEYTGTLIDGTVFDSTEKAGKPATFQVSQVIPGWTEALQLMPAGSTWEVFVPADLAYGPRSVGGPIGPNETLIFKIHLISVKKAA

SEQ ID NO: 33300 - protein, 365 aa, Apium graveolens
MAKSSEIEHPVKAFGWAARDTTGLLSPFKFSRRATGEKDVRLKVLFCGVCHSDHHMIHNNWGFTTYPIVPGHEIVGVVTEVGSKVEKVKVGDNVGIGCLVGSCRSCESCCDNRESHCENTIDTYGSIYFDGTMTHGGYSDTMVADEHFILRWPKNLPLDSGAPLLCAGITTYSPLKYYGLDKPGTKIGVVGLGGLGHVAVKMAKAFGAQVTVIDISESKRKEALEKLGADSFLLNSDQEQMKGARSSLDGIIDTVPVNHPLAPLFDLLKPNGKLVMVGAPEKPFELPVFSLLKGRKLLGGTINGGIKETQEMLDFAAKHNITADVEVIPMDYVNTAMERLVKSDVRYRFVIDIANTMRTEESLGA

SEQ ID NO: 33301 - protein, 500 aa, Mesembryanthemum crystallinum
MDTGGNSLPSGPDGVKRKVSYFYDPEVGNYYYGQGHPMKPHRIRMTHALLAHYGLLQHMQVLKPVPARDRDLCRFHADDYVSFLRGITPEMQQDQLRQLKRFNVGEDCPVFDGLYSFCQTYAGGSVGGAVKLNHGLCDIAINWAGGLHHAKKSEASGFCYVNDIVLAILELLKVHERVLYVDIDIHHGDGVEEAFYTTERVMTVSFHKFGDYFPGTETFVYIGYGKGKYYSLNVPLDDGIDDESYQSLFKPIMGKVMEIFKPGAVVLQCGADSLSGDRLGCFNLSIKGHAECVKYMISFNVPLLLVGGGGYTIRYVARCWCYETGVALGFELDDKIPQHEYYEYFGPDYTLHVAPSNMENKNSRPMLDDIRGKLLEYLSSLQHAPSVQFQERPPEAEIPEEDEDQHDPEGRWDPDSDMEVDDRSISIRSRVKREIMEPDLKDRDDVKDAVDHPRDMDVSYGAGNTSVKAPTTSSDQPEGCVEMEQDNSNRPPDQGPNMNS

SEQ ID NO: 33302 - protein, 431 aa, Burkholderia cepacia
MAYHSTNPLLSRVVIVGAGQAAAAVAKTLRAEGHRGEIMMLGAERVGPYERPPLSKAWLSAENVPEIAALLEKSEAGQSDVDLRTGVNVTRIDRPSCTVHVDDGSEICFDRLVIATGGRARRLAVPGDASDQIAYLRTIDDALHIRRGLKAGKRLLLIGGGWIGLETACSARKLGVDVVLVEAAQRLCERTVPAIVGERLLGIQRSLGVDVRLGAGIEQLSKLPGGRYAASLSGVREEFDLVVAGVGMVANDELAAEAGLPCAGGVLCDVEGRTVDPHVFACGDVASFEHPSGPIGMRRLESWDNAQQQGAACARAILGKRAAAHPLPWFWSDQGDVNIQILGFPNATATPVVREGDGKATLVWLEEHAADEPAQIVAAVCINAPADMPILRRMWQKGVRVDRKTLAVQEVSLKSLLQRSAGAARNGGANT

SEQ ID NO: 33303 - protein, 487 aa, Myxococcus xanthus
MSSLPPWLAQFLPILILLGAIGLVLTRLPKVELGHSEAFKRRRFFNWFPLGMTYAFLYMGRYNLNVATSAMGDRTSNADFGTIFAWGTAVYGVAFLLNGPLTDKLGGRKTILMAAAGSAVANVAMGGVVYAVLTHNWAPPGGLVATLSFLYAVNMYFQSFGAVSIVKVNAAWFHVRERGLLGGVFGILISLGIYFAYDWSRLIVKAAPTYWAFFVPAAILAVFLVVDYFVIRDTPSHAGHPDFDTADASSGETGPQLGVAGVLKRMLTNRAIIIILCIEFCSGFMRNAIMQWYPKFAKATGLGETFVAANWGMLLCVAGITGGMFAGVISDRVFDSRRGPVSAVLYAGMSVGAVISVFVLESVALGWTVIFMSLCVIGVHGMLSGTASMDFGGKKNAGLAVGIIDGAVYAGTALQSILLGSILPMGDEAKTAANWGNWPYAMLPLSFLGLLLATQVWNARPQPKSTPVPATLPVPSEAPANRTGTGG

SEQ ID NO: 33304 - protein, 497 aa, Cladosporium fulvum
MSLSVQLETPSAGKYEQPTGLFINNEWVKPVSGKFFDVINPTDESVICQVAEADEKDVDIAVAAARKAFEGPWRQETPENRGKLLVKLAELFEKNLDLFASVKALDNGKAFNMAKVDIGMCAGCLRYYGGWADKIEGKVVDTTPDTFNYIKKEPIGVCGQIIPWNFPLLMWAWKIGPAVATGNTVVIKTAEQTPLGAYVAANLIKEAGFPPGVVNVISGFGKVAGAAIASHMDIDKVAFTGSTVTGRTILKAAAGSNLKKVTLELGGKSPNIVFDDADIDNAISWVNFGIFFNHGQRCCAGSRIYVQEGIYDKFLQRFKERAQKNVVGDPFAADTFQGPQVSQVQFDRIMGYIQAGRDAGATVEIGGNRKGDKGYFIEPTIFANVTEDMKIMQEEIFGPVCSISKFKTKEDAIKVGNATPYGLAAAVHTRNLNTAIEVSNALRAGTVWVNTYNTLHHQLPFGGFKESGIGRELGEDALANYTQTKTVSIRLGDALFG

SEQ ID NO: 33305 - protein, 251 aa, Lotus corniculatus var. japonicus
MPIRNIAIGAPQEATHPDTLRSALAEFISTFIFVFAGSGSGIAYNKLTDDGAATPAGLISASIAHAFALFVAVSISANISGGHVNPAVTFGLFVGGNISFLRGVIYIIAQLLGSIVASLLLAFVTGLAVPAFGLSAGVGVGNALVLEIVMTFGLVYTVYATAVDPKKGSLGTIAPIAIGFIVGANILLGGAFDGASMNPAVSFGPAVVSWSWSNHWIYWVGPLVGGGIAGLIYEVVFIGSQTHEQLPTTDY

SEQ ID NO: 33306 - protein, 382 aa, Escherichia coli
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLESEQSAAICEELANFDYLYLSGISLAILSPTSREKLLSLLRECRANGGKVIFDNNYRPRLWASKEETQQVYQQMLECTDIAFLTLDDEDALWGQQPVEDVIARTHNAGVKEVVVKRGADSCLVSIAGEGLVDVPAVKLPKEKVIDTTAAGDSFSAGYLAVRLTGGSAEDAAKRGHLTASTVIQYRGAIIPREAMPA

SEQ ID NO: 33307 - protein, 459 aa, Synechococcus
MTAVVLPAAAETLAALQATFDRGDTRTLAFRLARLQDLAKLVADNEAELLQALASDLRKPALEAYASEIYFVRDQIKLTCKHLRRWMQPEKQSISLMQQPGQAYRQAEPLGVVLIIGPWNYPFQLLITPLIGAIAAGNCAVLKPSELAPATSSLIQRLISDRFDPDYIRVLEGDASVSQALITQPFDHIFFTGGTAIGRKVMAAAAENLTPVTLELGGKSPCIVDTDIDLDVAARRIAWGKFFNAGQTCIAPDYLLVQRTVAEPFIEALIDNIQQFYGEDPQQSADYARIVSDRHWQRLNSLLVDGTIRHGGQVDRSDRYIAPTLITDVNWRDPILQEEIFGPLLPILIYDQLDEAIAQIRAQPKPLALYLFSRDRQVQERVLAETSAGSVCLNDTILQVGVPDAAFGGVGPSGMGGYHGKASFETFSHYKLVLKRPFWLDLALRYPPTGDKINLFRKL

SEQ ID NO: 33308 - protein, 429 aa, Saccharomyces cerevisiae
MVDVEEKSQEVEYVDPTVNRVPNYEVSEKAFLLTQSKVSIEQRKEAAEFVLAKIKEEEMAPYYKYLCEEYLVNNGQSDLEHDEKSDSLNEWIKFDQELYNELCKKNESKIKELNEKIQKLEEDDEGELEQAQAWINLGEYYAQIGDKDNAEKTLGKSLSKAISTGAKIDVMLTIARLGFFYNDQLYVKEKLEAVNSMIEKGGDWERRNRYKTYYGIHCLAVRNFKEAAKLLVDSLATFTSIELTSYESIATYASVTGLFTLERTDLKSKVIDSPELLSLISTTAALQSISSLTISLYASDYASYFPYLLETYANVLIPCKYLNRHADFFVREMRRKVYAQLLESYKTLSLKSMASAFGVSVAFLDNDLGKFIPNKQLNCVIDRVNGIVETNRPDNKNAQYHLLVKQGDGLLTKLQKYGAAVRLTGSDRV

SEQ ID NO: 33309 - protein, 160 aa, Stellaria longipes
VSNYPPLPKPDLIKGLSAHTDAGGIILLSEDDKVSGLELLKDSDWIDVPPMRHSIVVNLGDELEVITNGKYWSVMHRVQIDTNITRMSTASFYVPGNDRVIAPAEALPKEFKDDEVYPKFVFKSYMKAYAKLIRQSGLKFEAKEPRFEAMKAHRIGSSCN

SEQ ID NO: 33310 - protein, 148 aa, Schizosaccharomyces pombe
HMVKSLSLGATAVMMGGLLAGTTESPGEYYVREGQRYKSYRGMGSIAAMEGTGVNKNASTGRYFSENDAVRVAQGVSGLVVDKGSLLRFLPYLYTGLQHALQDIGTKSLDELHEAVDKHEVRFELRSSAATRKEGDIQGFATYEKRLY

SEQ ID NO: 33311 - protein, 42 aa, Daucus carota
AGCDWIHVDVMDGRFVPNITIGPLVVDALRPVTDLPLDVHLV

SEQ ID NO: 33312 - protein, 323 aa, Mangifera indica
MESLSFPVINLEKLNGEERAATMEKIKDACENWGFFELVNHGIPIEELDTLERKTKEHYRKCMEQRFKELVASKALEGVQTEIKDMDWESTFYVRHLPQTNLKCTPDLDDEYRKVMKEFASKLEKLAEELLDLLCENLGLEKGYLKKTFYGSKGPTFGTKVSHYPPCPQPDLIKGLRAHTDADGIILLFQDDKVSGLPASERWAVDIDVPPMRHSIVVNLGDQLEVITNGKYKSVEHRVVAQRDGNGRMSIASFYNPGSDAVIYPAPPLLEPEAEEKKQVYPKFVCEDYMKLYARLKFQAKEPRFEAMKAVETTVNLGPIATA

SEQ ID NO: 33313 - protein, 401 aa, Pisum sativum
MATKRSVGTLKEADLKGKRVFVRVDLNVPLDDNLNITDDTRIRAAIPTIKYLTGYGAKVILSSHLGRPKGVTPKYSLKPLVPRLSELLGSEVTIAGDSIGEEVEKLVAQIPEGGVLLLENVRFHKEEEKNDPEFAKKLASLADLYVNDAFGTAHRAHASTEGVAKYLKPSVAGFLMQKELDYLVGAVSNPKKPFAAIVGGSKVSSKIGVIESLLEKVDILLLGGGMVFTFYKAQGYSVGTSLVEEDKLGLATSLIEKAKAKGVSLLLPTDVVIADKFSADANDKIVPASSIPDGWMGLDIGPDSIKTFNEALDKSQTVIWNGPMGVFEFDKFAAGTEAIAKKLAEISGKGVTTIIGGGDSVAAVEKAGLADKMSHISTGGGASLELLEGKPLPGVLALDDA

SEQ ID NO: 33314 - protein, 217 aa, Streptomyces lincolnensis
ELLAEALHPYPSGLLVTTKVGPALSPAGEWGLDGRPAALRAQVDNALRRLRVDRIELLQLHRLDPDTPLADQIGALRDLRAEGKVGRIGLSEVTVAELDEARAIVDIASVQNRYNLLDRREHEPVLKACEAAGIAFLPWRPLAPGAADANPDITAVAAELDATPTQVALAWLLAHSPVILPIPGTATLAHLEENVAAADLALTPDQLARLDRLDGTH

SEQ ID NO: 33315 - protein, 268 aa, Escherichia coli
MERYESLFAQLKERKEGAFVPFVTLGDPGIEQSLKIIDTLIEAGADALELGIPFSDPLADGPTIQNATLRAFAAGVTPAQCFEMLALIRQKHPTIPIGLLMYANLVFNKGIDEFYAQCEKVGVDSVLVADVPIEESAPFRQAALRHNVAPIFICPPNADDDLLRQIASYGRGYTYLLSRAGVTGAENRAALPLNHLVAKLKEYNAAPPLQGFGISAPDQVKAAIDAGAAGAISGSAIVKIIEQHINEPEKMLAALKVFVQPMKAATRS

SEQ ID NO: 33316 - protein, 468 aa, Salmonella typhimurium
SAEHVLTMLNEHEVKFVDLRFTDTKGKEQHVTIPAHQVNAEFFEEGKMFDGSSIGGWKGINESDMVLMPDASTAVIDPFFADSTLIIRCDILEPGTLQGYDRDPRSIAKRAEDYLRATGIADTVLFGPEPEFFLFDDIRFGASISGSHVAIDDIEGAWNSSTKYEGGNKGHRPGVKGGYFPVPPVDSAQDIRSEMCLVMEQMGLVVEAHHHEVATAGQNEVATRFNTMTKKADEIQIYKYVVHNVAHRFGKTATFMPKPMFGDNGSGMHCHMSLAKNGTNLFSGDKYAGLSEQALYYIGGVIKHAKAINALANPTTNSYKRLVPGYEAPVMLAYSARNRSASIRIPVVASPKARRIEVRFPDPAANPYLCFAALLMAGLDGIKNKIHPGEPMDKNLYDLPPEEAKEIPQVAGSLEEALNALDLDREFLKAGGVFTDEAIDAYIALRREEDDRVRMTPHPVEFELYYSV

SEQ ID NO: 33317 - protein, 505 aa, Hordeum vulgare
MAAPPAIPRRGLFIGGGWREPTLGRHIPVINPATEDTIGDIPAATAEDVELAVAAGGPVLARRREPWARASGATRAKYLNAIAAKITGKIAYLALLETVDSGKPKDEAVADMDDVAACFEYYAALAEALDGKQHAPISLPMEEFKTYVLKEPIGVVGLITPWNYPLLMATWKVAPALAAGCTAVLKPSELASLTCLELGAICEEIGLPSGVLNIITGLGPDAGAPIASHPHVDKIAFTGSTATGKTIMTAAAQMVKPVSLELGGKSPLVTFDDVADIDKAVEWPMLGCFFNGGQVCSATSRLLLHEKIAEPFLDRLVEWAKNIKISDPLEEGCRLGSVISKGQYEQIKKFISTARSEGATILHGGDRPKHLGKGFFIEPTINTGVSTSMQIWREEVFGPVICVKVFKTESEAVELANDTHYGLAGGVISDDLERCERIAKVIHSGIVWKNCSQPTLVQAPWGGNKRSGFGRELGEWGLENYLSVKQVTRYCKDELYGWYQRPSKL

SEQ ID NO: 33318 - protein, 1142 aa, Saccharomyces cerevisiae
MAINGNSIPAIKDNTIGPWKLGETLGLGSTGKVQLARNGSTGQEAAVKVISKAVFNTGNVSGTSIVGSTTPDALPYGIEREIIIMKLLNHPNVLRLYDVWETNTDLYLVLEYAEKGELFNLLVERGPLPEHEAIRFFRQIIIGVSYCHALGIVHRDLKPENLLLDHKYNIKIADFGMAALETEGKLLETSCGSPHYAAPEIVSGIPYQGFASDVWSCGVILFALLTGRLPFDEEDGNIRTLLLKVQKGEFEMPSDDEISREAQDLIRKILTVDPERRIKTRDILKHPLLQKYPSIRDSKSIRGLPREDTYLTPLSESNSSIDATILQNLVILWHGRDPEGIKEKLREPGANAEKTLYALLYRFKCDTQKELIKQQQVKKRQSISSVSVSPSKKVSTTPQRRRNRESLISVTSSRKKPISFNKFTASSASSSNLTTPGSSKRLSKNFSSKKKLSTIVNQSSPTPASRNKRASVINVEKNQKRASIFSTTKKNKRSSRSIKRMSLIPSMKRESVTTKLMSTYAKLAEDDDWEYIEKETKRTSSNFATLIDEIFEYEKYEQIRKEKEELERKVREAKAREELERRRRKQEEKERARKLLEKEDLKRKQEELKKQIEIDISDLEQELSKHKEEKLDGNIRSISAPMENEEKNINHLEVDIDNILRRRNFSLQTRPVSRLDPGIMFSSPTEEVSPVEPKRTENERLTTEKKILETIRRSKFLGSSFNIDKELKLSKMEYPSIIAPQRLSEERVVSDSNDGYESLILPKDGNGVSQLKDSTATTAPVSDGRLRKISEIRVPQFTRKSRHFSESNKRLSVLSMYSTKESFTNLVDILKNGNLDVNNQQSQRIPTPRSADDSEFLFETVNEEAEYTGNSSNDERLYDVGDSTIKDKSALKLNFADRFNGSNEAKQTDNLHLPILPPLNGDNELRKQNSQEGDQAHPKIKSMIPESGSSSHTEKEEENEEKEEKKPEQHKQEEDQEKREKVVDDMEPPLNKSVQKIREKNAGSQAKDHSKDHLKEHKQDKNTAIGNGSFFRKFSKSSDKTMELYAKISAKQLFNGLEKLLRGWTQYGLKNIKSHPNNLTLTGKLSSDNIFSLRSTLFEVNIYPRGKMSVVQFKKVSGSFKAVKKLVNEVENVLNKEGVLQK

SEQ ID NO: 33319 - protein, 497 aa, Arabidopsis thaliana
MEMLLGGQATNGALRSKTKIVCTLGPASRSVEMIEKLLKAGMNVARFNFSHGSHSYHQETLDNLRTAMDNTGILCAVMLDTKSPVIRTGFLKEGKPIQLKQGQEITISIDYKIQGDSNTISMSYKKLAEDLKPGDVILCSDGTISLNVLSCDKYLGLVRCRCENSALLGERKNVNLPGIVVDLPTLTEKDKEDIMQWGVPNKIDIIALSFVRKGSDLIQVRKLLGEHSKSIMLMSKVENQEGVMNFDKILENSDAFMVARGDLGMEIPIEKMFLAQKTMINKANAHGKPVVTATQMLESMTVSPRPTRAEATDVANAVLDGTDCVMLSGETAAGAHPETAVLTMSRICKEAEDFIDYDILHKKTLGMVSLPLSPIESLAASAVSTARSVFASAIVVLTRGGYTAELVAKYRPSVPILSVIMPEIAECSDSVAHVARRGLIYRGIIPVVGCSARDSTEEMIRLAIGFAKTKGICKTGDSIVALHKIDGSSIVRIVSVE

SEQ ID NO: 33320 - protein, 510 aa, Arabidopsis thaliana
MAAMLTVEFQNCLIFILLCILLLLCYPLFFKKPKVSQDGFGLPPSPLSLPIIGHLHLLFSNLTHKSLQKLSSKYGPLLYLRIFNVPIIFVSSASVAYEIFRGHDVNISFRGNPPIEESLLVGSFGFFTAPYGDYWKFMKKVMVTKLLGPQALQRSRGIRADALERFYMNLLDKAMKKESVEIGKETMKLIYDSICKMIMGRNFSEENGEAERVRGLVTESTALTKKIFMANVLHKPLKKLGISLFKKEIMDVSNSFDELLERFLVEHEEKLNEDQDMDMMGVLLAACRDKNAECKITRNHIKSLFVDLVVAGTDTSRHATQWTMAEIINKPKVLEKVREEIYSVVGRTRLVQETDLPSLPYLQATVKEGLRLHPPGPLFARTAREGFSVGGFYVPENTPLVVNAYAMMRDPGSWEDPNEFKPERFLGSGKEDEREHGLKYIPFGSGRRGCPGINLAYILVGTAIGVMVQCFDWKIKGNKVNMEEARGSLVLTMAHPLKCIPVARTQIPSC

SEQ ID NO: 33321 - protein, 365 aa, Arabidopsis thaliana
MKKLMVTKLFGPQALERLRHVREDELERFHTNLLSKEMKGETVQIAKEAIKLTNNSVCKMIMGRSCLEENGDAARVRGLVTETFALVKKIFLTQVLRRLFEILGISLFKKEILGVSRKFDEFLEKILVEHDEKPDFQGGDMMDVLLAAYRDENAEYKITRNHIKSLFAELILGGTDTSAQTIEWTMAEIINKPNILEKLRKELDSVVGKTRLIEEKDLPNLPYLQSVVKEGLRLHPPAPVFGRKVLEGCTIKGYYVPKNTALVVNAYAVMRDPHYWEDPDEFKPERFLTTSSKKEEEREQELKYIPFGSGRRGCPGVNLGYIFVGTAIGMMVHCFDWRVKGDKVNMDETAAALTLNMAVGRRDTC

SEQ ID NO: 33322 - protein, 445 aa, Arabidopsis thaliana
MVNILILSLLFLVILLLLTAFKRAKRRQHRPIPSPPGFPIIGNLHQLGELPHQSLWKLSKKYGPVMLLNLGKVPTVILSSSETAKQALRDYDLHCCSRPSLAGGRELSYNNRDISFSPYNDYWKELRKLCTQELFSAKNIHSTQHIKDEEVKKLIVSIAESASLKTPINLNKKCLALTVSIVCRIAFGVSFEGTVLSNDSFNKLIREAFEMLGSFSASDFIPYIGWIIDRFTGLQGRREKSDILLAGIETSAGTMAWTMAELAKNPLVMRKVQSEIRNKFENRELISFEDIEQLHYLKTVIKETWRLHPPAPLLLPREVMSEFEINGYTMQPKTQIHVNVWAIGRDPNTWKDPEEFLPERFIDSNIDTKGQNFELLPFGGGRRMCPAMYMGTTMVEFGLANLLYHFDWKLPEGMKVEDMDMEEAPGLTVNKKNDLLLVPVKYLDN

SEQ ID NO: 33323 - protein, 500 aa, Arabidopsis thaliana
MTNIWLLSLIFVICILVAVFNHKNRRNYQRTPPSPPGCPIIGNLHQLGELPHQSLWKLSKKYGPVMLLKLGRVPTVIVSSSETAKQALKIHDLHCCSRPGFAGARELSYNYLDIAFSPYDDYWKEVRKLAVQELFSSKQVHSIQPIKDEEVKKLIDSISESAAQKTPINLNKTLLALTVSVVCRTAFSVNFEGTVLNSERFNNIVREALEMLGSFSASDFIPYVGRIIDLLTGLQGRRERSMRDLDAFYEQMFDLHKQKKEEGSEDFVDLLLRLEKEEAVLGNDKLTRNHIKAILMDVLLAGMDTSAITMTWAMAELAKNPRVMKKVQSEIRSQIKNKERISFDDTDKLEYLKMVIKETWRLHPTTPLLIPREAMSEFEINGYTIPVKTRLHVNVWAIGRDPDTWKDPEVFLPERFTDNNIDAKGQHFELLPFGGGRRMCPAVYMGTTMVEFGLANLLYHFDWKLPEGMKVDDIDMEEAPGLTVNKKNELILVPTKFLDP

SEQ ID NO: 33324 - protein, 500 aa, Arabidopsis thaliana
MAHIWLLPLIFLVCILLAVFNHKKHPKYRQFPCPPGFPIIGNLHQIGELPHQTLWKLSKKYGPVMHLMLGRVPTVVVSSSDTARQVLRVHDLHCCTRPSLSGPRELSYNYLDIAFSPYDDYWKEVRKLCVQELFSTKQVHSIQPIKDEEVKKMIDSIAESASQKNPVNLNNKCLELTVSVVCRTAFGVSFEGTVLNSDRFNKIVREALEMLGSFSAADFIPYVGWIIDVLTGLQGRRERSKRDLNAFFEQMFDLHKEGKKEGNEDFVDLLLRLEKEEAVLGNDKLTRNHIKAILLDVLLAGIDTSAITMTWAMTELARNPRVMKKVQSEIRTQMGNRSMISFEDMDQLEYLKMVIKETWRLHPTTPLLLPREAMSEFDINGYTIPVKTRLHVNVWAIGRDPDTWKDPEVFLPERFMDNNIDAKGQHFELLPFGGGRRICPAIYMGTTMVEFGLANLLYHFDWKLPEGVEVKDIDVEEAPGLTVNKKNELLLVPEMRRSCG

SEQ ID NO: 33325 - protein, 500 aa, Arabidopsis thaliana
MATILFLSLLFLSCILLAAFTHKKRQQHQRKPPSPPGFPIIGNLHQLGELPHQSLWRLSKKYGHVMLLKFGSIPTVVVSSSETAKQVLKIHDLHCCSRPSLAGPRALSYNYLDIAFSPFDDYWKELRRICVQELFSVKRVQSFQPIKEDEVKKLIDSVSESASQGTPVNLSEKFTSLTVRVTCKATFGVNFQGTVLNSDRFEKLIHDTYLFLGSFSASDYFPNGGWIIDWLTGLHGQRERSVRALDAFYEQMFDLHKQGNKEGVEDFVDLLLRLEKEETVIGYGKLTRNHIKAILMNVLIGGIGTSAITMTWAMTELMRNPRVMKKVQSEIRNQIGKKSMITLDDIDQLHYLKMVINETWRLHPPSPFLIPRQVMSEFELNDYVIPVKTRLYVNVWAIGRDPDTWKDPEEFLPERFVNSSIDAKGQHFELLPFGSGRRMCPAMYMGTTMVEFGLANMLYHFDWKIPVGMVAEDIDLEESPGLNASKKNELVLVPLKYLDH

SEQ ID NO: 33326 - protein, 486 aa, Arabidopsis thaliana
MVDVYKLWIVIVSLIVVKLFHLIYQWSNPKCNGKLPPGSMGYPIIGETIEFMKPHDALQFSTFIKKRVLIFFFFFLCIMDRFFRTSLFGGKVIISMDNELNMEMAKTNRTPGITKSIARLFGEDNNLFLQSTESHKHVRNLTVQMLGSQSLKLRIMENIDLLTRTHMEEGARDGSLDVKETTSKILIECLAKKVMGEMEPEAAKKLALCWRYFPSGWFRLPFNLPGIGVYNMMKARKRMKTLLKEEVLKKREAGEEFGEFSKIIFGEKEGEKETMSMKNVIEYIYTFFVIANETTPRILAATVKFISENPKVMQELQREHAMIFENKSEEAGLTWEDYKSMTFTNMVINESLRISTTVPVILRKPDHDTKVGDYTIPAGWNFMGYPSAHFDPTKYEDPLEFNPWRWKGNDLDAIVSTNYIPFGAGPRLCVGAYFAKLLMAIFIHHLCRYRWSMKAEVTVTRSYMLMFPRGCDVQISKDTQEHDSDG

SEQ ID NO: 33327 - protein, 418 aa, Arabidopsis thaliana
MSNYRGDDAEYMEDVDDEMEDVEDDMDEEFRGDDLGASDSDVEEFDYSNNKVADTTAEQARKGKDIQGIPWDRLNISREKYRQTRLEQYKNYENVPNSGESSEKLRNLVWATSKHDVYLMSNFLVTHYSSLTSGKHEVLNVRGHVAPSEKHPGSLLEGFTQTQVSTLAVKDDFLVAGGFQGELICKHLDRPGVSFCSRMTYDDNAITNAIEIYNKPSGALHFTASNNDCGVRDFDMERYQLVKHFRFPWPVNHASLSPDGKLLAIVGDNPEGLIVDPNTGKTLETLSGHLDFSFASAWHPDGVTFSTGNQDKTCRVWDIRNLSQSVTVLKGNLGAIRSIRYTSDGKYMAMAEPADFVHVYDVSNGYETEQEIDFFGEISGISFSPDTEALFIGVWDRTYGSLLEFGRRRNYSYLDSYL

SEQ ID NO: 33328 - protein, 501 aa, Arabidopsis thaliana
MGVFSNLRGPKIGLTHEELPVVANGSTSSSSSPSSFKRKVSTFLPICVALVVIIEIGFLCRLDNASLVDTLTHFFTKSSSDLKVGSGIEKCQEWLERVDSVTYSRDFTKDPIFISGSNKDFKSCSVDCVMGFTSDKKPDAAFGLSHQPGTLSIIRSMESAQYYQENNLAQARRKGYDIVMTTSLSSDVPVGYFSWAEYDIMAPVQPKTEKALAAAFISNCAARNFRLQALEALMKTNVKIDSYGGCHRNRDGSVEKVEALKHYKFSLAFENTNEEDYVTEKFFQSLVAGSVPVVVGAPNIEEFAPSPDSFLHIKQMDDVKAVAKKMKYLADNPDAYNQTLRWKHEGPSDSFKALIDMAAVHSSCRLCIFVATRIREQEEKSPEFKRRPCKCTRGSETVYHLYVRERGRFDMESIFLKDGNLTLEALESAVLAKFMSLRYEPIWKKERPASLRGDGKLRVHGIYPIGLTQRQALYNFKFEGNSSLSTHIQRNPCPKFEVVFV

SEQ ID NO: 33329 - protein, 1166 aa, Ustilago maydis
MPPLPYRRSSSLLPVTHSGTSTVARATTSLATRTPIHLTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHSSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKSGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAAAASASASASASPAVASTSPAPGDAETGSPTNGKSAVPPAGSTGGTPESILTVSIATARGNSTSTALSAADAAFSEEADS

SEQ ID NO: 33330 - protein, 102 aa, Arabidopsis thaliana
IRSDVASVASADEFEYKDPVDGSISKHQGIRYLFEDGSRLVFRLSGTGSEGATIRLYIEQYEKDASKTGRESQEALSPLVDLALKLSKMEEFTGRSAPTVIT

SEQ ID NO: 33331 - protein, 307 aa, Flavobacterium sp.
MKFQNALETIGNTPVVKINNLFNSDHEIWIKLEKSNPGGSIKDRIALAMIEDAEAKGLLNKDSTIIEPTSGNTGIGLALVAAVKGYKLILVMPESMSIERRKIMEAYGAEFVLTPREKGMKGAIEKANELAEETPNSWIPRQFDNPANVKIHVETTAQEILQDFPEGLDYVITGVGTGGHITGIAKALKEKYPNLKVIAVEPELSPVLSGGSPAPHPLQGLGAGFVPSILDITLLDGVITVGKDEAYEYAINAAKKEGLFCGSFHRSRLSRYRKTFTGNTAWSKNSLPLITTPEKGIFLLRDSSKIL

SEQ ID NO: 33332 - protein, 467 aa, Actinobacillus actinomycetemcomitans
MFISVIMAGGSGSRLWPLSRSMFPKQFLALDKKNNLTMLQATIDRINQMSTSEPIIITNEQHRFIVAEQLREYGVKSRIILEPVGKNTAPAIALAAFEAIKHGEDPILLVLAADHVVLNKEAFQTSVRNALVQAQTGYLVTFGIVPTAPETGYGYIQRGEKITEEAYKVERFVEKPNFETAEKYVASGNCYWNSGCFMFKASCYLHELRKFALEIYEACEKATSNRLKNNDFIRVDVDEFLKCPDDSVDYAVIEKTDKAIVVPMDAGWSDVGSWSALWEVSDKDENQNSYHGDVIMKNTSGCYIYAPNKLVAAVGLENIVIVDTKDAVLVADRSKVQEVKQIVEQLKKEDRREYKEHREIYRPWGRSDAIAQGERYKVNRITVNPGESEETQVHYHRAEHWIVVSGMAKVTKGEQESLITENQSIYIPVGVPHQIANLGKIPLELIEVQSGGYLDDDDVSVLRKYYK

SEQ ID NO: 33333 - protein, 236 aa, Juglans nigra
QQVDGENPNLYFRSEDVILCVLPLFHIYSLNSVFLCGLRAGAAILLMQKFEIVSLLQLIQKYKVSIMPVVPPIVLAISKSPDLDKYDLSSIKMLKSGGAPLGKEIEETVKAKFPNAKFGQGYGMTEAGPVLSMCLAFAKEPFEVKSGACGTVVRNAEMKIIDPETGSSLPRNQPGEICIRGDQIMKGYINDPEATDRTIDREGWLHTGDVGFIDDDDELFIVDRLKELIKYKGFQV

SEQ ID NO: 33334 - protein, 331 aa, Streptomyces limosus
  misc_feature (48)..(48): Xaa can be any naturally occurring amino acid
  misc_feature (277)..(277): Xaa can be any naturally occurring amino acid
IKAEGLPDIGAGEQVKLLGNEVMPFFDQDGVHAVYRDWRALLAEYGEXDRVLVAEAWTPTVERTAHYVRPDEMHQAFNFQYLSTYWDAEALREVIDASLAAMRPVGAPTTWVLSNHDVTRHATPFANPPGGTQLRTPGDRALGLRRARAATLLMLALPGSAYVYQGEELGLPDVTDLPDEVRQDPSYFRAAGQDGFRDGCRVPIPWTVEGPSAGFGPGGSWLPQPAGWGGLSVEAQTGDPTSTLELYRAALAVRREHPGLGAGQEITWREAPEGSSXFARPAFACTANTTGAPVRLPAPGRPLLASQGAAPAVAEDGTVELPADTTVWWTV

SEQ ID NO: 33335 - protein, 509 aa, Streptomyces coelicolor A3(2)
MANSTHTPAERAHRTIHAGGEWLAASSGATREILDPADAVAFAVVAEGDEKDTDLAVAAARRAFDAGDWPHTPVAERAALLRRVAGLLVRDREKLGLLESRDAGKTVEEGRVDIDCVADAFRYFADLVAGEAPGRVVDAGSPEVHSVVVHEPVGVCAMITPWNYPLLQASWKIAPALAAGNTFVIKPSEITPMTTIALIDLLVEAGLPTGVANIVTGPGHTVGARLAEHPDVDLVSFTGGLTSGVKVAQAAAVTVKKVALELGGKNPNVVFADACATEEGFDTAVDQALNAAFMHSGQVCSAGGRLIVEESVRERFVAELARRAERIRLGRGTEEGVECGPLVSAQQRAKTEDYVASALAEGAELRCGGKRPEPSPQRPESGYFYEPTVLDHCHREMRVVREEVFGPVLTVETFRTEDEAVALANDTEYGLAGAVWTADAGRARRVAGRLRHGTVWINDFHPYLPQAEWGGFGKSGVGRELGPAGLAEYRESKHVYQNLAPKPVRWFSG

SEQ ID NO: 33336 - protein, 461 aa, Neurospora crassa
MAFRTALRRVAAVNAAPATRLAGAGAGAATAARRSYATASQLTHPDPTEDSPSGKMVREHVPYMVTTYSRPPPVFVKGKGSYLWDLEDRKYLDFTSGIAVNSLGHCDEEFSKIIAEQAQELVHASNLYYNPWTGALSKLLVESTKASGGMHDASSVFVCNSGSEANEAGIKFARKVGKVLDPSGSKVEIVCFQNAFHGRTMGSLSATPNPKYQAPFAPMVPGFKVGTYNDIAAIPSLVTEKTCSVIVEPIQGEGGVMPATEEFLVALGKRCREVGALLHYDEIQCGLARTGTFWAHSSLPKEAHPDILTTAKAIGNGFPIAATIVNEHVASKIKVGDHGTTFGGNPLACRLAHYIVGRLADKQLQEGVKAKSEVFLRGFEKLRNKFPSLVKEVRGKGLILGLQLSEDPTPVIKAARERGLLVITAGTNTLRFVPSLLVTEGEIEEGLKILEESFEAVMVKA

SEQ ID NO: 33337 - protein, 461 aa, Streptomyces coelicolor A3(2)
MTVSPPSTASTASTGSTGSTGSTATTGPSAGLAAPPSEPSAPRAGTAAPTGRPDIVDLYLKHIGSGRAVMGRVMGGMAEVRSEGVWIHADDGRRFLDFGGYGVFIMGHRHPAVVEAVHRQIDTHPLASRVLLEPVAARAAQALAAHTPPGLDYVHFVNSGAEATEAALKLARAHGLTSVITTRSGFHGKTLGALSVTANTTYQTPFQPLLPDVTQVAYDDPADLEQALAAHRDRACVIVEPVQGEGGVRIPRPGYLGQVRALCRTYGALLVVDEIQTGMGRLGTWWGVDAEDVRPDVLLVGKGLSGGVVPVAAMVATAEAYAPFSRDPYLHTSTFGASPIACAAALATVRAMEEEDTVARAAALGPRILTAVRDVCAPYQGGLVREVRGRGLLIGIEFAEEQAVGELMLELISRGVLVNNSLNSTRVLRLTPPAVVEDSALDLFLTTLGAALRGTADRMTG

SEQ ID NO: 33338 - protein, 411 aa, Pseudomonas putida
MIKAIVIIGAGLAGATAARSLRAQGYLGQIHMVGEEACVAYDRPSLSKDVLAGNLVEPPLIMDPFWYVSADIDLHLGVRVTGIDVVSRQVLFESGETLAYDRLLLATGVRARRMAIMGCELAGIHTLRDSADSFALRQVLEPGKSLVIVGGGLIGCEVATTARKAGTKVTILEAGDELLLRVLGHKIGAWCRTELELMGIRVELNAQASHFEGQGHVRAVVCADGRRIAADVVLISIGAEPADELARAAGIACERGVLVDATGASSCPEVFAVGDVAAWPLRTGGQRSLETYINSQMQAETAAAAMLGTPVPAPQVPTSWTEIAGHRMQMIGDFGGPGEIVLRGDVQNGQPLVLFRLLDGRIEAATAINAAKEFSIATRLVIGRFPVSAKQLQDTSLNLRELLKAKAQLCT

SEQ ID NO: 33339 - protein, 364 aa, Vigna unguiculata
MFLALFFLGTWPALLTMLERRGRLPQHTYLDYSITNFFAALLIAFTFGEIGKGKPDEPNFLAQLAQDNWPSVLFAMGGGVVLSLGNLSSQYAFAFVGLSVTEVITASITVVIGTTLNYFLDDKINKAEILFPGVGCFLIAVFLGFCRFNSSNASDNKAKLSNYTSDYKEVAISSKESDLVKSKDLERGSSSADNVEAGTAVFLLELEERRAIKVFGKSTLIGLALTFSAGLCFSMFSPAFNLATNDQWHTLPNGIPHLTVYTAFFYFSISCFVIAIILNITFLYHPVLNLPKSSLKAYLADSDGRIWALLAGLLCGFGNSLQFMGGQAAGYQQQSLCRHFLCKHFWGVLLFGEYRRSSRKTYIC

SEQ ID NO: 33340 - protein, 174 aa, Hordeum vulgare subsp. vulgare
MEVNVKGNYVQVYVMLPLDAVSVNNRFEKGDELRAQLRKLVEAGVDGVMVDVWWGLVEGKGPKAYDWSAYKQLFELVQKAGLKLQAIMSFHQCGGNVGDAVNIPIPQWVRDVGTRDPDIFYTDGHGTRNIEYLTLGVDNQPLFHGRSAVQMYADYMTSFRENMKDFLDAGVIVD

SEQ ID NO: 33341 - protein, 459 aa, Staphylococcus aureus
MNIIEQKFYDSKAFFNTQQTKDISFRKEQLKKLSKAIKSYESDILEALYTDLGKNKVEAYATEIGITLKSIKIARKELKNWTKTKNVDTPLYLFPTKSYFKKEPYGTVLVIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYICKSTRLESGVHLPPYKGKFKYIKAFFKN

SEQ ID NO: 33342 - protein, 511 aa, Saccharomyces cerevisiae
MAYVLTETSAGYALLKASDKKIYKSSSLIQDLDSSDKVLKEFKIAAFSKFNSAANALEEANSIIEGKVSSQLEKLLEEIKKDKKSTLIVSETKLANAINKLGLNFNVVSDAVTLDIYRAIKEYLPELLPGMSDNDLSKMSLGLAHSIGRHKLKFSADKVDVMIIQAIALLDDLDKELNTYAMRCKEWYGWHFPELAKIVTDSVAYARIILTMGIRSKASETDLSEILPEEIEERVKTAAEVSMGTEITQTDLDNINALAEQIVEFAAYREQLSNYLSARMKAIAPNLTQLVGELVGARLIAHSGSLISLAKSPASTIQILGAEKALFRALKTKHDTPKYGLLYHASLVGQATGKNKGKIARVLAAKAAVSLRYDALAEDRDDSGDIGLESRAKVENRLSQLEGRDLRTTPKVVREAKKVEMTEARAYNADADTAKAASDSESDSDDEEEEKKEKKEKKRKRDDDEDSKDSKKAKKEKKDKKEKKEKKEKKEKKEKKEKKEKKSKKEKKEKK

SEQ ID NO: 33343 - protein, 471 aa, Aphanopetalum resinosum
  misc_feature (299)..(299): Xaa can be any naturally occurring amino acid
TEPKASVGFKAGVKDYKLTYYTPDYETKDTDILAAFRVTPQPGVPPEEARAAVAAESSTGTWTTVWTDGLTSLDRYKGRCYHIEPVPGEETQFIAYVAYPLDLFEEGSVTNMFTSIVGNVFGFKALRALRLEDLRIPVAYVKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMMKRAVFARELGVPIVMHDYLTGGFTANTSLAHYCRDNGLLLHIHRAMHAVIDXQKNHGMHFRVLAKALRMSGGDHIHAGTVVGKLEGEREITLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREACKWSPELAAACEVWKEIKFEFEAMDTL

SEQ ID NO: 33344 - protein, 331 aa, Triticum turgidum
MTQNLGISVPIMSSSPMFANAPPEKKGVKNFAIDFLMGGVSAAVSKTAAAPIERVKLLIQNQDEMIKAGRLSEPYKGIGDCFGRTIKDEGFGSLWRGNTANVIRYFPTQALNFAFKDYFKRMFNFKKDKDGYWKWFGGNLASGGAAGASSLFFVYSLDYARTRLANDAKASKGGGDRQFNGLVDVYRKTLKSDGIAGLYRGFNISCVGIIVYRGLYFGLYDSLKPVLLTGTLQDNFFASFALGWLITNGAGLASYPIDTVRRRMMMTSGEAVKYKSSLDAFQQILAKEGAKSLFKGAGAKLLRAIAGAGVLSGYDQLQILFFGKKYGSGGA

SEQ ID NO: 33345 - protein, 465 aa, Klebsiella pneumoniae
MHDKYDVLIIGGGPGGYVAAIRAGQLGLRTVLVEKQHLGGICLNWGCIPTKALLHGAEVAHTITHASQLGISVGEVNVDLQKLVQFSRTVSQQLTAGVAYLLKKNGVRVIDGTARLRGKGQITVEDARGEARDYRADHVILATGARPRALPGIAPDGEHIWTYFEALRPKLLPKSLLIIGSGAIGVEFASLYNDLGCKVTLVELASQILPVEDAEVSAAVRKSFEKRGIQIHTQTLVTQVQLTDTGVRCTLNNTGGEYSQDVERVLLAVGVQPNIEDLGLETLGVELDRGFIKTDAACRTNVFGLYAIGDVAGPPCLAHKASHEGVLCVETLAGVEGAHPLDRDYVPGCTYARPQVASLGLTESTALARGRPIRIGKFSYQSNGKALVSGETEGFVKTIFDAETGELLGAHMVGAQVTEQIQGFGIARHLEATDESLLSMIFAHPTLSEAMHESILAACDQPLHQ

SEQ ID NO: 33346 - protein, 412 aa, Neurospora crassa
MSTKLCQRIARTATLSPTSLVPRSSRLIPIVSSAAVRPSSAIPTRRPFSTTESRYLANVQAGMDKIRDAIAENFGGPAHNIGTTSFSLDDTPDLSGKVAVITGGSEGIGYGVAYTLIKHNLSKLFILSRKREVFDGALASIASELGQDKADRVHWIQCNLEDWAQTAVVAEQIKKDTDRLDILVNNSGRGIMTAGLTSYGVDKHMATNHMGHVVLTSHLLPLLQKTAEETGETVRISNQSSNLHSAAPKGTQFKSLEEINEDVGPNGQYGRSKLAGILYARYFDREVTRKMEGSKGRVVMNATHPGFVSTKQSVKDIHEPYPISGFAISHLAEPFKKDQFEGAVPTVYAVTMANEGGQWICAPAKAEAGTDLAQSDELADNLMELTRKIISEKTWPKSVAKGCPMDDVVVHV

SEQ ID NO: 33347 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIAKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 33348 - protein, 293 aa, Zea diploperennis
IIESVGEGVTDVAPGDHVLPVFTGECKECAHCKSAESNMCDLLRINTDRGVMISDGKSRFSINGKPIYHFVGTSTFSEYTVMHVGCVAKINPQAPLDKVCVLSCGISTGLGASINVAKPPKVSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTRPMNFLNERTLKGTFFGNYKPRTDLPNVVELYMKKELEVEKFITHSVPFAEINKAFDLMA

SEQ ID NO: 33349 - protein, 293 aa, Zea luxurians
IIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 33350 - protein, 506 aa, Lycopersicon esculentum
MDKKHLCAALLLWAIACSALPASSGDLFRIGLKKHRLDVDSIKAARVAKLQDRYGKHVNGIEKKSSDSDIYKVPLKNYLDAQYYGEIGIGSPPQKFKVIFDTGSSNLWVPSSKCYFSIACWIHSKYQASKSSTYTRDGESCSIRYGTGSISGHFSMDNVQVGDLVVKDQVFIEATREPSITFIVAKFDGILGLGFQEISVGNTTPVWYNMVGQGLVKEPVFSFWFNRDANAKEGGELVFGGVDPKHFKGNHTCVPLTQKGYWQFNMGDFLIGNTSTGYCAGGCAAIVDSGTSLLAGPTTIVTQINHAIGAEGIVSMECKTIVSQYGEMIWDLLVSGIRPDQVCSQAGLCFLDGSQHVSSNIRTVVERETEGSSVGEAPLCTACEMAVVWMQNQLKQEQTKEKVLEYVNQLCEKIPSPMGESAIDCNRISSMPDITFTIKDTAFVLTPEQYILKTGEGVATICVSGFAALDVPPPRGPLWILGDVFMGPYHTVFDYGKSQVGFAEAA

SEQ ID NO: 33351 - protein, 445 aa, Hevea brasiliensis [sequence omitted]

SEQ ID NO: 33352 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 33353 - protein, 398 aa, Vigna radiata
MAVQAASLVSGYFSVAKEGKPGMSLRNTTMFGLSLEDALKADFSSLSFSCKREFQKKVCPLRVQSVATTPGVTKASPEGKKTLRKGSVIITGASSGLGLATAKALAETGKWHVIMACRDFLKAERAAKSSGISKENYTVMHLDLASLDSVRQFVDNFRQSGRPLDVLVCNAAVYLPTASEPTHTADGFELSVGTNHLGHFLLSRLLLEDLNKSDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKFITKGFVSEDESGKRLAQVVSDPSLTKSGVYWSWNKASASFENQLSQEASDADKARKVWEISEKLVGLA

SEQ ID NO: 33354 - protein, 474 aa, Vigna radiata
MVSLPTLLLLFAASAAAIFLHRAFSRRKFRLPPGSYGLPFIGETLQLISAYKSSNPEPFMDERVRRYGSIFMTHVFGEPTVFSADPELNRFILQNEGKLLDCSYPGSISNLLGKHSLLLMKGALHKRMHSLTMSFANSSIIKDHLLHHIDRLIGLNLDTWSDRVTLMDQAKKITFELTVKQLMSFDPDEWTESLRKEYVLVIEGFFTLPLPLFSTTYRRAIKARTKVAEALTLVVRQRREEYNQGKEKKSDMLGALLASGDHFSDDQIVDFLLALLVAGYETTSTIMTLAVKFLTETPLALAQLKEEHDQIRARSDPGAPLEWTDYKSMVFTQHVVNETLRVANIIGGIFRRATTDIDIKGYTIPKGWKVFASFRAVHLNPEYYKDARTFNPWRWQSNSSEAANPANVYTPFGGGPRLCPGYELARVVLSVFLHRIVTRFSWVPAEEDKLVFFPTTRTQKRYPIIVKRRNANHV

SEQ ID NO: 33355 - protein, 479 aa, Streptococcus mutans
MMSYTFPENFLWGGATAANQFEGAYNQDGKGLSVQDVTPKGGVAQSGSSSPLITEKPTEDNLKLVGIDFYNRYKEDIALFAEMGFKVFRLSIAWTRIFPNGDDLEPNEAGLAFYDKVFDELAKYDIEPLVTLSHYETPLHLARKYNGWANRELIAFYERYARTVFTRYKDKVKYWLTFNEVNSVLHAPFMSGGIITDPEQLSKQDLYQAVHHELVVSALATKVGHEINPDFKIGCMVLAMPAYPMTADPLDQLAVREFENQNYLFSDLHARGKYPNYIKRYFKDNNIDIKMGEGDKELMLENTVDFISFSYYMSVAAAHNPEDYNSGRGNVLGGLSNPYLQASEWGWQIDPVGLRLVLNDSYDRYQLPLFIVENGLGAKDVLVQGPDGPTVEDDYRIDYLQKHLMQVGEALQDGVDLLGYTTWGPIDLVSESTVELSKRYGFIYVACNDDGSGSLARYKKKSFAWYKKVIETNGASLYE

SEQ ID NO: 33356 - protein, 249 aa, Hordeum vulgare
MVKLAFGSFGDSFSATSIRSYVAEFIATLLFVFAGVGSAISYGQLTQGGALDPAGLVAIAIAHAFALFVGVAMAANISGGHLNPAVTFGLAVGGHVTILTGLFYWVAQLLGASVACLLLQFVTHAQAMPTHAVSGISEVEGVVMEIVITFALVYTVYATAADPKKGSLGTIAPMAIGFIVGANILAAGPFSGGSMNPARSFGPAVAAGNFSGHWVYWVGPLIGGGLAGLVYGDVFIASYQPVGHQQEYP

SEQ ID NO: 33357 - protein, 491 aa, Pseudomonas sp.
MKQYRNFVDGKWVESSKTFQDVTPIDGSVVAVVHEADRDLVDAAVKAGHRALEGEWGRTTAAQRVDWLRRIANEMERRQQDFLDAEMADTGKPLSMAATIDIPRGIANFRNFADILATAPVDSHRLDLPDGAYALNYAARKPLGVVGVISPWNLPLLLLTWKVAPALACGNAVVVKPSEDTPGTATLLAEVMEAVGIPPGVFNLVHGFGPNSAGEFISQHPDISAITFTGESKTGSTIMRAAAEGVKPVSFELGGKNAAVIFADCDFEKMLDGMMRALFLNSGQVCLCSERVYVERPIFDRFCVALAERIKALKVDWPHETDTQMGPLISSKHRDKVLSYFELARQEGATFLAGGGVPRFGDERDNGAWVEPTVIAGLSDDARVVREEIFGPICHVTPFDSESEVIRRANDTRYGLAATIWTTNLSRAHRVSELMRVGISWVNTWFLRDLRTPFGGAGLSGIGREGGMHSLNFYSELTNVCVRIDKESPDV

SEQ ID NO: 33358 - protein, 348 aa, Kluyveromyces marxianus
MSIPTTQKGVIFYENGGQLYYKDIPVPKPKSNELLINVKYSGVCHTDLHAWKGDWPLDTKLPLVGGHEGAGVVVAMGDNVKGWKIGDLAGIKWLNGSCMNCEECELSNESNCPDADLSGYTHDGSFQQYATADAVQAAHIPAGTDLAQVAPILCAGVTVYKALKTAEMKAGDWVAISGAAGGLGSLAVQYAKAMGFRVLGIDGGEGKEELFKSLGGEVFIDFTKSKDIVGEVIKATNGGAHGVINVSVSEKAIESSIEYCRSNGTVVLVGLPKDAKCKSDVFNQVVKSIHIVGSYVGNRADTREALDFFCRGLVNAPIKVVGLSTLPEIYEKMEQGKVLGRYVVDTSK

SEQ ID NO: 33359 - protein, 506 aa, Azotobacter vinelandii
MRYAHPGSEGAIVSYKVRYGNYIAGQFVPPVKGQYFTNSSPVTGEEFTEFPRSTAEDIEKALDAAHAAAGAWGRTSVQERAAVLLKIADRIEQNLEVLAVTETWDNGKPVRETLNADVPLSADHFRYYAGCIRAQEGSAGEINENTVAYHFHEPLGVVGQIIPWNFPLLMAAWKLAPALAAGNCIVLKPAEQTPLSITVLVELIGDLLPPGVLNIVQGFGREAGEALATSKRIAKIAFTGSTPVGAHILKCAAENIIPSTVELGGKSPNIFFEDIMQAEPAFIEKAAEGLVLAFFNQGEVCTCPSRALIQESIYDDFMKVVMKKVGQIKRGHPLDTDTMVGAQASSQQFEKILSYLEIARGEGAEVLTGGAAERLEGSLASGYYIQPTLLKGHNKMRVFQEEIFGPVVGVTTFKDEAEALAIANDTEFGLGAGLWTRDINRAYRMGRGIQAGRVWTNCYHLYPAHAAFGGYKKSGVGRETHKMMLDHYQQTKNLLVSYDINPLGFF

SEQ ID NO: 33360 - protein, 245 aa, Vibrio cholerae O1 biovar eltor str. N16961
MIKLQNIHKRFGTSEVLKGIDLEIQRGEIVVIIGSSGTGKSTLLRCVNFLEQADQGSIRIDELTVDTQKHTKADVLALRRKTGFVFQNYALFAHLTARQNIAEALITVRGWKKAQAHQRAQQILDDIGLGDKGDSYPAALSGGQQQRVGIGRAMALQPELLLFDEPTSALDPEWVGEVLALMKKLATQHQTMLVVTHEMQFAKEVADRVIFMAEGKIVEQGSPQDIFDHPQDPRLRKFLNQVGIR

SEQ ID NO: 33361 - protein, 466 aa, Vibrio cholerae O1 biovar eltor str. N16961
MGQKNHFDVIVIGSGPGGEGAAMGLTKGGKNVAIIEKESSVGGGCTHWGTIPSKALRHAVSRIIEFNSNPLFCKNNSSIHATFSTILSHAKSVIDKQTRLRQGFYDRNQCTLIFGAAHFIDAHTVAVKKADGSIDTYSADKFVIATGSRPYHPKDVDFGHPRIYDSDSILNLEHDPRHIIIYGAGVIGCEYASIFRGLDVKTDLINTRDRLLSFLDNEVSDALSYHFWNSGVVIRNDETYDKVEGTSDGVIVHLKSGKKMRADCLLYANGRTGNTDKLNLESVGLQADSRGQLVVNANYQTQVEHIYAVGDVIGYPSLASAAYDQGRFVAQAIIHGQAAHLLTEDIPTGIYTIPEISSVGRTEQELTAAKVPYEVGRASFKHLARAQIAGKDIGSLKILFHRETKEILGIHCFGERAAEIIHIGQAIMEQKGEANTIEYFVNTTFNYPTMAEAFRVAALNGLNRLF

SEQ ID NO: 33362 - protein, 454 aa, Vibrio cholerae O1 biovar eltor str. N16961
MEKVMATHFDYLCIGGGSGGIASANRAAMYGAKVALIEAKDLGGTCVNVGCVPKKVMWHGAQIAEAMHLYAEDYGFDVDVKNFNWAKLVESRQAYIGRIHQSYDRVLGNNKVHVIKGFAKFVDAKTVEVNGELYTADHILIAVGGRPSIPNIPGAEYGIDSNGFFELSEQPKRVAVIGAGYIAVEIAGVLNALGTETHLFCRKESPLRSFDPMIIETLVEVMNSEGPQLHTHSVPKQVVKEADGSLTLHLENGQTYNVDTLIWAIGRHPATDAINLAATGVATNEQGYIKVDEFQNTNVAGIYCVGDIMEGGIELTPVAVKAGRQLSERLFNNKLNAKMDYQLVPTVVFSHPPIGTIGLTEPQAIAQYGAENVKVYKSSFTAMYTAVTSHRQPCKMKLVCAGPEETVVGLHGIGFAVDEMIQGFGVAMKMGATKADFDSVVAIHPTGSEEFVTM

SEQ ID NO: 33363 - protein, 465 aa, Vibrio cholerae O1 biovar eltor str. N16961
MFIPVIMAGGSGSRLWPLSRSAFPKQFLSLDSSSQHTMLQATIERLQGLPIAEPIVISNEDHRFIVAEQIRRYGKKSRIILEPAGRNTAPAIALAAFTAIEQEDDPVLLVLAADHFVKNKSAFQAAISQAAQQAEAGKLATFGIVPTTPETGYGYIHRGEEVTQGTYEINSFVEKPQLNIAEQYLASGEYYWNSGCFMFKASVFLNELKQHSPEIYRQCELAMQGLSHDYDFIRVGVEEFLKCPDDSIDYAVMEHTKLGVVVSMDAGWSDVGSWSALWEVSDKDADGNVCQGDAILSGTSNCYIYAPNKLVAAVGLKDIVVVETKDAVLVADKNQVQEVKKIVEHLKAENRAEYREHRERYRPWGKSDAIDKGERYKVNRITVEPGKKQSLQMHYHRAEHWVVVSGTAKVTCEGNVKVITENQSLYIPIGTNHMIENPGKIPLELIEIQSGSYLNEDDVVRFEDK

SEQ ID NO: 33364 - protein, 510 aa, Vibrio cholerae O1 biovar eltor str. N16961
MSAKKPMALVILDGWGYREDNANNAINNARTPVMDSLMANNPHTLISASGMDVGLPDGQMGNSEVGHTNIGAGRIVYQDLTRITKAIMDGEFQHNKVLVAAIDKAVAAGKAVHLMGLMSPGGVHSHEDHIYAAVEMAAARGAEKIYLHCFLDGRDTPPRSAEASLKRFQDLFAKLGKGRIASIVGRYYAMDRDNNWDRVEKAYDLLTLAQGEFTYDSAVEALQAAYAREENDEFVKATEIRAAGQESAAMQDGDALLFMNYRADRARQITRTFVPDFAGFSRKAFPALDFVMLTQYAADIPLQCAFGPASLENTYGEWLSKAGKTQLRISETEKYAHVTFFFNGGVENEFPGEERQLVASPKVATYDLQPEMSSKELTDKLVAAIKSGKYDAIICNYPNGDMVGHTGVYEAAVKACEAVDECIGRVVEAIKEVDGQLLITADHGNAEMMIDPETGGVHTAHTSLPVPLIYVGNKAISLKEGGKLSDLAPTMLALSDLDIPADMSGQVLYS

SEQ ID NO: 33365 - protein, 259 aa, Vibrio cholerae O1 biovar eltor str. N16961
MKSLFKVSLLAATVMLAVGCQKEEAPKTETTPAAQTAAAKTVEFKSEDDKAAYAIGVSFANYLKTSIEKPSEIGIDLNKDLVLKGIEHVFAGNPEMSEEETRAALEALDKRVAETMQAKAAEKAAENKKKGDEFRAQFEKESGVVKTQSGLLYQVMTPAEGDKPKDTDTVQVHYKGTLIDGSQFDSSYERGEPATFPLNRVIPGWTEGVQLMSVGSKFKLVIPPELAYGEQDTPTIPANSTLVFEVELLKIENGKDAAQ

SEQ ID NO: 33366 - protein, 316 aa, Vibrio cholerae O1 biovar eltor str. N16961
MRQTNNKESTMKPTADILASIIEEVRPLTSKGIVADYIPALAKVPSDKLGIAVFTNQGEVITAGDAQEGFSIQSISKVLSLTLAMGLYQPDELWSRVGKEPSGQAFNSLIQLEMEQGIPRNPFINAGAIVVCDMLQSRLSAPRQRLLEFVRQLSGEPQIAYDKVVAASEMMHSDRNAAIAYLMRSFGNFHNEVIPVLHNYFHACALKMSCVELAKTFSYLANKGVSVVTGETVITPTQSKQTNALLATCGLYDGAGEFAYRVGMPGKSGVGGGIIAVVPGEMTIAVWSPALDQSGNSLAGTRALELLAQRIGRSIF

SEQ ID NO: 33367 - protein, 392 aa, Vibrio cholerae O1 biovar eltor str. N16961
MRGQIMSVIKMIDLDLAGKRVFIRADLNVPVKDGKVTSDARILASLPTIKHCLEAGAKVMVTSHLGRPTEGEYAEEFSLLPVVNYLNDALDCEVRLVKDYLDGVELNAGELVVLENVRFNKGEKKNEEALSKKYAALCDVFVMDAFGTAHRAQASTHGVGMFAPIACAGPLLADELEALGKAMDKPARPMVAIVGGSKVSTKLTVLESLSKIADQLVVGGGIANTFIAAAGHNVGKSLYEADLVETAKKLMEECAIPVATDVACAKAFDENAEAEIKHVSEVQDDDMIFDLGPNSTAELAEILKNAKTILWNGPVGVFEFKNFEAGTRGIAEAIAQSEGFSVAGGGDTLAAIDKFGIKADVSYISTGGGAFLEFVEGKKLPAVEMLEARAKA

SEQ ID NO: 33368 - protein, 470 aa, Vibrio cholerae O1 biovar eltor str. N16961
MKKTKIVCTIGPKTESVEKLTELVNAGMNVMRLNFSHGDYVEHGTRITNFRKVMEVTGKQLAILLDTKGPEIRTIKLENGDDVDLVAGQEFTFTTDTKVVGNKERVAVTYSGFAKDLNVGNRILVDDGLIEMEVLATTDTEVKCKVLNNGALGENKGVNLPGVSVNLPALSEKDKNDLKFGCEQGVDFVAASFIRKGSDVKEIREVLASHGGQNIQIISKIENQEGLDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVKIMAQIAERTDPVLKAELGSRLDSPRLRITEAVCKGAVDTAEKLAAPLIIVATEAGKSARSVRKYFPTANIIAVTTNKKTAAQLVLSKGVTPVVVDAIDNTDAFYHLGKEIALQSGLGKKGDIVVMVSGALVASGTTNTASVHVL

SEQ ID NO: 33369 - protein, 295 aa, Vibrio cholerae O1 biovar eltor str. N16961
MSDFPTLEDYVGQTPLVRLQRLNAGRSTVLVKLEGNNPAGSVKDRPALNMIVQAEARGSLQPGDTIIEATSGNTGIALAMAAAIKGYKMILIMPDNATQERKDSMRAYGAELILVSKEQGMEGARDLALQMQQEGKGKVLDQFNNLDNPDAHYRSTGPEIWQQSQGKITHFVSSMGTTGTIMGVSRYLKQQNPQIQIIGLQPSEGSAIPGIRRWPQAYLPGIFDAARVDQVLDVTQTDAEQTARALAREEGICAGVSSGGAVFAALQIAQQNPGSVVVAIVCDRGDRYLSSGLFS

SEQ ID NO: 33370 - protein, 376 aa, Vibrio cholerae O1 biovar eltor str. N16961
MSIRLDNISKHFGQFQALAPLSLKIEDGEMIGLLGPSGSGKTTLLRIIAGLEGADSGTIHFRNRDVTNVHVRDRRVGFVFQNYALFRHMTVADNVAFGLQVMERAQRPNPAEIQKRVKQLLEIVQLGHLAHRYPEQLSGGQKQRIALARALATQPEVLLLDEPFGALDAKVRKELRRWLRSLHDELGFTSVFVTHDQDEALELSDRVVVMSNGRIEQIDSPVELYAQPNSRFVFDFFGNVNQFAGEWQNGQWVNGSAFIQPPESDATRQSGLLYVRSHELALSDKENSQASLPFEVVSINPVGAEVRVELASVGWQSQELWEAKLSHRSLSEKRLSRGDQVFATPQVGYFFASEGQSSPSVLRWPFLAPGSLMFEI

SEQ ID NO: 33371 - protein, 337 aa, Vibrio cholerae O1 biovar eltor str. N16961
MVYIQRDASASLFIRAIGIVEMENKRIVITQFGTPDVLAMQSAPIPTPKAGEVLVKVAFASVNPIDVKTRAGLGWAAAQNKDKLPWTPGYDISGRVVALGEGVSRLKERDNVAGFIGFPLRGGGYSQYVCVPEQELSLVPDAVTLEAAAALPLAGQTAAQALSKAQVQEGERVLILAGAGGVGHIAVQIALAAKTEVFTTCSEANLDYLATLGAHAINYQFAPVSQRLEEVDVLIDLVGGEAALDALKCLKDNARVITVPTLTAELICEKAKLLGFEATGMLVDPNPEQLDTMLYMVSVGLLKIEIQHIYSLLDAAQAHEQIESGHTRGKLLLDMKC

SEQ ID NO: 33372 - protein, 177 aa, Vibrio cholerae O1 biovar eltor str. N16961
MKHTVEVMISEQEVAQRIRELGQQITEHYQGSSDLVLVGLLRGSFVFMADLARQIHLTHQVDFMTASSYGNSMQSSRDVRILKDLDDDIKGKDVLLVEDIIDTGNTLNKVKEILALREPKSIRICTLLDKPTRREVDVEVNWVGFEIPDEFVVGVGIDYAQKYRHLPYIGKVVPLAE

SEQ ID NO: 33373 - protein, 343 aa, Vibrio cholerae O1 biovar eltor str. N16961
MSCALLIENLTCQYDAQTVLKSLSLQVNPGEIVCLLGASGCGKTTLLKAIAGLLPLASGQLSLNCVTLDDGKRWLPPEQRNIGMIFQDYALFPHLTVAQNVGFGLDAMPAKQKEAKIAEMLALVHLDAFAERYPHQLSGGQQQRVAIARALAYKPDLLLLDEPFSNIDTQVRHELIIEIRKIFKQQGVTAIFVTHSREEAFAFADKMAVMNRGVIEQYGTAAELYYQPSSQFVADFLGGGSYLSAKRISETQYQTALGVVEAIARQPIAVEAECKLLLRPQQVQIRAEEESSVTVTEQQFMGDHCRYLIDAHGTQLIATSSQPLELGQAVSVNIDTQGVLAFA

SEQ ID NO: 33374 - protein, 470 aa, Vibrio cholerae O1 biovar eltor str. N16961
MIKFGTGGWRAFIGEEFTKDNVRLVAQALANIIHHEQAANEGFVIGYDRRFLSDKAGRWFAEVLAANGVVVSFIDKFVPTPVVMFKAKAMDCAYSACITASHNPADYNGIKVFIRGGRDADEVITQKIEQQIATLTLQDVKSIDFDQAVNDKLIDIINPMNEFVDSIINFIDIEAIKKANLRVLIDPMFGVAKNALQTVLINGRCDVDVINDGKNPDFGGLMPSPSAATLYRLKHLVKHEGYDIGIGTDGDADRLGIIDEKGNFIHPNEVLILLYYYLLEYKGWKGSVVRNIATTHLLDKIAADHGERCFEVPVGFKHISSQMEADDSLIGGESSGGLTIRGHIKGKDGVFASSLLVEMISVTGKKLSELLTEIYDRYGYAYTAEGDCKFKPAQRDEIYNKVYIEKKLPEFEFDIDKVSYEDGAKVYFKNGGWVIARFSGTEPLLRIFAEMADKDTAERVLQQMKAFLAL

SEQ ID NO: 33375 - protein, 432 aa, Vibrio cholerae O1 biovar eltor str. N16961
MTKSAELYQKAQTTIPGGVNSPVRAFNGVGGSPIFIDRADGALIFDADGKAYIDYVGSWGPMILGHNHAVIREAVIQAAQRGLSFGAPTEMEITMAELVSELVPSMEQLRMVNSGTEATMSAIRLARGYTGRDKIIKFEGCYHGHADSLLVKAGSGALTLGQPSSPGVPADFAKHTLTARFNDLDSVRELFAANQGEIACIIVEPVAGNMNCIPPVEGFHEGLREICDQEGALLIFDEVMTGFRVALGGAQAHYNIKPDLTTLGKVIGGGMPVGAFGGRREVMQYIAPTGPVYQAGTLSGNPIAMAAGYACLNLLREEGNEKRLAAKTKQLADGFKSLADQHGIPLLVHQVGGMFGFFFTEQETVTCYEDVARCDVERFKRFFHLMLQHGVYLAPSAFEASFTSLAHGSKEIEATLEAADRSFAILAAEAKA

SEQ ID NO: 33376 - protein, 446 aa, Vibrio cholerae O1 biovar eltor str. N16961
MSDKRRYFGTDGVRGKVGQYPITPDFVLKLGWAAGRVLAKQGTRKVIIGKDTRISGYMLESALEAGLAAAGLKATFTGPMPTPAVAYLTQTFRAEAGIVISASHNPYYDNGIKFFSYEGTKLPDDIELAIEAELDKDIECVESAELGKASRMVDAAGRYIEFCKSTFPSKLSLSGLKLVVDCANGATYHIAPNVFRELGAEVIAMGVEPNGLNINDQVGATDVRALQKRVVEEHAHLGLAFDGDGDRIIMVDHLGNKVDGDQIAYIIARDALRRGELKGGVVGTLMTNLGMENGLKQLGIPFVRAAVGDRYVMEKLLEKGWKIGAENSGHVILLDKVTTGDAIVAGLQVLASVVGSEMTLHELAKGMTLYPQVLENVRFAGDNNPLEADAVKAAVSEVEAELGSKGRVLLRKSGTEPLIRVMVEGEDETLVKQSALKIAQAVKDNC

SEQ ID NO: 33377 - protein, 193 aa, Vibrio cholerae O1 biovar eltor str. N16961
MLRLGICGKINAIKEFTRGLPVIDGDGYRLNVGIVICNNHGQVFWAKRYGQHSWQFPQGGIDDGESPEQAMFRELYEEVGLTKKDVKVIATSRHWLRYKLPKRLVRWDSQPVCIGQKQKWFLLRLECDESKINMQRGSSPEFDGWRWVSYWYPVRQVVSFKRDVYRRAMKEFASLAMPFKERKVKGKRNTHRG

SEQ ID NO: 33378 - protein, 391 aa, Vibrio cholerae O1 biovar eltor str. N16961
MTDKQYSLDDIRLRLNELDDQLLNLLSERRKMSIEVAKSKVETAKPVRDPAREQQLLVKLINAGKEKYQLDPQYITKIFHTIIEDSVLLQQSYLQNLANPQSRKPLARVAFLGAKGSYSHLATREYFSRKNTELIELNCDHFKEVARTVESGHADYGVLPIENTSSGSINEVYDLLQHTTLYIVGELTQPIEHCLVATQEIRLEDLKVLYSHPQPHQQCSEFLSRLKGVKLESCASTADAMKKVQELNRADVAAIGNSASGKLYGLQPIQGNIANQTENHTRFIVVARKPVDVSPQIPAKTTLIMSTSQEAGSLVSTLLVLQRYGINMTKLESRPIMGNPWEEMFYVDLEAHIDSDEMQQALAELTQLTRHLKVLGCYPSENVKPTQVKFI

SEQ ID NO: 33379 - protein, 171 aa, Vibrio cholerae O1 biovar eltor str. N16961
MNYFELFGLPIQFELDGSLLSSQFRALQKRFHPDNFATASERDRLMAVQQAAQINDAYQTLKDPLRRAEYLLSLQGIEMNAEQQTLQDPMFLMEQMELREELESVTACADPEAALVAFDTKVTAMQRHYLAQLQGQLAQSEWLAAADQIRKLKFIAKLKNEVERVEDQLLG

SEQ ID NO: 33380 - protein, 489 aa, Vibrio cholerae O1 biovar eltor str. N16961
MHMLRIAKEALTFDDVLLVPAHSTVLPNTADLRTRLTKNIALNIPMVSASMDTVTEARLAIALAQEGGIGFIHKNMSIEQQAAQVHQVKIFEAGVVTHPVTVRPEQTIADVMELTHYHGFAGFPVVTENNELVGIITGRDVRFVTDLTKSVAAVMTPKERLATVKEGATGAEVQEKMHKARVEKILVVNDEFQLKGMITAKDFHKAESKPNACKDEQGRLRVGAAVGAAPGNEERVKALVEAGVDVLLIDSSHGHSEGVLQRIRETRAAYPHLEIIGGNVATAEGARALIEAGVSAVKVGIGPGSICTTRIVTGVGVPQITAIADAAGVANEYGIPVIADGGIRFSGDISKAIAAGASCVMVGSMFAGTEEAPGEVILYQGRSYKAYRGMGSLGAMSKGSSDRYFQTDNAADKLVPEGIEGRIAYKGHLKEIIHQQMGGLRSCMGLTGSATVEDLRTKAQFVRISGAGMKESHVHDVQITKEAPNYRLG

SEQ ID NO: 33381 - protein, 322 aa, Vibrio cholerae O1 biovar eltor str. N16961
MSKIYEDNSLTIGNTPLVRLNKVSNGKVLAKIEARNPSFSVKCRIGANMIWEAEKQGKLKPGVELVEPTSGNTGVALAFVAAARGYKLTLTMPESMSLERRKLLKALGANLELTEAAKGMKGAIAKAEEIVASNPEKYLLLQQFNNPANPQIHEKTTGPEIWDATDGQIDVFVAGVGTGGTLTGTSRYIKGTQGKAILSVAVEPAESPVITQALAGEEIKPAPHKIQGIGAGFIPGNLDLSLIDRVERVTSDEAIEMARRLMEEEGILAGISSGAAVVAANRIAQLPEFEGKTIVTVLPSSGERYLSTALFAGIFTDKENQQ

SEQ ID NO: 33382 - protein, 214 aa, Vibrio cholerae O1 biovar eltor str. N16961
MRIILLGAPGAGKGTQAQFIMEKFGIPQISTGDMLRAAIKAGTELGKQAKAVIDAGQLVSDDIILGLIKERIAQADCEKGFLLDGFPRTIPQADGLKEMGINVDYVIEFDVADDVIVERMAGRRAHLPSGRTYHVVYNPPKVEGKDDVTGEDLVIREDDKEETVRARLNVYHTQTAPLIEYYGKEAAAGKTQYLKFDGTKQVSEVSADIAKALA

SEQ ID NO: 33383 - protein, 428 aa, Vibrio cholerae O1 biovar eltor str. N16961
MMMDLAFDRCHIWHPYTSTLTPLTCYPVSRADGVMITLEDGRSLVDGMSSWWAAIHGYNHPKLNQAAHQQIEQMSHIMFGGLTHQPAIELCQKLLKLAPNNLQQVFLADSGSVAVEVSLKMALQYWHSKGQPRAKFLTLRHGYHGDTFAAMSVTDPDNSMHSLYKGFLPEHIFANSPEGGFFDAWDERDIADFRHKLTEHHHQIAAVILEPIVQGAGGMRIYHPEFLRQVRALCDEFGVLLILDEIATGFGRTGKLFACEHAGIQPDILCVGKALTGGYMTLSATLTTQQVADTVCAGEAGCFMHGPTFMGNPLACAVASASLSLIEQGDWQQQVANIEAFFAEQLPKLNDSPRVKQTRWLGAIGVVETHLPVNMEVIQALFVEHGVWIRPFGRLIYLMPPYISQPEHLQKLVDAMAAALNQPDCFKQ

SEQ ID NO: 33384 - protein, 210 aa, Vibrio cholerae O1 biovar eltor str. N16961
MNPASPFATLTDRIDWQKVDGLVPAIVQDFQSSQVLMMGYMNPEALQKTLDTQQVTFFSRSKQRLWTKGETSGHVLQLKNIALDCDQDTLLVKVNPIGPTCHTGTVTCWDGDAQEESQMVWLHQLEQLLAERKNADPSSSYTASLYARGTKRIAQKVGEEGVEVALAATAGDKEELICESADLMYHLLVLLQEQGLAMNDVINKLKERHK

SEQ ID NO: 33385 - protein, 268 aa, Vibrio cholerae O1 biovar eltor str. N16961
MNRYQALFQRLSAAQQGAFVPFVTIGDPNPEQSLAIMQTLIDAGADALELGMPFSDPLADGPTIQGANLRALAAKTTPDICFELIAQIRARNPETPIGLLMYANLVYARGIDDFYQRCQKAGVDSVLIADVPTNESQPFVAAAEKFGIQPIFIAPPTASDETLRAVAQLGKGYTYLLSRAGVTGAETKANMPVHALLERLQQFDAPPALLGFGISEPAQVKQAIEAGAAGAISGSAVVKIIETHLDNPAKQLTELANFTQAMKKATKI

SEQ ID NO: 33386 - protein, 251 aa, Vibrio cholerae O1 biovar eltor str. N16961
MTQQLNQDFMIQIKDMNKWYGEFHVLKNINLNVKKGERIVICGPSGSGKSTMIRCINRLEEHQKGQIIVAGNELTEDLKNIELVRREVGMCFQHFNLFPHLTVLENCTLAPIWVKKMPKDKAEEIAMKYLTRVRIPEQADKYPGQLSGGQQQRVAIARSLCMNPQIMLFDEPTSALDPEMVREVLDVMVELAEEGMTMLCVTHEMGFAKEVADRVIFMDAGEIIEENNPKEFFENPQSDRTQNFLAQILHH

SEQ ID NO: 33387 - protein, 461 aa, Vibrio cholerae O1 biovar eltor str. N16961
MENSVHRYKKEASNLIKLATPVLIASVAQTGMGFVDTIMAGGVSAIDMAAVSIAASIWLPSILFGVGLLMALVPVVAQLNGAGRQHKIPFEVHQGLILALLVSVPIIAVLFQTQFIIRFMDVEEAMATKTVGYMHAVIFAVPAYLLFQALRSFTDGMSLTKPAMVIGFIGLLLNIPLNWIFVYGKFGAPELGGVGCGVATAIVYWIMLLLLLFYIVTSKRLAHVKVFETFHKPQPKELIRLFRLGFPVAAALFFEVTLFAVVALLVAPLGSTVVAAHQVALNFSSLVFMFPMSIGAAVSIRVGHKLGEQDTKGAAIAANVGLMTGLATACITALLTVLFREQIALLYTENQVVVALAMQLLLFAAIYQCMDAVQVVAAGSLRGYKDMTAIFHRTFISYWVLGLPTGYILGMTNWLTEQPLGAKGFWLGFIIGLSAAALMLGQRLYWLQKQSDDVQLHLAAK

SEQ ID NO: 33388 - protein, 478 aa, Vibrio cholerae O1 biovar eltor str. N16961
MAKSIFPNDFLWGGAVAAHQVEGGWDQGGKGVSIVDVLTRGAHEVPRRITDGVMEDEFYPNHQAVDFYHHYKEDIALFAEMGFKCFRTSIAWTRIFPNGDEAEPNEAGLQFYDDLFDELLKHNIEPVITLSHFEMPLHLVKQYGSWLNRDLIDHFTKFAQVVMTRYQHKVKYWITFNEINNQCNWKLPIFGYCNSGMLYAEQDRPEQAMYQVLHHQFIASALVVKLGHEINPDFKIGSMIHMMPLYPATSRPEDVLLAQELMREKYLFSDVQVRGYYPSYLRKEWQRKGIEIEMQAGDEQILRQGCADYLAISYYMTNIVSAAPEQEGETTSLFETSRLNPYLPASDWGWQIDPQGLRYALSELYERYQKPIFVVENGLGALDTVEADGSINDDYRIRYLSEHIAAVKQAIDYDGVEVMGYTPWGCIDCVSFTTGEYKKRYGFIYVDKHDDGSGTMARAKKKSFYWYQQVIASNGEKL

SEQ ID NO: 33389 - protein, 458 aa, Vibrio cholerae O1 biovar eltor str. N16961
MSVVSQVLSHMRGDFFRRLIAIALPITLQNIMFSSRGLVDVLMLGQLGEAEIAAVGVAARATFVTTIMLVGVTTGGALLTAQYWGAGDRKGVRESTALTWLVSNFFAFFTVLLFLFFPQQIMSLTTDSEQVNALGSQYLIITSFTMFAVACVSSMAVGLRAMHKPGVSTFFSGIGIVSNVVLNWILIFGKFGFPAMGIQGAAIATVLSGAIEIACLYSYLYGKKHLMAFGWQDIKAVIDWPKISRFLRLSLPTTFNFLIWAAGLFTYHAIMGQTGVQGLAALSVMTPVESISLSLLIGMSTAAAVLVGNQLGAKNYEAVYYQAIGVTACSVLVGIVVAIGLYLVQIPVLGAFTALTPETRELSEKFMLILCLGIVLRSFPMTAIVGVLRAGGDVKFCLGQDIVAQWCIGIPLAAFAALVLKVEPEWIYLLFLTEEVVKWFGSLHRMKSKKWMKNLIEN

SEQ ID NO: 33390 - protein, 488 aa, Vibrio cholerae O1 biovar eltor str. N16961
MRSLAMLPTDFPFFHQSAFINGQWILGEPQARQTVTNPFDGSLIGSVPLLSAAQVQEAIAGAQAAQILWCQQPAENKAKILRRWYELIEQHHESLAKLLTIEQGKPLAEARGEIHYAASFVEWYAEEAKRAYGELIPSHKPDARIMVSRQPVGVVAAITPWNFPAAMITRKCAPAFAAGCAVVLKPAPDTPFTALALADLAQQAGIPDGLLQVVTGDAIEIGRVLTESKTVRKLSFTGSTGVGKLLMAQSANNVKKLSLELGGNAPFIVFEDADINAAIDGVMVAKFRNAGQTCVCANRIYVHDAVYDQFAAKLVDRVSRLNVGYGLDAGVNIGPLINDAAVAKVTSHIVDAQSKGAKVMFGALPEAGSRLFQPHVLTEVTDEMRVADEETFGPLAALFRFSSEQEVIERANATDSGLAAYCYTQSLRRAWHMSEALEAGIVGINEGLISTTLAPFGGIKESGLGREGAKHGLEEYLEVKYTLMGGLA

SEQ ID NO: 33391 - protein, 506 aa, Vibrio cholerae O1 biovar eltor str. N16961
MIYAQPGSDNAVITFKSHYDNFIGGQWVKPVSGEYFGNISPVNGQVYCQVARSTQADIDLALDAAHQVREAWAKTSVTERSNLLLKIADRIEANIEQLAVAECWENGKPVRETLAADLPLVVDHFRYFAGCIRAQEGSAAELDSHTASYHFPEPIGVVGQIIPWNFPMLMAAWKLAPALAAGCCVVLKPAEQTPTSILVLIEKIADLIPAGVLNVVNGFGSEAGQALATSQRIAKLAFTGSTQVGQHILKCAAQSLIPSTVELGGKSPNIYFPDIFDHEDTYLEKCIEGTLLGFFNQGEVCTCPSRVLVHESIYDRFVAKVAERAKGIKQGNPLDTATQVGAQASQEQFDKILSYLDIGRQEGAKVLFGGGVAKQEGELGQGYYIQPTLLQGHNKMRVFQEEIFGPVIAITSFKDEAEALALANDTEYGLGAGIWTRDQNLAYRMGRNIQAGRIWINCYHAYPAHAAFGGYKKSGIGRETHKMMLNHYQNTKNLLISYDVNPLGFF

SEQ ID NO: 33392 - protein, 164 aa, Vibrio cholerae O1 biovar eltor str. N16961
MITLHTNFGDIKIQLNFEKAPVTSANFEQYCREGFYDNTLFHRVIDGFMIQGGGMTSGLREKETRDPIRNEANNGLSNKVGTIAMARTMDPHSASSQFFINVNNNTFLDFRSESRDGWGYCVFGEVVEGMDIVNKIKGVSTGSYGMHQDVPLEEVVITGTTIEA

SEQ ID NO: 33393 - protein, 256 aa, Vibrio cholerae O1 biovar eltor str. N16961
MTDVPALEIKNLHKTFGQNEVLKGISLQAQKGDVISIIGSSGSGKSTFLRCINLLETPTAGEIWVKGELIQMKTTRQGTVQPAKEKQVQRIRSRLAMVFQSFNLWSHMTVLENVIEAPVHVLGVPKAQAIEQAERLLRKVGLYERKDYYPGHLSGGQQQRAAIARALAVEPEVMLFDEPTSALDPELVGEVLGVMRDLAEEGRTMLVVTHEMAFARDVSNHVMFLHQGKVEEQGKPEKLFKNPDSERLKQFISSIY

SEQ ID NO: 33394 - protein, 476 aa, Vibrio cholerae O1 biovar eltor str. N16961
  misc_feature (110)..(110): Xaa can be any naturally occurring amino acid
MALGIFPVSLWQPWLERDPKQVALSHAGQTLTWQVLDSQVAHYAKALREQGVRSGEVVTLVGKNHLHTVLWFLACTQVGALCAFLAPQPLARLQEKLATLYAEQSPKHLXLAPSCALSEEDITALNAHRLSLPDERDESVGGEKVSSQFSGEQLATLIFTSGSTGTPKAVAHTHQQHLVSARGLLNKFAFTESDSWLLSLPLYHISGVAILYRWLAVGATLKIGTGDLQNDIAGVTHASLVPTQLKRLLDSSSPLTLKRVLLGGSHIPVELAQMAATRGIDTWLGYGMTEAASTVTAKRVDGLAGNGELLEHRELRLVDGRIFIAGKTLAQGYYRQGQLVPLTNEQGWFDSKDLGRWQGNNLLIDGRADNLFISGGENVHCEEIEAVLNQHPHVQVAIVIPVQDSEFGARPVAVIRSEAEWCQAIGDTWCQGKLEKFKWPIMYCLLPDALLDGGIKVSRAAVKAWLAANQTQFTPL

SEQ ID NO: 33395 - protein, 404 aa, Vibrio cholerae O1 biovar eltor str. N16961
MQNIGMSSKLDNVCYDIRGPVLKHAKRMEEEGHKILKLNIGNPAPFGFDAPDEILVDVIRNLPTSQGYCDSKGIYSARKAVVQYYQKKGIRSLDVEDVYIGNGASELIVMAMQALLNNGDEMLVPAPDYPLWTAAVALSGGKAVHYICDEEADWYPDLDDIRSKITPKTRGIVLINPNNPTGAVYSRDFLLEIIEIARKHKLMIFADEIYDKVLYDGAVHTSIATLADDVLVVTFNGLSKAYRVCGFRGGWMFLTGPKQQAQGYIAGLDMLASMRLCANVPMQHAIQTALGGYQSINELILPGGRLLEQRDRAWELINQIPGISCVKPKGAMYLFPKIDTKMYPIKDDQKMVLDFLVQEKVLLVQGSGFNWPKPDHFRIVTLPHVEDLEIAISRFERFITTYSQ

SEQ ID NO: 33396 - protein, 481 aa, Vibrio cholerae O1 biovar eltor str. N16961
MSSTLRRTKIVATLGPSTESPEILEAIIRAGANVVRMNFSHGTAEDHKNRAQKVREIAAKLGRHVALLGDLQGPKIRVSTFKEGKIILNEGEHFILDAELAKGEGTQESVGIDYKKLPQDVCNDDILLLDDGRVQLQVMRVEGNKIHTKVLVGGPLSNNKGINKKGGGLSADALTEKDKNDIRLAAEIQVEYLAVSFPRNGEDMKFARRLAQESGLYARMVAKVERAETVSCDENIDDIVRASDVIMVARGDLGVEIGDPELIAVQKKLISRAKKLNRVVITATQMMESMISNPMPTRAEVMDVANAVLDGTDAVMLSGETAAGKYPVETVKAMAEVCIGAEKMIESNEQNYRIKSVFRTEEEAIAMSTIYAANHLEGVKAMVTLTESGRTALMTSRLNSVFPIFAMSANQATLNRCALLRGVIPFYFDTKQASGLEAAIAALDALKERNLLEEGDLVIITQGDIMGVEGSTNCMRILPVY

SEQ ID NO: 33397 - protein, 387 aa, Vibrio cholerae O1 biovar eltor str. N16961
MPQIPTMKILIDENMPYAQALFSQLGEVILKPGRTLTADDLIDVDALMIRSVTKVNDALLAKANRLKFVGTATAGMDHVDQALLRERGIFFTAAPGCNKVGVAEYVFSVLMVLAQQQGFSVFDKTVGIIGAGQVGSYLAKCLSGIGMKVLLNDPPKQAQGDEREFTELETLLKQADVITLHTPITRGGEWPTHHLIDAAILEQLRSDQILINAARGPVVDNAALKARLQQGDGFTAVLDVFEFEPQVDMELLPLLAFATPHIAGYGLEGKARGTTMIFNSYCEFLGSAHCANPASLLPKAPVPKVYLERAWDEETLRTLTQIIYDVRKDDAQFRREIHQPGAFDLMRKHYWDRREYSAVTLAGGADCHLAPLAKLGFQVEVCDEPTI

SEQ ID NO: 33398 - protein, 430 aa, Vibrio cholerae O1 biovar eltor str. N16961
MLEKLFKLSEYGTNVRTEILAGVTTFLTMAYIIFVNPAILSDAGMDRGAVFVATCLAAAIGCFIMGFIANYPIAQAPGMGLNAFFTYGVVLGMGHTWQVALAAVFCSGVLFILLSLFKIREWIINSIPHSLRTGISAGIGLFLAFIALKNAGIVVDNPATLVSLGAITSLHAVLAAVGFFLTIGLVYRGVKGAVMIAILAVTALGLVFGDVQWGGIMSTPPSIAPTFMQLDFSAVFEIGMISVVFAFLFVDLFDTAGTLVGVATKAGLIEKDGKIPRLNRALLADSTATSVGALLGTSNTTSYIESVSGVAVGGRTGLTAVVVGILFLLALFFSPLAGMIPAYATAGALFYVAILMMSGLVSIDWRDLTEAAPTVVTCLMMPLTFSIAEGISLGFIAYAAIKLFSGKGRSVSLSVWVMAAIFVIKYILAA

SEQ ID NO: 33399 - protein, 459 aa, Vibrio cholerae O1 biovar eltor str. N16961
MIVKAKRAYVCNECGADFPRWQGQCNACGSWNSISEVRLAASPQVARNERLVGYAGALEAKVQTLADIDLQEVPRFTSGFKELDRVLGGGIVPGAAILIGGNPGAGKSTLLLQTMCLLSGQMPTLYVTGEESLQQVAMRASRLGLPKQHLKMLSETNVDRICQIAEQEKPRIMVIDSIQVMHVADVQSSPGSVAQVRESATALTRYAKQNNVAVFIVGHVTKDGTLAGPKVLEHIIDCSILLDGDTDSRFRTLRSHKNRFGAVNELGVFAMTGQGMREVSNPSAIFLSRGEEATSGSSVMVVWEGTRPLLVEIQALVDYSQLANPRRVAVGLEQNRLSLLLAVLHKHGGLQMADQDVFVNVVGGVKVTETSADLALLMALLSSFRDRPLPKDVVVFGEVGLAGEIRPVPSGQERLNEAFKHGFKKAIVPIANMPKGGIEGMQIHGVKKLSDAIAAFDEL

SEQ ID NO: 33400 - protein, 162 aa, Vibrio cholerae O1 biovar eltor str. N16961
MMRDITPDLCDKYESQVTLLNLPLQNFGQRSAFWGEIVTVRCYHDNSKVRDVLSQNGKGKVLVVDGHGSCHKALMGDQLAILAIKNDWEGVIIYGAVRDVVAMSEMDLGIKALGTSPFKTEKRGAGQVNVTLTMQNQIVEPGDYLYADWNGILMSETALDVA

SEQ ID NO: 33401 - protein, 489 aa, Vibrio cholerae O1 biovar eltor str. N16961
MGKATGFLEFGRELPKKIDPAERIKNNKEFVLNQEFGKKINQQASRCMDCGVPFCHNGCPIGNIIPEFNDAVYRDSWEEAWNILSSTNNFPEFTGRVCPAPCETACVLGINQDPITICNIEKTIVERAYQEGYAKPKTPRSRTGKTVAIIGSGPAGLAAAEQLNAAGHSVTVFERDEKVGGLLRFGIPDFKLGMDVIDRKINLMEQAGVKFVVNAHIGVDINAQQLRQEFDAVLLTGGSTVPRDLSIPGRDLKGVYFAMQFLAQNNRRANGMDLKGEEIHAKGKHVVVIGGGDTGSDCVGTSNRHGAASITQVEIMPIPPQKRPVNMPWPQYPMILRTSTSHEEGCERHWNILTKEFIGNEQGEVTGLRIADIVWKDAAPGERPSFDEVVGSERVIPCDMAFLAMGFLHPEPHGVLAQLGIKLDERGNVATQDFATNQKGVFAAGDMRTGQSLVVRCINEGRECARAVDTFLMGNTHLEAKADSLMLSA

SEQ ID NO: 33402 - protein, 471 aa, Vibrio cholerae O1 biovar eltor str. N16961
MMSQNVYQFIDVNRVDPAKKPLHIRKIEFVEIYEPFTKQQATAQADRCLDCGNPYCEWKCPVHNYIPQWLKLANEGRILEAADLAHQTNSLPEVCGRVCPQDRLCEGSCTLNADFGAVTIGNIEKYITDTAFEMGWKPDMSNVVWTDKKVAIIGAGPAGLAAADILVRNGVRPVVFDRYPEIGGLLTFGIPSFKLEKGVMENRRRIFSEMGIEFRLNVEVGQDITLQQLLDEYDAVFLGVGTYQYMRAGLANEDAPGVYDALPFLISNTYKVMELNNEAPFIDMAGKNVVVLGGGDTAMDCVRTSIRQGASRVICAYRRDEENMPGSRREVKNAKEEGVEFMFNLQPLGIEVNAQGQVTGVKVVKTALGEPDAAGRRKPEPVAGSEHVLPADAVIMAFGFQPHKMAWLEPFDVELDQWGRIKAPAKQTYQYQTTNPKIFAGGDAVRGSDLVVTAIDEGRKAAEGILDYLGV

SEQ ID NO: 33403 - protein, 475 aa, Vibrio cholerae O1 biovar eltor str. N16961
MSKEIKAQVVVLGAGPAGYSAAFRCADLGLDTVIIERYNTLGGVCLNVGCIPSKALLHVAKVIEEAKALTEHGIVFGEPKTDIDKVRLWKEKVINQLTGGLAGMAKMRKVNVVNGYGKFTGPNTIEVDGEEGKTVVTFDNAIVAAGSRPIKLPFIPHEDPRIWDSTDALELKEVPGKLLIMGGGIIGLEMATVYHSLGSKIDVVEMFDQLIPAADKDMVKVYTKRIKDKFNLMLETKVTAVEAKEDGIYVSMEGKSAPAQAERYDAVLVAIGRVPNGKLLDAEKAGLEVDERGFIRVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 33404 - protein, 433 aa, Vibrio cholerae O1 biovar eltor str. N16961
MSKIVKVLGREIIDSRGNPTVEAEVHLEGGFVGMAAAPSGASTGSREALELRDGDKSRFLGKGVLKALAAVNGPIADALVGKDAKDQATIDQIMIDLDGTENKSNFGANAILAVSLANAKAAAAAKGMPLYEHIAELNGTPGVFSMPLPMMNIINGGEHADNNVDIQEFMIQPVGAKTLKEAVRMGAEVFHNLAKVLKSKGYNTAVGDEGGFAPNLKSNAEALEVIAEAVAAAGYKLGTDITLAMDCAASEFYDAEKKEYNLKGEGRIFTSNGFSDFLEELTEKFPIVSIEDGLDESDWEGFAYQTEKLGKKIQIVGDDLFVTNTKILKRGIDNGIANSILIKFNQIGSLTETLAAIKMAKDAGYTAVISHRSGETEDATIADLAVGTAAGQIKTGSMSRSDRVAKYNQLIRIEEALGSRAPFNGLKEVKGQA

SEQ ID NO: 33405 - protein, 409 aa, Vibrio cholerae O1 biovar eltor str. N16961
MAKVSLEKDRIKILLLEGLHPSSVEVLQAAGYSNIEYHKGSLEEAELIKAIKDVHFVGIRSRSNLTEKVINAAEKLVAIGCFCIGTNQVDLNAAAKRGIPVFNAPFSNTRSVAELVLGEILLLLRGIPEKNALAHRGIWKKSADNSYEARGKRLGIIGYGHIGTQLGIIAENLGMHVYFYDIESKLSLGNATQVHTLSELLNKCDVISLHVPETAGTKNMMGAEEFARMKPGAIFINAARGTVVDIPALCNALESGHIAGAAIDVFPEEPASNKEPFESPLMKFDNVILTPHVGGSTQEAQENIGIEVAGKLAKYSDNGSTLSSVNFPEVSLPEHRSCSRLLHIHANRPGILTQINTIFAEEGINIAAQYLQTTAEIGYVVIDVETARSEEALTKLKAIDGTIRARILH

SEQ ID NO: 33406 - protein, 325 aa, Vibrio cholerae O1 biovar eltor str. N16961
MSLPTTSLPTVVFLDRATIPRHISLPALPFEHHWLEYDACEPQQVVERLLAADIVITNKVVLTREMLIQLPKLKLIAISATGTNNVDLPACRDLNIAVCNVQGYATRSVPEHVVAMMFALRRNLIGYHNDIAAGEWQRHKQFCFFTHPIGDIAGSTMGIIGSGALGQATANLARALGMHVLLAERKGQVECRDGYTSFEQVLAQSDVLSLHCPLTDETRNIISEAELAQMNPNALLINTGRGGLVDEQALVDALKRRQIAGAGVDVFSAEPADMDNPLIANRDLPNLLLTPHVAWGSDSSIQQLATILIDNISAFMRGEAKNRVV

SEQ ID NO: 33407 - protein, 267 aa, Vibrio cholerae O1 biovar eltor str. N16961
MSQSDLVTIKNLRFSRSQRVIFDDIDLHVPKGKVTAIMGPSGIGKTTLLRLIGGQLLPEQGEIWFDGENIPTLSRRKLYRARKKMSMLFQSGALFTDLNVFDNVAYPLREHTELDEAMIKTLVLLKLEAVGLRGAAYLMPSELSGGMARRAALARAIALDPELIMYDEPFVGQDPITMGVLVELIRNLNRALGVTSVVVSHDVPEVMSIADWVYLLADGKVIAQGSPQALRDNPDPRVQQFLCGDADGPVPFRFPAQPIEQELFSAK

SEQ ID NO: 33408 - protein, 209 aa, Vibrio cholerae O1 biovar eltor str. N16961
MTFMSEVKFETVEQKASYGIGLQMGQQLAGSGLEGLNVAAIAAGIATALVGEQPAISIDEINQALHAIHMRAEEARQEAAKVAASEGEAFLKDNALRPEVTVLESGLQYEVLVEGNGAIPTSDKSVRVHYHGQLVDGTVFDSSVSRGQPAEFPVTGVIRGWVEALQLMPVGSKWKLYIPHNLAYGERGAGAAIPPFAALVFEVELLDIL

SEQ ID NO: 33409 - protein, 403 aa, Vibrio cholerae O1 biovar eltor str. N16961
MTVEMSVDRSSFDEVMVPCYNPMEFIPVKGFGSRIWDQQGHEYIDFAGGIAVSCLGHCHPVMVQALTTQANKLWHLSNVMTNEPALRLAKKLTQVSFAEKVFFANSGAEANEAALKLARRYAADVYGPEKSEIIAFNQGFHGRTFFTVSVGGQATYSDGFGPKPGDIVHLPYNDLAALQAQISDRTCAVMMEPLQGEGGIVSPSAEFVQAVRELCDKHNALLIFDEVQTGNGRTGDFYAYQGIGVTPDILATAKSLGGGFPIGAMLTTAKIAEHMKVGVHGSTYGGNPLACAVAEAVVDFVAQPEILAGVKQREQWMRAELEKINQKYQLFKEIRGKGLLLGAALNDEWQGRARDILVAAGKQGLMVLVAGASVVRFTPSLIISQQEIEEGMARLDKAIATLM

SEQ ID NO: 33410 - protein, 236 aa, Vibrio cholerae O1 biovar eltor str. N16961
MFSLHSIPNEVGMKDFLIAPSILSADFARLGEDVAKVLAAGADVVHFDVMDNHYVPNLTFGAPICKALRDYGITAPIDVHLMVKPVDRIIPDFAKAGASMITFHVEASEHVDRTLQLIKECGCQAGVVLNPATPLHHLDYIMDKVDLILLMSVNPGFGGQSFIPHTLDKLRAVRERIKQSGRPIRLEIDGGVKVENIREIAEAGADMFVAGSAIFGQPDYQAVIEQMRAELAKAKI

SEQ ID NO: 33411 - protein, 484 aa, Vibrio cholerae O1 biovar eltor str. N16961
MKQIHVDVAVIGGGTAGLGAYRAAKAYTPNVVMIEGGPYGTTCARVGCMPSKLLIAAAESVHQIEKAPGFGVYPQGEIVINGREVMDRVKRERDRFVGFVLEGVDSIPEQDKITGYAKFIDNHTLQVDDHTRIHAKRIVIATGSRPAYPAVWNELGDRLVVNDDVFEWDDLPQAVAVFGPGVIGLELGQSLHRLGVKVKVFGLGGQVGPLTDPDVMAYANRAFQQEFYLDADVKVESMKRIAGDKVEIQFINQQGELETFIVDYVLAATGRRPNVDKLALDNTDVALDERGVPKADHYTLQTSVPSIFIAGDASNQIPLLHEAADQGRIAGDNAGRFPDIRAGLRRSPISAVFSDPQIAMVGETYKQLTQRLGNCGCFAVGEVSFENQGRSRVMLRNKGLLHVYGEQGTGRFLGAEMMGPNAEHLAHLLAWAHQNQMTISQMLDMPFYHPVIEEGVRTALRDLNAKLHLGPEMIKHCLDCGPGC

SEQ ID NO: 33412 - protein, 265 aa, Vibrio cholerae O1 biovar eltor str. N16961
MIRYGDIPMRRPVVMGNWKLNGSKAMVTDLLNGLNAELEGVEGVDVVVAPPAMYLDLAERLIKEGGNKLILGAQNTDTHNSGAYTGDMSPAMLKDFGASHIIIGHSERRDYHKESDEFVAKKFAFLKENGLTPVFCIGETEAQNEAGETEAVCARQINAVIDAYGVEALNGAIIAYEPIWAIGTGKAATADDAQRIHASIRALIAAKDAAVAEQVIIQYGGSVKPENAASYFAQPDIDGALVGGASLDAKGFAAIAKAAAEAKKA

SEQ ID NO: 33413 - protein, 171 aa, Vibrio cholerae O1 biovar eltor str. N16961
MEYNTSALCDIYLDQVDVVEPMFSNFGGCASFAGQITTIKCYEDNGLIRETLEQDGLGRILLIDGGGSLRRALIDAELAALAEENEWEGIVVYGSVREVDELEEMSIGIQAIASIPVGATSQGIGEVDIPVNFGGVTFLPEDYLYADNTGIIISQEPLSADLGEEEEDELL

SEQ ID NO: 33414 - protein, 469 aa, Vibrio cholerae O1 biovar eltor str. N16961
MSVENVLSLIQENEVKFVDLRFTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGLDGIKNKIHPGEAMDKDLYDLPAEEAAEIPKVAESLQQALQYLDADREFLTAGGVFSDDFIDSYIALKTKDVERVNVAVHPLEFELYYSV

SEQ ID NO: 33415 - protein, 315 aa, Vibrio cholerae O1 biovar eltor str. N16961
MGYQHPTFSAKSFGYKNKNHKENKMRVSFIGLGVMGYPMAGHLQKAGFDVTVFNRTQAKAVAWAKQFGGQYAETVAECVKNADVVLTCVGNDDDVRSMTTAATGAIPAMKPGAVLIDHTTTSALLAEELSAAAQQAGLHFMDAPVSGGQAGAENGVLTIMCGGDEALFAKMQPIFAAYGRSSVLMGTAGQGQRAKMVNQICIAGVLNGLSEGLMLAEQAGLDIPNLVACLKNGAAGSWQMENRALTMSQEKFDFGFAIDWMIKDLGFCLDEAAQLGLRLPMTENTMTAYQRLSAQGLGRMDTSVLIQAVKEAAKK

SEQ ID NO: 33416 - protein, 469 aa, Vibrio cholerae O1 biovar eltor str. N16961
MSSDSRGLYHRKNNEVTMFELFKPAAHTQRLPSDKVDSVYSRLRWQLFIGIFVGYAGYYLGRKNFSLAMPYLIEQGFSRGDLGVALGAVSIAYGLSKFLMGNVSDRSNPRYFLSAGLLLSALVMFCFGFMPWATGSITAMFILLFLNGWFQGMGWPACGRTMVHWWSRKERGEIVSVWNVAHNVGGGLIGPIFLLGLWMFNDDWRTAFYVPAFFAVLVAVFTWLVMRDTPQSCGLPPIEEYKNDYPDDYDKSHENEMTAKEIFFKYVFNNKLLWSIAIANAFVYLIRYGVLDWAPVYLKEAKHFTVDKSSWAYFLYEWAGIPGTLLCGWISDKVFKGRRAPAGILFMVLVTLAVLVYWFNPAGNPAVDMAALVAIGFLIYGPVMLIGLYALELAPKKAAGTAAGLTGLFGYLGGAVAANAILGYTVDHFGWDGGFMVLVASCVLSVLCLIYAFVGERAHHNDKLKQATI

SEQ ID NO: 33417 - protein, 494 aa, Vibrio cholerae O1 biovar eltor str. N16961
MDTIMPLPTHFYTTQQLKQGEQDAASERGLELFHLMERAGQAVFTIAFAQYPTSHHWLICCGGGNNGGDGYIVAVLARHMGIDVTVWQLGDPEKLPADAHRAYQQWKELGGAVYAPQSEVPESTDVIIDALFGIGLKEVLRPQVVPLVELLNQSGKPIVAVDVPSGLCADTGQVMGTCIKAQHTVSLIGLKQGLVTGQARCYVGTLHYAGLGVEEVFAQHNTPSLVSIDGKLRHSLLPPRQACTHKGQNGKALIVGGNEGMGGALILCASACARSGAGLSAAMTHPDNVTAMLTITPEVMSTSWNKQHLFEERIEWCDALALGPGLGRDAQAQQIMQRLSSLKVPKVWDADALYFLAHNPSYDAQRIITPHPVEAARLLGCEVEEVEQDRFAAIRQLQQRYGGVVVLKGAGTLVDDGKEIAVCLQGNPGMASGGMGDVLTGIIVALLAQKIPLADAAKLGVWLHSSAADLNTKSHGQRGLLASDLLPHLRELLN

SEQ ID NO: 33418 - protein, 331 aa, Vibrio cholerae O1 biovar eltor str. N16961
MLNVIFFSAKHYDIASFSKLVDPTQLSLHFHDFRLTDKTAQMAKGCEVVCAFVNDELHASVLEQLYQGGTRLIAMRCAGFDKVDLEAAKRLGMQVVRVPAYSPEAVAEHTVGMMLCLNRRFHKAYQRTRDANFSLDGLVGFNFHGKTVGVIGSGKIGVATMRILQGLGMQILCFDPYPNPDAIALGARYVELSELFAQSDVITLHCPMSKENYHLLNESAFDQMKDGVMIINTSRGELLDSVAAIEALKRGRIGALGLDVYDNEKDLFFQDKSNDVIVDDVFRRLSACHNVLFTGHQAFLTEDALNNIAQTTLNNIQLFFDNQASGNELIQ

SEQ ID NO: 33419 - protein, 347 aa, Vibrio cholerae O1 biovar eltor str. N16961
MRIEQELKLGFKDVLFRPKRSTLKSRSQVNLTREFTFKHSGRQWSGVPVIAANMDSVGSFAMAKALAEHGVMTAVHKHYTVADWAEFVKSADKATLNNVMVSTGTSEADFQKTKDVMALSDELIFICIDIANGYSEHLVEYVQRVRAAFPDKVISAGNVVTGDMVEELILAGADIVKVGIGPGSVCTTRVKTGVGYPQLSAIIECADAAHGLGGRIIGDGGCTCPGDVAKAFGGGADFVMLGGMLAGHEEAGGELIVKDGETFMKFYGMSSKSAMDKHSGGVAGYRAAEGKTVLLPYRGSVHGTIQDILGGVRSTCTYVGAAELRELTKRTTFIRVQEQENNVYGRE

SEQ ID NO: 33420 - protein, 337 aa, Vibrio cholerae O1 biovar eltor str. N16961
MFNQYHKLPLFLYTVLCVRLSSRALNTFEELNMTNYLERGIKELVEEFISSGKPCPSKQTISERRAGYLSSTVLAGSSPEMADEFVDELDGIQVKVYKPSDKIDLPITIYFHGGCFISGGFETHEAQLRQLAHLSETIVVCIKYRLAPEHAYPSAHDDVFQAALGIKEHGHKYGGDTEHVFFVGDSAGAQLALATALRLKNKKLWLPEKQILIYPMVDPLGVSDSYQKNGTDFIITAQMLLSGFQLYAGESERLASEKELNLLARKDLQGLPPTLIITAEYDPLRDEGEQLYRLLLSQGVDAYCERYLGVIHGFYQLSGVSESARRCIRNIANAIKN

SEQ ID NO: 33421 - protein, 323 aa, Vibrio cholerae O1 biovar eltor str. N16961
MKIAILDDYQNVVRGLNAFQCLQGHDVTVFNDSLSDETVLIERLKPFEALVLIRERTPITENLLAHLPNLKLISQTGKVSNHIDVALCERYGVTVLEGIGSPVAPAELCWGLILAASRHLPSYIEQLHAGHWQQNGGLGLGRTLSGHTLGIWGLGKIGQRIAQFGHVFGMPILVWGSEASRQKALELGYQAAADKAEFFAKADVLSLHLRLNDATRGIVTKQDLLAMKPDSLFVNTSRAELVESGALYSVMQTNPTRQAAVDVYENEPALPNNEPLLSLPNVLCAPHLGYVEKNSYEIYFQAAFENVVKFAHSAAKASLSDKA

SEQ ID NO: 33422 - protein, 323 aa, Vibrio cholerae O1 biovar eltor str. N16961
MNALVRLSSNHILRSDSMSRVWLTGDAVVDLIPDGQQHYLKCPGGAPANVAVAIARLCGRSAFFGRVGNDPFGRFMQQTLTDEQVDCQHLYFDPVHRTSTVVVDLDEHGERSFTFMVKPSADQFLQLSDIPSFQNGEWLHVCSIALANQPSRSSTFAAIAQMKEVGGYVSFDPNLREEVWSEPQELQATVMRAVGLADVVKFSEEELQFLTGTQSIEEGLQAIADFQIPLVVVTLGAKGALVVTPNSRQIVSGKAVKPIDTTGAGDAFVGGLLYRLSVAQDWHNQATILDAVKWANGCGALATTQKGAMTALPNQAALYAFLE

SEQ ID NO: 33423 - protein, 157 aa, Vibrio cholerae O1 biovar eltor str. N16961
MSKIIIPLVVFLLAGFMIYRTWTNHKSADANFSAGQQFLAENGQRENVITTDSGLQYEVLQAGTGTEHPGPKSRVKVHYHGELLDGTVFDSSVERGEPISFGLNQVIKGWQEGVQLMVVGEKTRFYIPSNLGYGKNGAGPIPPSAVLIFDVELLAIE

SEQ ID NO: 33424 - protein, 436 aa, Vibrio cholerae O1 biovar eltor str. N16961
MKIVPMVQPIQAMEIDQAYRHWRIHLMISMYVGYGVFYLTRKSFNFAMPQMLSELGLDYSDLGFLSTLFYLTYGVSKFVSGLMIDRSRSPYFMGLGLMATGIINIAFGFSSSLLAFTLLWTANAFFQGWGWPACAKVLTHWYSRSERGFWWSIWNTCHNLSGALIPIVIGFISLTFGWRYGFLFAGGVAIFVGLWLCYRIQEKPSEMGLPSVGEWRGDALELEHEKEGQGLAFRVAVYRYVLTNRYIWLLCGSYLLVYVVRIGINDWGSLYLVERHAYNILSANSAVAMFEVGGFLGSLLGGWGSDYYFRGNRAPMNLIFALGIFASVAALWLTPIDHLWFLAGCFFCIGFFVFGPQMMIGMAAAECARKDLAGTATGFVGLFSYLGAALASYPMSLAIEAWGWEGFFCLITAAAAVISLQLLPFIKAQQPVTEDE

SEQ ID NO: 33425 - protein, 351 aa, Vibrio cholerae O1 biovar eltor str. N16961
MEKQNFVVLKNICKRFGSNTVIGNLDLEIKKGSLVTLLGPSGCGKTTVLRLVAGLEKPTSGQIFIDGEDVTERSIQQRDICMVFQSYALFPHMSLYENVAYGLKMLKLPSEEVRQRVDEALKIVDLEGMGERYVDQISGGQQQRVALARALVLKPKVLLFDEPLSNLDANLRRSMRETIRELQQRFDITSLYVTHDQAEAFAVSDTVIVMKQGDIMQIGTPQELYKAPKSMFMANFMGEANMFQGHFDGQQIHINGYAIDADLEVTRDKPNGEYQIGVRPEAITLHTQGSESQACQILKSAYMGSMYEVTVKWHDQELLLQLNSAQFNHTLTQHAYVVFNPRGLFLLPYAE

SEQ ID NO: 33426 - protein, 459 aa, Vibrio cholerae O1 biovar eltor str. N16961
MLNFFKTRPDLPLLSSSKAEMLKRYKSYQWQVFIGLIFGYAMFYVVRMALGVVKKPMLDAGIVTLEELGIMGSAFFFTYAFGKFLNGFLSDYANIGRFMSFSLLLSGVASIFMGMNTVAFFFVLLWGLNGWFQSVGSAPSCVSIYQWFSPKQRGSRYSIWGGSRNIGEGITWILTASLVSYFGWRAGFIGAGIAGVVASLIMFKLLKDRPQTYGMPDPGTAFEEGTEIKKANDPKETRRAQMFILKQPVVWLIALACAAMYISRYAMSSWAVLFLQEQKGYSLIDAGFAMSMYPTAGLAGAILSGILSDKVFKGNRNIPNLLYGLTNIAGMCLMFFGPDNRIVDAVALSMIGFSIGGLVVFLAGLIACDLMPKNAVGAVKGLIGLCSYIAASAQELISASLITVTEVEGVKHYDFGNAQYFWLAAGVVSVLLALTVWNAKKVVDIDEAEGKPLKTQTAS

SEQ ID NO: 33427 - protein, 486 aa, Vibrio cholerae O1 biovar eltor str. N16961
MCKTKIVATLGPASQTRETLTQLIQAGVNVVRLNFSHGSAEEHIARAEMVREIAQQLNVSVGVLVDLQGPKIRIACFAEGAIQLSAGDTFILDGHLDGQAGTQERVGLDYPELIDDLNVGNILLLDDGRIQLEVTAVDMQARLVHTIALNSGKLSNRKGINLLGGGLSAPALTEKDKLDIITAAELQADFLAVSFPRNAEDIEYARQLATQAGCHAHIVAKVERAEVVASEEAMDSVIRASDVIMVARGDLGVEIGDARLPSVQKALIARAKHLGKPVITATQMMESMIENPLPTRAEVLDVANAVIDGTDAIMLSAESAAGRYPVETVQAMVRIAQGVEHETHCAQNCWDALQHLCSDAGKSFALSSMISASKVNKDLGVAIVTEQGETPLLMSRCQSQATIWAVSDKPALLRKLAILRGVTPTYFPHLDKQGDIATQLIHLLRKPAQEKKIASILVTQLESVEGVGHVNVCRLLNLAQQEALFA

SEQ ID NO: 33428 - protein, 247 aa, Vibrio cholerae O1 biovar eltor str. N16961
MQYVRMSIRVKGINKSYGTTQVLHDIHFECASGETLVLLGPSGAGKSSLLRVLNLLETADNGQLHIANQSFDFSTHPTEQQGLALRRKVGMVFQQYHLWPHMTVLENLVEAPVKVAGMAKSQAKQQAIEILKTLQLADKADAWPLQLSGGQQQRVAIARALMMKPDVLLFDEPTAALDPEITNQVVKIIKELSGTGITQVVVTHEVDFAKKIASHVLYLEKGRIVEHGTHASFTHPQTQQFADYLKH

SEQ ID NO: 33429 - protein, 309 aa, Vibrio cholerae O1 biovar eltor str. N16961
MNDLFTKTDYSLYSNAMTFVRRPYVRNPVDTNADVVVLGVPLDMATSGRPGARMGPDAIRRASVNLAWEGKKFPWDFNLFKKINVIDAGDLVFDCGDAEDFTYRLEAATSEILKSGKTMLALGGDHFITLPILRAYAKHFGEMALIHFDAHTDTYANGSAYDHGTMFYHAPKEGLISAKHSVQVGIRTEYKQEGHGFNVINAMQANDMSVEEIVAQIRHIVGDKPVYLTFDIDCLDPAFAPGTGTPVCGGLSSDKILKIIRALKGINLIGMDVVEVSPPYDQSDLTSLAGATIALELLYVWASNKKDEE

SEQ ID NO: 33430 - protein, 411 aa, Vibrio cholerae O1 biovar eltor str. N16961
MDIFKHHESQVQSYANHFPVLFGTAKGSWLYSQQGDAYLDFLSGAGALNYGHNNAVLKQALLEYIERDGLTHGLDMHSEAKAHFIQALQTHILEPRGLNYKLQFTGPTGTNAVEAALKLARKVTGRHNVVTFTNGFHGCSLGALAATGNQHHRQGAGLALSGVYRVPYDGYAGVDGLTLFETMLQDNSSGLDKPAAVLLETVQGEGGLNVASDAWLQRVQAICRAQQILLIVDDIQAGCGRTGTFFSFEPSGIEPDMVTLSKSLSGYGLPMALVLFKPEWDQWKPGEHNGTFRGNNHAFVTATRALEAYWANQDFQTHIAARSEQVTQALLQCLSRYPTLFSGLKGRGLMQGLACHNGDIARDIAALCFQKGLIIETAGAEDEVLKVFCPLTITEADLAHGLTIIERVLLE

SEQ ID NO: 33431 - protein, 343 aa, Vibrio cholerae O1 biovar eltor str. N16961
MKIKALSKLKPEQGIWMNEVDMPELGHNDLLIKIKKTAICGTDVHIYNWDEWSQKTIPVPMVVGHEYVGEVVGIGQEVRGFQIGDRVSGEGHITCGHCRNCRGGRTHLCRNTIGVGVNRTGCFSEYLVIPAFNAFKIPDGISDDLASIFDPFGNAVHTALSFDLVGEDVLITGAGPIGIMAAAVAKHVGARHVVITDVNEYRLDLARKMGVTRAVNVAEQNLEDVMKELGMTEGFDVGLEMSGVPSAFSAMLKTMNHGGRIALLGIPPSSMAIDWNQVIFKGLVIKGIYGREMFETWYKMASLIQSGLDISPIITHHFKVDDFQKGFDIMRSGASGKVILDWQ

SEQ ID NO: 33432 - protein, 482 aa, Vibrio cholerae O1 biovar eltor str. N16961
MKGDIGVIGLAVMGQNLILNMNDHGFKVVAHNRTAAKVDEFLEGPAKGTNIVGAYTLQELVDKLATPRKVMLMVRAGQVVDDFIEQLVPLLDKGDIIIDGGNTNFPDTNRRVKALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFADWNKTELDSYLVEITADILGYKDEDGEALVEKILDTAGQKGTGKWTGINALDMGIPLTLITESVFSRCLSALKDQRVEAEKLFGKTKTQVEGDKQVWVDALRQALLASKIISYAQGFMLMREASNENGWNLNYGNVALMWRGGCIIRSAFLGNIRDAFEKNPELAFLGSDAYFKGILDNCLAAWRKVAAKSLEVGIPMPCTTSALTFLDGYTTARLPANLLQAQRDYFGAHTYERIDRPRGEFFHTNWTGTGGNTASTTYDV

SEQ ID NO: 33433 - protein, 367 aa, Vibrio cholerae O1 biovar eltor str. N16961
MSRLFEPTDLKQLTLQNRVVMAPMTRARSSQPGNIPNPMMATYYQQRASAGLIISEATQISDDAQGYSFTPGVYTDEQTSGWKTVTQAVKQQGAAMFCQLWHVGRVSHPVFQKGQLPIAPSALKPVETQVWIADEQGNGQMVDCVEPRAMTQADIDRVVNDFAQAAKCAIEAGFDGVEIHGGNGYLIDQFLRTNSNHRTDSYGGSRENRMRFLLEVVDAVSQAIGASRVGVRLAPFITFKDMDCPDIVPTILEASKQLQARDIAYLHLSEADWDDAPTIPESFRIELRKHFTNAIIVAGRYTLERAEEVLQKGYADLVAFGRPFVANPDLVSRLKHQQPLAQLDGKTLFGGGEQGYTDYPKIPEQPI

SEQ ID NO: 33434 - protein, 347 aa, Vibrio cholerae O1 biovar eltor str. N16961
MTDILFQPYALNDVITLNNRIAMAPLTRCMADDDLVPTDAMVAYYARRADAGLIISEATIIRPDAQGYPNTPGLFTQAQIAGWKKVTDAVHANGGKIFAQLWHTGRVAHPAFFAGEYVLAPSALGVEGSVPRRRELQYTVPKAASQAEIKQLVADYAQAAENARLAGFDGVEIHGANGYLIDQFLHFDSNQRSDEYGETPANMARFALEVVDAVIARIGAERTALRVSPGAYFNIKADPRDREVFDYLLPELEKRNLAYLHEGMFDDSVTFDFLGGRVSTYLRQHYSKTLMGVGGFSAETGATAIENNEFDLLAIGRPFIANPDYIARVQKGEELKAYQDSMLTELY

SEQ ID NO: 33435 - protein, 239 aa, Vibrio cholerae O1 biovar eltor str. N16961
MKVIEFHQVSKWYGQFQALKSISLTVNKGEIVVICGPSGSGKSTLIRTVNGLESIDSGEIIVLPELDERTRRSGKIGMVFQHFNLFPHLTVLENLTLAPIRTLKLSAQEAKERAYHFLQRVKITDQTHKYPIQLSGGQQQRVAIARSLCMQPEILLFDEPTSALDPETINEVLEVMVDLAQDGITMMCVTHEMGFARKVAHRVMFMDEGEILEVGSPEQLFQNPTHPRTQQFLNQILSH

SEQ ID NO: 33436 - protein, 480 aa, Vibrio cholerae O1 biovar eltor str. N16961
MVQLSVVSRAESPEISSAIEALQAEFTRLKRQYANTPYPSLTHRLQRLTQLKQALLRENEALIAAVNQDYGFRSRFDSGLCDLLPTLNHLNYTAKQLKKWMKPQRRHAGWMLLPSRVEVQFQPLGVVGVMVPWNFPILLSIAPLITAVAAGNQVMVKLSEYTPATNQVLARVIAALGDIAVCVQGDAKVAAAFSALRFDHLLFTGSTAVGKLVAQAAAKNLTPVTLELGGKSPVIIADDADLARSVDNIMLGKTTNAGQICVAPDYVMLPQAKVATFVELYLQRFARRFIRHGRMDVTQIINQAQFDRLQHCLDDAQQKGAKLNTVVGKTVELEARQMLPHLLTEVSDDMLVMQQEIFGPILPVIGYRNIEEAIERVNQGPRPLALYVMTKESHLANHILQRTHSGGACVNDTLMHVAADDAPFGGIGESGQGHYHGIEGFKTFSHSKTVLRSAAWLPRSGWLLTYRQSMLRVLTRFFGR

SEQ ID NO: 33437 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYRDQGKDPAT

SEQ ID NO: 33438 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYCDQGKDPAT

SEQ ID NO: 33439 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 33440 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 33441 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQELLSKFFAQTEALAFGKSREVVEQEYCDQGKDPAT

SEQ ID NO: 33442 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 33443 - protein, 326 aa, Escherichia coli
KTFSEAIISGEWKGYTGKAITDVVNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 33444 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGNVVDYQTGPIIWGEPGTNGQHAFYQLIHQGTKMVPCDFIAPAITHNPLFDHHQKLLFKFFAQTEALAFGKSREVVEQEYCDQGKDPAT

SEQ ID NO: 33445 - protein, 326 aa, Escherichia coli
KTFSEAIISGEWKGYTGKAITDVLNIGIGGSDLGPYMVTEALRPYKNHLNMHFVSNVDGTHIAEVLKKVNPETTLFLVASKTFTTQETMTNAHSARDWFLKAAGDEKHVAKHFAALSTNAKAVGEFGIDTANMFEFWDWVGGRYSLWSAIGLSIVLSIGFDNFVELLSGAHAMDKHFSTTPAEKNLPVLLALIGIWYNNFFGAETEAILPYDQYMHRFAAYFQQGNMESNGKYVDRNGKVVDYQTGPIIWGEPGTNGQHAFYQLIHQGTKMVPCDFIAPAITHNPLFDHHQKLLSKFFAQTEALAFGKSREVVEQEYRDQGKDPAT

SEQ ID NO: 33446 - protein, 216 aa, uncultured marine group II euryarchaeote 37F11
MDEGERQGMLNIVLFGPPGAGKGTQAQRMMDATGLPQVSTGDMLRAAVKAGTSVGIEAKSYMDKGALVPDSVIIDLIRDRLHDDDAKNGVMFDGFPRTVPQAEALSEIVEVSAVLAIDVPDERIVERICGRYSCGTCGTVYHDTFNPIQNGICGCGSFTEKRRADDVEETVLARLEAYHTQTSPLADFYRAAGIFHHVDGDRDIDVITTDLLAVLG

SEQ ID NO: 33447 - protein, 379 aa, uncultured marine group II euryarchaeote 37F11
MSDKRDYYEVLDVERTATEKDLKNAFRRLARKYHPDRSEEEDAENKFKEIQEAYAVLSDSDKRAHYDRFGHDSPGGNPFGGFSGGGFNINLEDLLGGDFFSGFFGGGGGGGGGRRRDRRGSDILVRHSIDLTTVISGSDESIELDLPSECIVCSGTGAKGGSTTTCNACQGQGRVRVRQQIGPFVNEVVQDCRECAGVGSTIDSKCQDCSGLGHKVESKTIRFSVPPGAEDGTRLRLRGQGQPAERGQGKTGDLLVEIEVLTHPWFERNGSDLIMSLPLGYPDLVLGTTITLDHIDGKTMDIVIPAKSSAGHTLEIKKRGLPRLRRNGRGDVIVLLKLHMPKSISKAEKKQLKAMKEGLNPNDQLQTILDDAADRRVNG

SEQ ID NO: 33448 - protein, 379 aa, Emericella nidulans
MAEFVRAQIFGTTFEITSRYTDLQPVGMGAFGLVCSARDQLTAQPVAVKKIMKPFSTPVLSKRTYRELKLLKHLRHENIISLSDIFISPLEDIYFVTELLGTDLHRLISSRPLEKQFIQYFLYQIMRGLKYVHSAGVVHRDLKPSNILINENCDLKICDFGLARIQDPQMTGYVSTRYYRAPEIMLTWQKYDAKVDVWSAACIFAEMLLGAPLFPGKDHVNQFSIITELLGTPPDDVIQTICSENTLRFVKSLPKREPQDLAKLPKFLALVHPDKKPEEDEDYKNTINLLKAMLVYNPKDRISAEAALAAPYLAPYHDETDEPVAEEKFDWSFNDADLPVDTWKIMMYSEILDFHNIDQGGDINPALVEGAGLNQQGFQ

SEQ ID NO: 33449 - protein, 487 aa, Vigna radiata
MRRGLDNQAYYVLGHKTPNIRDLYTLGRKLGQGQFGTTYLCTENSTSNEYACKSISKRKLISKEDVEDVRREIQIMHHLAGHKNIVTIKGAYEDPLYVHIVMELCSGGELFDRIIQRGHYTERKAAELTKIIVGVVEACHSLGVMHRDLKPENFLLVNKDDDFSLKAIDFGLSVFFKPGQIFTDVVGSPYYVAPEVLLKHYGPEADVWTAGVILYILLSGVPPFWAETQQGIFDAVLKGHIDFDSDPWPLISDSGKDLIRKMLCSQPSERLTAHQVLCHPWICENGVAPDRAIDPAVLSRLKQFSAMNKLKKMALRVIAESLSEEEIAGLREMFQAMDTDNSGAITFDELKAGLRRYGSTLKDVEIRDLMEAADVDKSGTIDYGEFIAATVHLNKLEREEHLIAAFQYFDKDGSGYITVDELQQACAEHNMTDAFLEDIIREVDQDNDGRIDYGEFAAMMQKGNAGIGRRTMRNSLNLSMRDASSAQ

SEQ ID NO: 33450 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 33451 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 33452 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33453 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33454 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33455 - protein, 173 aa, Flaveria pringlei
  misc_feature (63)..(63): Xaa can be any naturally occurring amino acid
  misc_feature (172)..(172): Xaa can be any naturally occurring amino acid
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 33456 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 33457 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 33458 - protein, 357 aa, Acetabularia acetabulum
MKQPGFDVKLQGIVKHYKTRKGIFKAVNGVDLEINSGEIVALLGPSGSGKTTLLRVMAGLEEITEGKIFYDGEDATDWSLEDRQIGFVFQGYALFKHLTVGDNIAFGPRMKKMDIDIRKRVKELLDLVQLPGLESRFPQQLSGGQRQRIALARALAYEPRLLLLDEPFGALDPEIREDLRNSLKRIISSLNLTSVMVTHDQEEAFEVADRVVVFNKGSIEQVGSLEDIYRNPQTAFVMDFVGEANHIPSRCVFAKRMKFISNKPQIMFRPTEIEPYETFREDISVCPAQVTYKCPVGPWTKYQLKFDDGVEIEMILDRKVDAQKYDFTVKQRIYVRVPPLMFMGFDYDEISSKPLPI

SEQ ID NO: 33459 - protein, 354 aa, Eucalyptus gunnii
MGSLEKERTTTGWAARDPSGVLSPYTYSLRNTGPEDLYIKVLSCGICHSDIHQIKNDLGMSHYPMVPGHEVVGEVLEVGSEVTKYRVGDRVGTGIVVGCCRSCSPCNSDQEQYCNKKIWNYNDVYTDGKPTQGGFAGEIVVGERFVVKIPDGLESEQAAPLMCAGVTVYRPLVRFGLKQSGLRGGILGLGGVGHMGVKIAKAMGHHVTVISSSDKKRTEALEHLGADAYLVSSDENGMKEATDSLDYVFDTIPVVHPLEPYLALLKLDGKLILTGVINAPLQFISPMVMLESITGSFIGSMKETEEMLEFCKEKGLTSQIEVIKMDYVNTALERLEKNDVRYRFVVDVVGSKLD

SEQ ID NO: 33460 - protein, 307 aa, Streptomyces coelicolor A3(2)
MSTPTTFRPVLERIAEEIERTPGSGRPADYIPALAARDPRRFGMAVAELDGTVYGVGDWREPFSAQSLTKVFTLALDLAREGDALWEHVGREPSGNPFNSLVQLEYENGIPRNPFINAGALVVTDRLHTRTGDAAGELLAFLRAESGNPDLGHDEEVAASEAAHGDRNAALAHFMASYGNIDNPVPVLLDQYFRQCSVAASCADLALATGFLARHGIRADGTRLLSRSRAKQINAVMLTCGTYDAAGDFAHRVGLPGKSGVGGGIIAVVPGHCTLCVWGPGLDERGNSVAGVAALDRFTTLTGLSVF

SEQ ID NO: 33461 - protein, 461 aa, Streptomyces coelicolor A3(2)
MPIATVNPANGETLRTYEAMGEEEIERRIELAEATFRTYRTTGFYERAGLMRRAADLLEADQKEIGKVITTEMGKPVKQARAEAAKCAKAMRWYADHAAELLADEEPAEADVKDSGASRALVRYRPLGPVLAVMPWNFPLWQVIRFAAPALMAGNVGLLKHASNVPQTALYLEDLFHRAGFPEGCFQTLLIGSAQVDDVLRDERVRAATLTGSEPAGRAVAATAGEMIKKTVLELGGSDPFVVMPSADVERAAEVAVTARTQNAGQSCIAAKRFIVHTDVYDAFAQRFTEGMRALKVGDPMDEETEVGPLSSEQGLNDLVELVDDAVRGGASVLCGGERPDGPGWYYPPTVLAGVTRELRIHREEAFGPVATLYRAADLDEAVLIANDTDFGLSSNVWTRDDADVDRFVRDLEAGGVYVNGMTASHPAFPFGGVKRSGYGRELSGHGIREFCNITTVWHGA

SEQ ID NO: 33462 - protein, 407 aa, Streptomyces coelicolor A3(2)
MTAPVRTARGSEELIRAEEPVLAHNYHPLPVVVARAEGAWVEDVEGRRYLDMLAGYSALNFGHRHPALVEAAHRQLDRLTLTSRAFHNDRLAGFAERLAALTGTDMVLPMNTGAEAVESGIKVARKWAYDVKGVPADRATIVVAADNFHGRTTTIVSFSTDETARSGFGPFTPGFRIVPYNDLAALEAAVDETTAAVLIEPIQGEAGVLIPDDGYLAGVRELTRRKGCLFVADEIQSGLGRTGHTLAVEHESVVPDVVLLGKALGGGIVPVSAVVGRRDVLGVLHPGEHGSTFGGNPLAAAVGTAVVELLETGAFQRRAAELGAVLREGLAALVGRGVVGFRARGLWAGVDVDPALGSGREISERLMREGILVKDTHGSTIRLAPPLTVTAEELTGALGTLEKVLTS

SEQ ID NO: 33463 - protein, 250 aa, Medicago truncatula
MPIRNIAVGTPQEATHPDTLKAGLAEFISTFIFVFAGSGSGIAYNKLTNDGAATPAGLISASIAHAFALFVAVSVGANISGGHVNPAVTFGAFVGGNITLLRGIVYIIAQLLGSIVASALLVFVTASSVPAFGLSEGVGVGPALVLEIVMTFGLVYTVYATAVDPKKGNIGIIAPIAIGFIVGANILVGGAFTGASMNPAVSFGPAVVSWSWSNHWVYWAGPLIGGGIAGLVYEVLFINSTHEQLPTTDY

SEQ ID NO: 33464 - protein, 472 aa, Streptomyces coelicolor A3(2)
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 33465 - protein, 269 aa, Bacillus subtilis
MDQTRTLGKTKLKVKRIGFGANAVGGHNLFPNLNDETGKDLVRTALDGGVNFIDTAFIYGLGRSEELIGEVVQERGVRNELIIATKGAHKEVDGSIELDNSREFLRSEVEKSLKRLKTDYIDLYYVHFPDGKTPLAEVAGTLKELKDEGKIKAIGASNLDYQQLQDFNADGYLEVFQAEYSLIQRDAEKELLPYCEKQGISFIPYFPLASGLLTGKFTQDTVFDDFRKDKPQFQGETFIHNLKKVDKLKAVAEEKQADTAHVALAWLLT

SEQ ID NO: 33466 - protein, 473 aa, Acidithiobacillus ferrooxidans
MSQKIFLRITGMTCAHCAHSVEKALLGIHGIDSAQVSLATNQAEVFLQSSIPTEALLAAVTQAGYGAKVEQDSLQVQARSTQEPGQPHIAIIGSGGAAMAAALKAVERGARVTLIARGTIGGTCVKVGCVPSKILIRAAHIAHLRRASPFDAGIAAQEPVIRRDRLLAQQQGRVDELRYAKYEGILAQTPAISVLRGEATFQNTQTLSVVLADGGVHELRFDRCLIATGASPAIPPLPGLADTPYWTSTEALASETIPERLVVIGASVVAVELAQAFARLGSKVTILARSVLLSHEDPAIGEAITSAFRAEAIHVLEHTQPNRADYNDGQFLLTTGNGHLRADRLLIATGRAPNTHSLNLAAVGVEVNAHGAIVIDKTMRTSAPYIRDLKRRLDGGQRKLLANVRNTTGSYIIQHEEVAQLQLGEQVVHTARFSAFYTDRQAPRRYVAHGEPRFIAFLTALATSFFQTARNGP

SEQ ID NO: 33467 - protein, 348 aa, Eucalyptus camaldulensis
MDANGVKQPLLSKPLNSPQTDKKELKRNRLRRCKSAPLAEAVPQEANLNGPVQPSNSILRNLHPSFKRVAIILVFYLGIGTMCFYLVRNEIDGEKTNDLFDAVYFCIVTMTTVGYGDLVPGSALTKLLACAFVFSGMAIVGLILSRAADYLVEKQEILLVKALHLRNKVGPTEMLKEIETNGVRYKCVTAFILLLLLIVAGTTFLALIENLDIVDAFYCVCSTITTLGYGDKSFSTEGGRIFAVFWILTSTICLAQFFLYIAELNTENRQRALVKWVPSRRMTNFDLEAADLDNDGVVGAAEFIIYKLKEMGKINQEDISLILEEFDDLDVDQSGTLSGSDITLAQSS

SEQ ID NO: 33468 - protein, 228 aa, Acidithiobacillus ferrooxidans
MSQKIFLRITGMTCEHCAHSVEKALLGIHGVDSAQVSLATNQAEVFLQSSIPTEALLAAVTQAGYGAKVEQDSLQVQARSTQEPGQPHIAIIGSGGAAMAAALKAVERGARVTLIERGTIGGTCVNVGCVPSKILIRAAHIAHLRRASPFDAGIAAQEPIIRRDRLLAQQQGRVDELRYAKYEGILAQTPAISLVRGEATFQNAQTLSVVLADGGVHELRFDRCLIAV

SEQ ID NO: 33469 - protein, 463 aa, Schizosaccharomyces pombe
MDDIEDSLDQWKFAQCFGDKGDVEDITEADIISAVEFDHTGDYLATGDKGGRVVLFERNHSKKGCEYKFFTEFQSHEPEFDYLKSLEIEEKINKIRWCKRTNRAHFLLSTNDKTIKLWKLYEKNLRVVAENNLSDSFHSPMQGPVTTPSQLRLPRLNHHDMIIAAYPRRVYANAHAYHINSISVNSDAETYISADDLRINLWNLSISDHSFNIVDIKPENMEELTEVITSAEFHPINCNHLMYSSSKGNIKLLDLRQSALCDNPCKLFEDQEDQDSKSFFSEIISSISDVKFSQNGRYILSRDYLTLKIWDVNMEKAPVKTIPLHDVLRSKLCDLYENDCIFDKFECTFSGDDKHVLSGSYSNNFGIYPTDSSLPGDRGQIVLQADKAAFRARKSAANNVPKLNAVKNNDWRSQPQAAMGSASVGLDPDNLDYNKKILHASWHPFEDSVAIAATNNLFVFSKL

SEQ ID NO: 33470 - protein, 214 aa, Beta vulgaris subsp. vulgaris
MANRVDHEYDYLFKIVLIGDSGVGKSNILSRFTRNEFCLESKSTIGVEFATRTLQVEGKTVKAQIWDTAGQERYRAITSAYYRGAVGALLVYDITKRQTFDNVQRWLRELRDHADSNIVIMMAGNKSDLKHLRAVSEEDGQALAEKEGLSFLETSALEAVNIEKAFQTILTEIYHIISKKALAAQEASSNLPGQGTTINVADASANQRRSCCST

SEQ ID NO: 33471 - protein, 388 aa, Aspergillus flavus
MVLPTAPEPPTLLGYHRILSSSAGVRVSPLCLGTMSFGNGWKGVMGECDQATSFNMLDTFYESGGNFIDVANFYQGGDTERWVGEWMAQRQNRDEIVLSTKYTMGYTMFGPQKIKSNYQGNHAKSLRLSVKASLQKLQTDYIDLLYVHMWDFTTSVEEVMRSLNHLVANGKVLYLGVSDTPAWLVVKCNAFARANGLTPFSVYQGHWSCAFRDFERDILPMCESEGMGLAPWGVLGRGQFRSAEEFSREGRKMGPQDEKHRRLGEKLDQMAQQKNTKATSIAQAYVMHKAPYVFPVIGGRKVEHLKENIEALGLVLSEEEIREIDDAEPFDVGFPMNFSFETPTQSYRTNMTSKDIWQLSCNTRLETVPKQQPIEPFQGAKYFGSASK

SEQ ID NO: 33472 - protein, 286 aa, Arabidopsis thaliana
MAEMYNNMGPQPGMPRPPGNPEPGPFGNPFTGAGSGFIRGGLGAYGERILGSSSEYVQSNISRYFSDPQYYFQVNDQYVRNKLKVVLFPFLHRPFNCTIVGSASNPQGHWTRISEPVGGRLSYKPPIYDINAPDLYIPFMAFGTYVVLAGLSLGLNGKFTPEALNWLFVKGLVGWFLQVMLLKVTLLSLGSGEAPLLDIVAYGGYAFAGLCLAGFAKIMWGYSYYALMPWTCLCTGIFLVKTMKRVLFAEVRSYDSSKHHYLLLFLALVQFPLLIWLGNISVNWLL

SEQ ID NO: 33473 - protein, 436 aa, Arabidopsis thaliana
MDRFSNLPDDVIYHIVSFLSAKEATCLKFVSKNFQNLVTIKRNVVFHHWESFKNFVDGLLAEPASYRIKRFSLKLVSMDFAQYNIVNDCLCNVLKRGVLDLELDINVKEDYILPSDVFTCKTVVRLKLGCGFVIDILPKNALLPALKTLILDSVRFYASDGCAFTRLLSASPVLEELVIDRLNWEHWKGSRFVSSPTLKRLTLRRKEWEPEPETWTDFESVSFDTPSLAYLKYKDVIPYGYPIVNLNSIVEARLTLPREVEYDYWLNRSADPSNLIRGLKNVEILSIKVLHTMDLLFYNFKEAVPVFENLIHLSVTSEADFCWDPLQILLEKSPNLKTLTIEGPLHYNFYEKLDLEAVCECLLGYSFLLSCPIKVLKITEFVGDIGEIVQMKHVLGKLPCLELLEVHVQARRDDKKLQIMADLLMLPRTSSKCKVK

SEQ ID NO: 33474 - protein, 1021 aa, Actinoplanes sp. 50/110
MDERLKSHIVRALLPVLVGAAGGLPAPRAAQAESPPDRPSHAEQLYLVMPDRFANGDTGNDQGGLTGDRLTTGYDPTDAGFYHGGDIQGVIDKLDYIQGLGTTAIWLTPIFKNKPVQGTGPNASAGYHGYWITDFTQVDPHFGTNEDLKRLVGLAHRRGMKIYLDIVVNHTADVIKNAEGTAYADKGTAPYRDTAGRPFEDRNYADGTHGFPKVDEKSFPHRPFFEKPSDATAKAPAWLNDPTMYHNRGETTFGGENAEYGDFTGGLDDLWTERPEVLHGLTDIYAGWIRRFGVDGYRLDTLKATDLAFWRPFAEGVGKAADKAGKRDFFLFGEAWSKDQEVTSTFVRRGGLPATLDFPFQGAAQSYARGQGTGQQPWQDLYAKDDLYSRRPGPTPAGCHLGEWNHDMGRIATLIKAGSDPKRGCRLELVNELMFLTRGQPGGLLRADEQGFTGRPRLNKGSRQDMFASRTPDYLDDRLIGTDKTHASDNHDTGHPLYRTIAELGAVRKAHPGLRDGEQITRYAADRAGVFAASRIDRDQRAEYVIAVNNATTAQTVTFDTYTPGCGFQPLYGTGETAATGADGRLTITVPALSAVAYRAEKPIPAADGAPAVTITAPAGRDPRAGPHRTDRAVTGDPLSTVTFSARAGNGPWQPIGTAGRGPYRVFHDLTGLAGGAEVQYRRSPGTPRPYRHHHQPDPVGTVRAEAGYAVVHYQRPAGDYDGWRLHATGERSKRPRSNPQGEPFTGNGTPNGPFAWVKLRPGATKVTFTVSDANGVKDVDADRSLNPQQTPGIWLHQGDPAISYQGPAPAPAPNTAILHYRRPAGDYTGWGLHLWDGAATPTADWGAPLLPESFDSFGAVFRIPLAAGATGLSYIMHAGEAKDLPTDQRLEFADAGREVWVQAGVQERLLPSVVKPAKLDLTRADAVRVDRDTIAWQTGTPDTLEPAGAATDGRVYDLVHAPNGGLRLVDGDLAGDYRSIRLTAQRDGLTEKQRRQAPELWQYPAFQAAAPCPPVTDSSM

SEQ ID NO: 33475 - protein, 475 aa, Arabidopsis thaliana
MAATTRRLLYYVSKRFSTAGVRRSYGGLPQSNSKSPPSSSQRLMELESEFSAHNYHPVPVVFSRANGSTIWDPEGKRYIDFLAAYSAVNQGHCHPKIMKALQEQVEKLTLSSRAFYNDKFPVFAERLTNMFGYDMVLPMNTGAEGVETALKLARKWGHEKKNIPKDEAIIVSCCGCFHGRTLAIVSMSCDNDATRGFGPLLPGNLKVDFGDADSLEKIFKEKGDRIAGFLFEPIQGEAGVIIPPDGYLKAVRELCTKYNVLMIADEVQSGLARSGKMLACDWEEIRPDMVILGKALGGGVIPVSAVLADKDVMLHIKPGQHGSTFGGNPLASAVAMASLDVIVEEKLVERSASLGEELRIQLNEIKKQFPKYIKEVRGRGLFNAIEFNSESLSPVSAYDICLSLKERGVLAKPTHNTIVRLTPPLSISSDELRDGSEALHDVLELDLPNLLKINSGKTPVSHITECDRCGRNLYA

SEQ ID NO: 33476 - protein, 402 aa, Arabidopsis thaliana
MFRDSFLFARTIGCFGCFGSSGSRNQQSPKPYDDDTHSCDSDVTSTARGEEEEDEEEVEQKSRSKRSEEILKYRLDNGLICRHIPVRETNELIRGEDENGDKTINEYVRVCKIGSGSYGKVVLYRSTLDGQYYAIKAFHKSHLLRLRVAPSETAMSDVLREVMIMKILEHPNIVNLIEVIDDPETDHFYMVLEYVDGKWVYDGSGPPGALGEKTARKYLRDIVTGLMYLHAHDVIHGDIKPDNLLVTSSGTVKIGDFSVSQDDDDQLRRSPGTPVFTAPECCLGITYSGRAADTWAVGVTLYCMILGQYPFLADTLQDTYDKIVNNPLIIPDGLNPLLRDLIEGLLCKDPSQRMTLKNVSEHPWVIGEDGHVPEYFCWCKRNAASKIEEGEANGISETSDPN

SEQ ID NO: 33477 - protein, 375 aa, Arabidopsis thaliana
MGRGSLGKLMGGEERASKDTDTFNIFGPFHLTSIDWNNQYHRTSVASSLVNGVYTLEGDRLEEREGSEALAKPWWEFFHFTLLETLIDDDSSIYGAIFEYELYHLYQNTPHVKVPRYVIAFRGTVLKGKTWKFDLKLDLKCIFNTLHQGGRSMYAINVIRRMVDKHNHSAIWLAGHSLGAALVLLAGKTMKISGFLLESYIFNPPISSIPLEQLPGGDIIKGLFQITKSVVKATVAMALTDLQVPKDDPKTASWIPYLYVNPADPICAGYIDYFRHKTFMSEIGASHIERIGARKSVRSLLVGRRGKLSPSDLSSEPLHLLPSADMTVNKNKPTKSTTAHGLHQWWERDSTLRENWESCCIRPYHEGKLEQLTIQ

SEQ ID NO: 33478 - protein, 245 aa, Arabidopsis thaliana
MPDVKLDIRCILDNLHQGPRTIHAIQAIRAMIDKHSESAIWLAGHSLGAALVLLAGKTMKISGFLLESYIFNPPIISIPLEQLPGGVLLKGVFRITESLVKATAATVTMALTDQRVQEDSKTALWIPYLYVNPADPICAGYIDYFKHKIFMSKIGASHIERIGSRSSFRNPWTRRIGTSSSSSSPLSDLSMEPLHLLPSADMTVNKNKSASSMAAHGLHQWWEQDSVLRKNWKNCLIRPDPGDKS

SEQ ID NO: 33479 - protein, 342 aa, Arabidopsis thaliana
MASRREIFSFSGPPPIPSFDWNNLYHRASLVSCLVQGVYTMERDRQQNRCGSDSKARPWWAFYRFTLYQQLRDALDGSIYGAVFQNDINYQNTPNSIVPPRYIIALRGTILSPQTMACDVQLNIRIAFENLYRGGRFVQAIQAMQYFVATYGNTAIWIAGHSLGAGLALLAGKIMAMYGCPVEAYIFNPPISLIPLEQLVESEDLKCAVRLARDILKAGIARVLDLNEVSNLHNTYASWRPHLFVNQSDPICSEYIGYFNHRGDMNELQLGRIERLARYSIRRILFGGGESSSSYSSEEHLHFLPSAIVMVNTIISPDFQTDHGIHQWWNPMLGQFSYQIIA

SEQ ID NO: 33480 - protein, 307 aa, Arabidopsis thaliana
MEDFYDIKASTIEGQAVCMFGIFDGHGGSRAAEYLKEHLFNNLMKHPQFLTDTKLALNETYKQTDVAFLESEKDTYRDDGSTASAAVLVGNHLYVANVGDSRTIVSKAGKAIALSDDHKPNRSDERKRIESAGGVIMWAGTWRVGGVLAMSRAFGNRMLKQFVVAEPEIQDLEIDHEAELLVLASDGLWDVVPNEDAVALAQSEEEPEAAARKLTDTAFSRGSADNITCIVVKFRHDKTESPKIETNAMAESEPELNPTTELEPESNPSTALETESIPKAELESEPDAIPDPKPETEPETKGEKAGE

SEQ ID NO: 33481 - protein, 311 aa, Arabidopsis thaliana
MSSPDIVGILENTKELDRLRKDQEEVLVEINKMHKKLQASPEIVEKPGDISLAKLKNLYIQAKELSENEVTVSNILLTQLDLLLPYGPTGQQRRKLGEGNDQKRKRMKVDSDVIRLSPSMRNQIEAYASLKGEQVAARVTAESADKDEWFVVKVIHFDRETKEVEVLDEEPGDDEEGSGQRTYKLPMLCILPFPKRNDPSNTQEFPPGKHVLAVYPGTTALYKATVVSTPRKLLNMDVNSSNIRGSLTSKFVNLLCLLYTENGVFSSISYNKTICLIRYLLEFDDDEEDGALPQRTVPFHKVVALPEGHRQ

SEQ ID NO: 33482 - protein, 313 aa, Arabidopsis thaliana
MTCASSDDNESEKDKDSESFVEVDPTGRYGRYGELLGSGAVKKVYRAFDQEEGIEVAWNQVKLRCFSDDPAMTERLYSEVRLLKNLKNSNIITLYKVWRDERNNTLNFITEICTSGNLREYRKKHRHVSMRALKKWSKQILKGLDYLHTHDPCIIHRDLNCSNIFVNGNIGQVKIGDLGLAAIVGKNHLAHSILGTPEFMAPELYEENYTEMVDIYSYGMCVLELVSLEIPYSECDSVAKIYKRVSKGLKPEALNKVNDPEAKAFIEKCIAQPRARPSAAELLCDPFFDGILDDDDEDGENNDNNGAGRIVVS

SEQ ID NO: 33483 - protein, 449 aa, Arabidopsis thaliana
MDKISGFSDDELLVKILSFLPFKFAITTSVLSKQWKFLWMRVPKLEYDEDSMYSFEYSFRYFLPKAKEVDSETYSIVSESGHRMRSFIEKNLPLHSSPVIESLRLKFFTEVFQPEDIKLWVEIAVSRCAQELSVDFFPKEKHNALLPRNLYTCKSLVTLKLRNNILVDVPHVFSLPSLKILHLERVTYGDGESLQRLLSNCSVLEDLVVELDTGDNVRKLDVIIPSLLSLSFGMSRYCAYEGYRIDTPSLKYFKLTDLSKTFSGLIENMPKLEEANITARHNFKKLLELVTSVKRLSLNIENNDAEALTAIYGDDIVFNELEHLNFHIHNAYWSELLYWLLKASPKLQNLEFDEQCSRDGTMGTLAVFWNQPNSVPQCLLSTLQTFEWSGYPGSVQGKDLATYILRKSRQLKIATISIGYGLDPQQKLKMEMDVKFSFRASPTCKRVFY

SEQ ID NO: 33484 - protein, 246 aa, Arabidopsis thaliana
MVASISTLIRRTYPSTNQCNSLATIQSQTQLPRESLQHHSSAEGRLRFSGRVFCSESGAGCWNCGEKAAFLFCNSCRSIQPVDDSVDYFQIFGLEKKYEIDPGSLEGKYKDWQKKLHPDLVHNKSKKERDYAAEQSAKVTEACRTLTKRLSRAMYIMKLNGVNVNEEETITDPTLLMEIMELREAISEADDSTSLNQIRSQVQEKLKQWSDSFVEAFESQKFDDAVKCIQRMTYYERACEEILKKL

SEQ ID NO: 33485 - protein, 216 aa, Arabidopsis thaliana
MLAGLATCGFMMNIVSRASDLTQDFKTGYLTLSSPKSMFVSQVIGTAMGCVVSPCVFWLFYKAFDDLGLPNTEYHTPFATVYRSMAKLGVPRECLVLCYVFFGVAILVNIVKDSLHSKWGRFIPLSMAMAIPFFLGLYFAIEMCVGSLILFIWERVDAAKAEAFGTAVASCLICRDGTWSKPSSVLAVAAVNPPVCMKFLSSQTNSKVDNILQGST

SEQ ID NO: 33486 - protein, 438 aa, Arabidopsis thaliana
MGSRDFISSLPDEVLGKKILSLLPTKLVVSTSVLSKRWRNLFHFVDSFDLEDSTPIRNADSFSDFMKDTVALLSNCPIKRLTLNSHYEKSSVNRWIRSALKRGCLELNLQSQYDHYLDIGIFFRNNTLVKLTLSSYRTFLRGNVPPEGRVFFPALKTLSLGAVVAKPALYNWLISGCPVLEELFILDVGSGDDQPTWTRSVVSASIKRLTIVFHFPHNTYPYEDDVEIKTPNLEFLDYSALRSDGSDVDYLDSLAEARLDLRLWELTNTFDFGEVTNLVSAIRNVKTLHLSSSSLEAFYYRCYTMPVFDKLIHLSIESDKENGWQALPRLLLKSPNLQTLAIKGLLHKVTYRCGNACACTSKPKKGRCCLSTCRVKVLEISGYGGSLREVKQMEHFLRKLKYLETVKIGVEEDNDSEHLRTELMTLDIASSKCNIQFI

SEQ ID NO: 33487 - protein, 456 aa, Arabidopsis thaliana
MDLLSNLPYELLCHILSFLTTKEAALTSVLSKRWRNLIAFVPNVDIVDHDIRELFMDFVDRVLALQGNSPINKFSLDCSGVDSDRVDCWIQNVMVRGVSELNLSIFVDSVFEDDYNLFPKVFENKKLVKLGLSYISWLDGSIFLPMLKTLVLESVLLSVEKFEILLHALPALEELVMNNIYWKERDVVDLIVSSESLKTLTINFIVCTHTLSFDTPILAYLSYSGYVVDDYAEAKMENLFEARISLLVVEGDISRVRALINNDLLEDDEYDVLQFENVWKLMNGIRNIRCLYLSPNTLEVLSLCCESMPVFKNLKSLSIKSAENRGWQAMPVLLRNCPHLETLVLEGLLHHVTDKCGDACDCVSREDKGRSLTSCPVKVLEIKGFQGTTKEMNMIKHFLEYFPCLKELKMYMEENDPAQLRVPEVITGEMMERYKKSSSCNVQLLVGGKLYKKWTP

SEQ ID NO: 33488 - protein, 484 aa, Arabidopsis thaliana
MNKSKKGKSKTVWVCESCGHSEGQWWGSCRACHKVGTMKRFSEGSESSASGGGGNGTGLGFTEGKGLSWLPEQATVQPHRLTDVIHGITQQQWRISLPGLFGNEVARVLGGGLAPGSLILIGGDPGIGKSTLLLQGSELAEPAPVLYISGEESVEQIGSRADRMRIQTEELYLFSSSDLQDILNKAHRLSPRALIIDSIQTVYLKDVTGSAGGLTQVKECTSTLLRFAKKSNIPVFLVGHVTKAGDIAGPRVLEHIVDVVLYLEGEESSTYRLLRSVKNRFGSTDELGVFEMANSGLEVVSNPSGIYLSQQNPDSDVLAGLAVAVVMDGSRSFLIEVQALCSPGSTVSRHVNGVQASRADMIIAVLMKQAGLRIQENGIFLNVANGMALSETAGDLAIAAAICSSFLEFPIPHGVAFIGEIGLGGEVRTVPRMEKRVSTVAKLGFNKCVVPKSVEESLKALSLKEIEIIGCKNLKELINAVFKG

SEQ ID NO: 33489 - protein, 499 aa, Arabidopsis thaliana
MAELIIVDFQNISIFILLCLFSFLCYALFFKKPKGFDLPPSPPSLPIIGHLHHLLSSSLPHKSFQKLSFKYGPLLHLRIFNFPMVLVSSASMAYEVFRTNDVNVSYRFVPVNKDSLVFGSSGFVTAPYGDYWKFMKKLISTKLLRPHALELSKGNRAEELRRFCLDLQGKARKKESVEIGKVALKLTNNIICRMSMGRSCSEKNGVAERARELVNKSFALSVKLFFSNMFRKDIMGVSREFDEFLERILVEHEENLEGDQDRDMIDHLLEAYRNEEAEYKITRKQIKSLIVEIFLGGTDSSAQTIQWTMAEILNNPGVLEKLRAEIDSVVGGKRLIQESDLPNLPYLQAVVKEGLRLHPSAPVLLRVFGESCEVKEFYVPEKTTLVVNLYAVNRDPDSWEDPDMFKPERFLVSSISGDEEKIREQAVKYVTFGGGRRTCPAVKLAHIFMETAIGAMVQCFDWRIKGEKVYMEEAVSGLSLKMAHPLKCTPVVRFDPFSF

SEQ ID NO: 33490 - protein, 368 aa, Arabidopsis thaliana
MDFDSISRESTFLSPLLNQNAMWQMNLGSDDTMGVDGSYPERHGEPDCAYYIRTGLCRFGSTCRFNHPHDRKLVIATARIKGEYPERIGQPECEFYLKTGTCKFGVTCKFHHPRNKAGIDGSVSVNVLSYPLRPNEDDCSYFLRIGQCKFGGTCKFNHPQTQSTNLMVSVRGSPVYSALQSLTGQPSYSWSRTSFVANPPRLQDPSGFASGSQGGLFSSGFHSGNSVPLGFYALPRENVFPERPGQPECQFYMKTGDCKFGTVCKFHHPRDRQTPPPDCVLSSGEPLCVFYSRYGICKFGPSCKFDHPMRVFTYNNNTASPSPSSSLHQETAITTELRNLLVSSSVEAKPTSLPETTSAKDTIVDAQH

SEQ ID NO: 33491 - protein, 369 aa, Arabidopsis thaliana
MIENDDSPQHPSLFFTDFTRANSHVRVLHHKFLGKGVYGSVDLIRYTKTDGSSLQAAVKTSYAEDLEEYDALKREIQILSELKGYPNIVICYGDDLEEDFNEHGHKVYKLLLEYANEGSLSSFMENYPDRKLPDPMIRDFTRMILEGLVSMHSHGYVHCDLKSDNLLIFSRKDSASCELKIFDFGNCRQVGEVPDHWKSDYPYVGTPESFFDGVAKKTLDLWSLGCLVLKIYTGEQPWERVTSVDFVNFLSDGEAPNIPEYVPCDAREFIETCFAREHEKRGTASELLLHPFLCQKQPLLVKLKLRIKQASKITMGIREKPLTLKMFLSKPPQLKKLLSKLLRLKKMIHPKPLELDSSFVSYSSDLCLL

SEQ ID NO: 33492 - protein, 413 aa, Cupriavidus necator
MMSLSHATNPQPKPAAAPHTLAALLAAGGLAGKRVFIRADLNVPQDAAGAITDDTRIRASVPAIAACLQAGAAVMVTSHLGRPQEGAPDPRHSLAPVGRRLSELLGRQVPLLSGWTEGGFQVPPGQVVLLENCRMNTGEKKNSDELAQKMAALCDVYVNDAFGTAHRAEATTHGIARYAPIACAGPLLAAEIDALGKALGQPARPLVAIVAGSKVSTKLTILKSLADKVDNLIVGGGIANTFMLAAGLKIGKSLAEPDLLADARAIIDIMARRGASVPIPVDVVCAKEFSATAAATVKDVKDVADDDMILDIGPKTAAMLAEQLKAAGTIVWNGPVGVFEFDQFGNGTRVLAQAIAESKAFSIAGGGDTLAAIAKHGIADRVGYISTGGGAFLEFLEGKTLPALAVLAQRAAA

SEQ ID NO: 33493 - protein, 266 aa, Arabidopsis thaliana
MGHDNITKLGSLLVKLHKGPSSWLCLHPRPDRTSNGGRIKLVRSDGSLQVYDRPVVVSELTKDFPKHKICRSDLLYIGQKTPVLSETETLKLGLNYFLLPSDFFKNDLSFLTIATLKTPQNGGVLVKKTQQQPQPFLIQKGEKGERLRIRVSEEFVSELMMEGKKNRVNEEEEEEEGGGEGEGRVCTTVKLKKDYVQLVGLRRWKPKLETITETKAMKAATMEKTKKKRKRFTVMKKKSQSDSSSKRKLQSKSKSKTKKSIMRKID

SEQ ID NO: 33494 - protein, 139 aa, Agaricus bisporus
MSGKGKAGKSGGKAGSETKSMSRSSKAGLQFPVGRVHRLLKKGNYAQRVGAGAPVYMAAVLEYLAAEILELAGNAARDNKKQRIVPRHLQLAIRNDEELHKLLGNVVISQGGVVPHIAPELLPSKSSKGKKDEGVSQEL

SEQ ID NO: 33495 - protein, 458 aa, Pseudomonas fluorescens
MTTTSSSLADKDMRHQLHPYTNARAHEELGPLVIDRGDGVFVIDENGKPYIEAMAGLWSAALGFSNKRLVAAAEKQMSTLPFYHLFGHKAHAPSIELAEKLINMAPVPMSKVFFTNSGSEANDTVIKLVWYLNNAQGKPARKKIISRIGGYHGITLASASLTGLLANQRGFDVPLPGFLHVGCPHHYRHALPHETEEQFADRLAAELDALIVKEGPETIAAFVGEPLMGPGGVIVPPRTYWEKIQRVCRKHDILVVADEVICGFGRTGKDVRQPDFGIEPDIMILSKQLSSSYQPISAILINDRVYQGIADQTKSFGALGHGFTGGGHPVAAAVRLENLKIIDEENLVVHAAHMGELLRRGLQGFSDHPLVGEVRGAGLIAAVELVADRATKAPLDAPGTLGRFLAGRAQEHGMITRNLGDAIAFCPPLIINEDEDEVQSIVDRFGMALDDTSKWVNG

SEQ ID NO: 33496 - protein, 211 aa, Gossypioides kirkii
AKGQTPLFPRILAHEAGGIVESVGEGVTDLKPGDHVLPVFTGECGNCRHCKSKESNMCDLLRINADRGVMLSDGKTRFSINGKPIYHFLGTSTFSEYTVAHVGSVAKINLAAPLDKVCVLSCGISTGLGATLNVAKPTKGSTVAIFGLGAVGLPATEGARIAGASRIIGVDLNPNRFEEAKKFGCTEFVNPKDHNKPVQEVLAEMTNGGVD

SEQ ID NO: 33497 - protein, 211 aa, Gossypium robinsonii
AKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVD

SEQ ID NO: 33498 - protein, 211 aa, Gossypium raimondii
AKGQTPLFPRIFGHEAGGIVDSVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 33499 - protein, 211 aa, Gossypium hirsutum
AKGQTSLFPRIFGHEAGGIVESVGEGVTHLKPGDHVLPVFTGECGNCRHCKSKESNMCDLLRINTNRGVMLSDGKTRFSINGKPIYHFVGTSTFSEYTVAHVGSVAKINPAAPLDKVCILSCGISTGLGATLNVAKPTKGSTVAIFGLGAVGLAAAEGASIAGASRIIGVDLNPNRFEEAKKFGCTEFVNPKDHNKPVQEVLAEMTNGGVD

SEQ ID NO: 33500 - protein, 211 aa, Gossypium hirsutum
AKGQTPLFPRIFGHEAGGIVDSVGEGVTHLKPGDHVLPVFTGECGNCCHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 33501 - protein, 233 aa, Gossypium robinsonii
KILFTSLCHTDVYYWEAKGQTPVFPRIFGHEAGGVVESVGEGVTELKPGDHVLPVFTGECGDCGHCKSEESNMCDLLRINTDRGVMLSDGKTRFSINGKPIYHFVGTSTFSEYTVVHVGCVAKVNPAAPLDKICVLSCGISTGLGATLNVAKPTKGSTVAIFGLGAVGLAAAEGARIAGASRIIGVDLNPNRFEEAKKFGCNEFVNPKDYDKPVQEVLAEMTNGGVDRSVECT

SEQ ID NO: 33502 - protein, 203 aa, Gossypium raimondii
AKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLA

SEQ ID NO: 33503 - protein, 230 aa, Gossypium hirsutum
LFTSLCHTDVYFWEAKGQTPVFPRIFGHEAGGVVESVGEGVTELKPGDHVLPVFTGECGDCRHCKSEESNMCDLLRINTDRGVMLSDGKTRFSINGKPIYHFVGTSTFSEYTVVHVGCVAKVNPAAPLDKICVLSCGISAGLGATLNVAKPTKGSTVAIFGLGAVGLAAAEGARIVGASRIIGVDLNPNRFEEAKKFGCNEFVNPKDYDKPVQEVLAEMTNGGVDRSVEC

SEQ ID NO: 33504 - protein, 230 aa, Gossypium hirsutum
LFTSLCHTDVYFWEAKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLAEMTNGGVDRSVEC

SEQ ID NO: 33505 - protein, 455 aa, Bacillus sphaericus
MKQVLTELQEKDLQHVWHPCSQMKDYEAFPPIVIKKGEGVWLYDEQNQRYLDAVSSWWVNLFGHANPRISQALSEQAFTLEHTIFANFSHEPAIKLAQKLVALTPQSLQKVFFADNGSSAIEVALKMSFQYHMQTGKTQKKRFLALTDAYHGETLGALSVGGVDLYNEVYQPLLLDTVRAQGPDCFRCPFKHHPDSCHAQCISFVEDQLRMHHKEITAVIIEPLIQAAAGMKMYPAIYLRRLRELCTQYDVHLIADEIAVGFGRTGTLFACEQANISPDFMCLSKGLTGGYLPLSVVMTTNDVYQAFYDDYATMKAFLHSHSYTGNTLACRVALEVLAIFEEEQYIDVVQDKGERMRKLALEAFSDLPFVGEYRQVGFVGAIELVANRDTKEPLPSEERIGYQIYKRALAKGLLIRPLGNVLYFMPPYIITDDEMQFMIQTTKDTIVQFFEEREG

SEQ ID NO: 33506 - protein, 242 aa, Geobacillus stearothermophilus
MIYFHQVNKYYGDFHVLKDINLTIHQGEVVVIIGPSGSGKSTLVRCINRLETISSGELIVDNVKVNDKHIDINQLRRNIGMVFQHFNLYPHMTVLQNITLAPMKVLRIPEKEAKETAMYYLEKVGIPDKANAYPSELSGGQQQRVAIARGLAMKPKIMLFDEPTSALDPETIGEVLDVMKQLAKEGMTMVVVTHEMGFAREVADRIVFMDQGRILEEAPPEEFFSNPKEERAKVFLSRILNH

SEQ ID NO: 33507 - protein, 503 aa, Acinetobacter sp. M-1
MHYVDPNQSGSKIHFKDQYENFIGGQWVAPVKGVYFDNISPVDGKSFTRIPRSSAEDIELALDAAHKAKKEWNKSSPTTRSNLLLKIADRMEANLEMLAVAETWDNGKPVRETLAADIPLAIDHFRYFAGCIRAQEGGISEIDEDTIAYHFHEPLGVVGQIIPWNFPILMAAWKLAPALAAGNCVVIKPAEQTPVGILLVAELIQDLLPAGVLNIVNGYGAEVGRPLATSPRIAKIAFTGSTQVGQLIMQYATENIIPVTLELGGKSPNVFFADVMDHDDDFLDKTLEGFAMFALNQGEVCTCPSRALIQESIADQFMEKAIERVKRIKLGHPLDTDTMVGAQASLEQQEKILRCIDTGRQEGAEVLLGGHGRQEVGNGYYIEPTIFKGHNNMQVFQEEIFGPVLSVTTFKDFDEAIQIANDTMYGLGAGVWSRSTHTAYRAGRAIEAGRVWTNCYHIYPAHAAFGGYKKSGVGRENHKMMLDHYQQTKNLLVSYSTKAMGFF

SEQ ID NO: 33508 - protein, 2413 aa, Vibrio cholerae
MKEMTAMQAAYWLGRQHDCLLDGVAAHLYAEFDGQALNRQALTEAVRALYAKHPMLRLAITKDGQQKILPLSTFHQLKVDDLSQWKPDEVESFVHTKRQRMTHQMLDLTQGNPIEISLTLLPEGKHRLHIDADMIACDAQSFRLLVDDLTSLYLEAIEHRLEIIESDVVTFFQYLDAQQADRALAKRKEVDKKWWQERLATIPAEPSLPYQPVPTDAVSANSQRFAHWFTPVERKGLAEVARQHHLTLTQLTLALFSQVIANACQERQFRLNVPTFHRGNRSLDIEHTIGDFSNLLIFSADVGTTQTLLSLCQQTANQLHQLLRHESYSGVSVMRDLSRKQGGVQRSPIVFTSGMEMRDEEIFSDHVTQHLGRMNWVISQGAQVTLDAQIAPAYEGILLNWDVRMENFADKDITALFAHYVDLIRCVALHPEMMQQSVQQIDAQLGYARRESIQEMPLTPLQQAYLLGRSTQIALGGVAMHEFREYRGHIDTQSLHSRLLYLVEHIPALRTRIDQEKWIQWVSPCIALNWQAIDLQHLSREQALLAVEPVRQQYQQRMHDLTRSPWQICVVQLPIEEQEEFSSIVLTSFDALIVDGRTHALILAALLGSEEPDITQVVQNARDTQSISPQFASKKAQDEAYWKSKLHPDCPPPALPWKQALETITTSRYARESLQIPKESVGKLNRCGIENGLFLNSLLTATILDVLSYWTTEIGMRVGFPVLIPSSNAIDGNESSFVILEHEKSTLSLLSQASKLQREMLEALEHLAFSGVDLNRLLMNQAPQALVLPVVLTNGLSWKTLNPEDAVTLFDGVTQTPQVALDIRLTYDEQKNLIISFDYALAVLETELIREMLSALHHRLSQITSSASLAAPLEPCIDLSHYRFNSDESASHDCDFLAKLAQQLFVRTEDKTAVICGEQTLSYAQLGEQVQRVMWQLKARGLTTGNVLAICLPRSVEHIVISLASALSGIIWVPIDAASPKERLNYLLENCHADLVVMDKPCEFGNVIAFDALIEPVLFADGVPDVTPLDQLSRLSQSQQTAYYLYTSGTTGKPKCVVVNNQATSNVIGQTGQAWHLTSEDVVMSVTPLHHDMSVFDLFATLSFGATLVLPAGHEEKDALQWNRLIERHQVTIWVSVPAILEMLLSCTQAGQLHSLRLIAQGGDYIKPATIAQLRAGSNPPRLISLGGPTETTIWSIWHELTADDVSVIPYGRPLAGNRYFIMDEIQRHVPQGVVGRIFTSGVNLAQGYLEDGELKQTDFVTVLDEHGHPVRAFRTGDQGYYRADGNIIFASRINGYVKVRGVRVSLPDIEKQLQTHPALASVVVVDYADTNGDTALAALFSVKPQQSASSQALREFAKQSLPSSHIPSRFIALEALPLSANGKVDRKQCQAHVQRQSISVEPVGQPNQSQPLSPPTLSSASLSEFEQRVWRQHQRHGDGRNQYATAYRLSGKVNIARLITALSQLPNHFPVLNRRYVLDEASGLTLYSAKPTPLEIHFEHVESMDEAFEHLVRWQNQPMDLAKQATLSFCLLSLGSEERVLGVISHQIISEQWDWRRVFECVTNGYNQIACDIDPVMEGEDLSLGFTPVMPQTPLSQALLPWLQPASHATWIEQSLPSANSAINTLCSRKYRIALHSSVLAEHGLAQPDKQEVLALIAALFARYLAASAKLGQFELYVPHDVERKTRELNGSMIESQLVHIALKGFERPLSQLSQEILDAMRQPLTGGVASETHASAAALVTWLVDPSVHLQLEGLRCEKLLFAAMHPKFEVALGVGLNCQGALVLELALDATVSPHVGAYLLEQFVAAIGGRTMPSSTTSSSHVSAIELTSNNPPTSNNAHAALAESELELSAVNSSAVEECILAEFRSALGVAEMTAEDDFFDFGGHSLIATRVIGRLLSEQGIELHINDMFSFPNAKQLAQQAVLHRKPTSTSFAVSEVVESSKAPLSLAQASLWKAMSKYAKFGLTHIFNLPFALKFLDEVNEQAFGEAFHWLLLRHAGLRTHFGLEDGQPYQHVIAASNIEHYQWFWTSKDNAAQSVARLLAQEAEHTFDLSQELPLRLNFVRDEQTGTQYLSLLFHHIVLDEWSINILMDELAQVYQHSVQGTRPQWQTEPLPFHEFARKQRSSAFNQTHLNYWLTKFAGVPWAQPLFAADHPLSNSTGVDLGEGGWVEIKLPKSTMVSLYQLAKARHASLFNVMYAAISASVHCLGAPEKLLVGTPASGRLDAEFFDTVGYFTTMGVQLVDFTKVQTVWQLIEQVKNSINQSMPYTDIPIDLIEEGLKGVEHETEGHMFEVFIQLHAKNKLHGELLLTEGHAIRFQQVDPDKSESGLGLQFEILEERIEQKQTLRVMMSYMSKHYSPAQVALLTKVTSGMFERFSDCIAQDIALPTLKKQVRQLEDEACRSPSMG

SEQ ID NO: 33509 - protein, 495 aa, Schizosaccharomyces pombe
MAFSLVSILLSIALAWYVGYIINQLTSRNSKRPPIVFHWIPFVGSAVAYGMDPYVFFRECRAKYGDVFTFVCMGRKMTAFLGVQGNDFLFNGKLADLNAEEAYSHLTTPVFGKDVVYDIPNHVFMEHKKFIKSGLGFSQFRSYVPLILNEMDAFLSTSPDFGPGKEGVADLLKTMPVMTIYTASRTLQGAEVRKGFDAGFADLYHDLDQGFSPVNFVFPWLPLPRNRRRDRAHKIMQKTYLKIIKDRRSSTENPGTDMIWTLMSCKYRDGRPLKEHEIAGMMIALLMAGQHTSAATIVWVLALLGSKPEIIEMLWEEQKRVVGENLELKFDQYKDMPLLNYVIQETLRLHPPIHSHMRKVKRDLPVPGSKIVIPANNYLLAAPGLTATEEEYFTHATDFDPKRWNDRVNEDENAEQIDYGYGLVTKGAASPYLPFGAGRHRCIGEQFAYMHLSTIISKFVHDYTWTLIGKVPNVDYSSMVALPLGPVKIAWKRRN

SEQ ID NO: 33510 - protein, 449 aa, Schizosaccharomyces pombe
MPGDVEGCQHLKLKPADVENYQKICTQIFSCHFVPRRCSTCKRINKRSIRCLSCHSVGCLWGHHGEEHAMEHTHMIGVDVKNGHTYCFGCQDYVYQTELETLRFKIKNIKAWQSDHKRLPEKYNQMVCLEAYRKYPPVCATAGLRGIQNLGATCFMSVILQSILHNPLVRNLFFSGFHTSTDCKRPTCMTCAIDDMFSSIYNSKNKSTFYGPTAVLNLMWKLSKSLCGYSQQDGHEFFVYLLDQMHTESGGGTSMPCTCPIHRIFSGSLKNVVTCLDCKKERVAVDPLMDISLDINEPTLQGCLERFVSKEKVQYSCHSCGSKNAIKQLVFDKLPPTICMQLKRFEQNNFAMSTKIDKQVSYPAFLRMRYNFNQDDVDYQLYSVVCHKGTLDTGHYIAYTYYQNQWFLLDDTTIVEVKESEVLNSQAYLLFYHERQILYSDEMTVKTEN

SEQ ID NO: 33511 - protein, 290 aa, Arabidopsis thaliana
MPRYDDRYGNTRLYVGRLSSRTRTRDLERLFSRYGRVRDVDMKRDYAFVEFGDPRDADDARHYLDGRDFDGSRITVEFSRGAPRGSRDFDSRGPPPGAGRCFNCGVDGHWARDCTAGDWKNKCYRCGERGHIERNCKNQPKKLRRSGSYSRSPVRSRSPRRRRSPSRSLSRSGSYSRSRSPVRRRERSVEERSRSPKRMDDSLSPRARDRSPVLDDEGSPKIIDGSPPPSPKLQKEVGSDRDGGSPQDNGRNSVVSPVVGAGGDSSKEDRSPVDDDYEPNRTSPRGSESP

SEQ ID NO: 33512 - protein, 474 aa, Agrobacterium vitis
MFIRSNRRAKIVATVGPASSSPAILRSLFLAGVDTFRLNFSHGSRDDHAAAYRHIRALEKELGTSIGILQDLQGPKIRIGVLHEGRLQLTKDAEIRFVCGTEPGRGLMDIPLPHREIFAAVKPGDDLLIDDGRVRVRALGVSDEFIDAKVIVAGPISNRKGVNLPGTVLDISPLTPKDRKDLEFGLELGVDWIALSFVQTARDMIEARSLVSDRAGLIAKIEKPSALDEIDDIVALSDAIMVARGDLGVEIPPEDVPGRQKELIRACRIAAKPVIVATQMLDSMVTSPTPTRAEASDVAGAIYDGADAVMLSAESATGAFPVETVEIMSRIIEKTEKHKFYRPILEATEPQIAHTPPHAVATAAADVALALKAPVIVAFTVSGTTASRISRARPPLPILALTPSEQTARQLGLMWGVVSLLSPTVDTYEQSVDRATQAAVQTGLAEKSDQIVVVTGFPFATAGSTNNLRVTQAG

SEQ ID NO: 33513 - protein, 357 aa, Lycopersicon esculentum
MKKGSFAPNLKLSLPPPDEVALSKFLTESGTFKDGDLLVNRDGVRIVSQSEVAAPSVIQPSDNQLCLADFEAVKVIGKGNGGIVRLVQHKWTGQFFALKVIQMNIDESMRKHIAQELRINQSSQCPYVVICYQSFFDNGAISLILEYMDGGSLADFLKKVKTIPERFLAVICKQVLKGLWYLHHEKHIIHRDLKPSNLLINHRGDVKITDFGVSAVLASTSGLANTFVGTYNYMSPERISGGAYDYKSDIWSLGLVLLECATGHFPYKPPEGDEGWVNVYELMETIVDQPEPCAPPDQFSPQFCSFISACVQKHQKDRLSANDLMSHPFITMYDDQDIDLGSYFTSAGPPLATLTEL

SEQ ID NO: 33514 - protein, 401 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVFDGWKAPSIMQVPGARDVAVEFFTLSKSYNMAGWRIGFMVGNKTLVNALARIKSYHDYGTFTPLQVAAIAALEGDQQCVLDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLP

SEQ ID NO: 33515 - protein, 501 aa, Pisum sativum
MAMANLARRKGYSLLSSETLRYSFSLRSRAFASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 33516 - protein, 360 aa, Saccharomyces cerevisiae
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 33517 - protein, 298 aa, Schizosaccharomyces pombe
MSVQELSHPLIKDGWFREINNMWPGQAMTLKVKKVLYAGKSKYQDVLVFESETYGHVLVLDGAIQATERDEFSYQEMIAHLALNSHPNPKKVLVIGGGDGGVLREVVKHECVEEAILCDIDEDVIKVSKQYLPEMSAGFNHPKVKVHIGDGFKFLQDYQNTFDVIITDSSDPDGPAEALFQKPYFQLLSDALRGGGVITTQAECMWIHLGVISNVLTAVKTVFPNVRYAYTTIPTYPSGSIGFVVASKDASIDLSKPLRKWSPEEENKLCKYYNSEIHAASFVLPTFARDVVDKATSS

SEQ ID NO: 33518 - protein, 270 aa, Diospyros kaki
NWGLFELVNHGIPPELMDTVERLTKEHYKKCMEQRFKELVASKALEGVQAEVTDMDWESTYFLRHLPQSNISELPDLDEEYRRVMKDFAERLEKLAEYLLDLLCENLGLEKGYLKKAFYGTKGPNFGTKVANYPPCPKADLIKGLRAHTDAGGIILLFQDDKVSGLQLLKDDQWIDVPPMKHSIVINLGDQLEVITNGKYKSVLHRVVAQTDGTRMSIASFYNPGNDAVIYPAPALVEKEIQEKEIYPKFVFDDYMKLYAALKFQAKEPR

SEQ ID NO: 33519 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 33520 - protein, 469 aa, Shewanella benthica
MSAESVLQQLKELEVKFVDLRFTDTRGKEQHVSIPSHQVDEDFFEDGKMFDGSSINGWKGINESDMVLMPDPESFVLDPFTADTTAIIRCDILNPGTMTGYNRDPRSIAKKAEEYLRSTGIADTVLLGPEPEFFLFDDVKYGSDMSGCFYKLDAEEASWNSGTSYEGGNTGHRPSVKGGYFPVPPVDSSQDIRSAMCLILEEMGQVVEAHHHEVATAGQNEIATRFNTLTLKADEVQVLKYVVHNVAHVYGKTATFMPKPIVGDNGSGMHVHISLAKDGTNLFAGDKYGGLSELAIYFIGGVIKHARAINAFSNPATNSYKRLIPHFEAPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSSDFIDSYITLKTEDVERVNQTTHPVEFELYYSL

SEQ ID NO: 33521 - protein, 310 aa, Selenomonas ruminantium
MAKIYNSVTELIGNTPLLKANNFIEANDLQANILVKLEYLNPAGSVKDRIAKAMIEQAEKEGKITKDTVIIEPTSGNTGIGLASFAAARGYKAILTMPETMSVERRNLLKAYGAQIVLTDGAKGMKGAIAKAEELAKETPNAFIPSQFTNQANPAIHEATTGPEIWQDAEGKVDVFIAGVGTGGTLTGVGRYLKKQNAAVHIVAVEPESSPVLSQGTAGPHKIQGIGAGFVPETLDTKVYDEVLPISNEDAFKYGRQFAHSEGVLVGISAGAALAAAVQLAKRPEFAGKNIVALLPDTGDRYLSTELFND

SEQ ID NO: 33522 - protein, 353 aa, Dianthus gratianopolitanus
MVSSTINETLDGKHDINKVGQGETVCVTGASGFIGSWLIMRPLERGYTVRATVRDPDNTKKVQHLLDLPHAKTNLTLWKADLNEEGSFDAAVDGCTGVFHIATPMDFESKDPENEMIKPTINGMLDILKSCVKAKVRRVVFTSSGGTVNVEATQKPVYDETCWSDLDFIRSVKMTGWMYFVSKILAEQAAWKYAAENNLDFISIIPPLVVGPFIMPSMPPSLITALSPITRTESHYTIIKQGQFVHLDDLCMSHIFLYENPKANGRYVASACAATIYDIAKTLREEYPEYNVPTKFKDYKEDMGQVQFSSKKLTDLGFEFKYGLKDMYTEAAETCRAKGLLPISLEHHENGSA

SEQ ID NO: 33523 - protein, 194 aa, Lycopersicon esculentum
NLLLTEDKTTIKLADFGLAREDAEAEMTTEAGTYRWMAPEMFSMDPIRVGVKKYYNHKVDVYSFSMILWELLTNSTPFKGRSNIMVAYATATKMRPSLENIPSEIEPLVSSCWAEDPAERPEFEQISDFLANILGNVCGSPSCSPNLFDTEHPTGNELVNSPVTNCLMEKDAENSKKKHRSSCCCFMSAYDNSL

SEQ ID NO: 33524 - protein, 471 aa, Blumeria graminis
MPTFGFLKKRKKVSLGHRDLDSPASTLSQPASPITPSTSRGLGEPIDTTSSKITSPGQKLGSNITKDHRGTRTTVEDLPSMTDVSHLQQAYRNLSQGSTASKSNLLTIHNLINPPQHDGAGQSKVMPEKHMNNKTERPVQGKAAVAQVRQTKGKYSLSDFEILRTLGTGSFGRVHLVQSKHNQRFYAVKVLKKQQVVKMKQVEHTNDERSMLQEVKHPFLITLWGTFQDSKNLYMVMDFVEGGELFSLLRKSQRFPNPVAKFYAAEVTLALEYLHKKDIIYRDLKPENLLLDRHGHLKITDFGFAKKVTDITWTLCGTPDYLAPEVVSSKGYNKSVDWWSLGILIFEMLCGYTPFWDNGSPMKIYENILKGRVKYPPYIHPDAQDLIQRLITADLTKRLGNLHGGAEGIKSHQWFAEVTWERLAKKDIDAPYVPPVKAGSGDASQFDKYPEETERYGQTGPDEHGSLFENF

SEQ ID NO: 33525 - protein, 355 aa, Fusarium oxysporum f. sp. lycopersici
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 33526 - protein, 207 aa, Streptomyces hygroscopicus
MGTPLIPLADEQCDIVAKLEFCNPTGSSKDRSALWILEQAIGRGEIARSTTVVESSSGNFALALAFYCRMLGISFVPVIDPNCNEATEAQLRLLCERVEKVAIRDGSGSYLKNRLSRVRELLVELDSAYWPNQYANPDARDAHYHFTAGELIAQAGPLDYLFVGVGTGGTIAGLSRRIKETYPDCVVVAVDAEGSVIFGGPPKKRRI

SEQ ID NO: 33527 - protein, 399 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGHLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDPRAELFQAAKGA

SEQ ID NO: 33528 - protein, 331 aa, Glomerella cingulata
KRAAITDACDVGYGAGTTGGSGGTTTTVSTPAQFTAAATSDEKAVIVVKGAITGATKVKVGSNKSIIGRAGSSLTGVGLYINKQENVIVRNMKISKVLADNGDRIGIQASSKVWVDHCDLSSDKNNGKDYYDGLLDITHASMAVTVSNTYIHDHYKGSLVGHSDSNSAEDTGKLYVTYANNHWYNVGSRNPSVRFGNVHIFNNYAEKLETSGVNTRMGAQLLIESSVFSDTKKAVTFLDSKSTGYAVVNDVDLGGSTNDRPQGTFTKPDYSYTLLGSSKVRLPSSRPLARPSPSKWFSERRRNPAVGNEKSAFAAFRRRAFFLPAPAVAEY

SEQ ID NO: 33529 - protein, 420 aa, Streptomyces coelicolor A3(2)
MPRAKTFVIVGGGLAAGKAAEELREHGHDGPLLVIGDERERPYIRPPLSKGYLLGKEDRESIHVHPESWYREHDVDLLLGTSVTSVDARGRAVTLDDGRRVPYAGLLLATGSSPRRLSVPGADLEGVLYLRRVGDSERLKEAFTEGARIVVVGGGWIGLETAAAARAAGAEVTVLERGELPLLKVLGREAAEVFAGLHRDHGVDLRPHARIEAVTGTGGRVDGVRLADGTHLPADAVVVGVGITPNVRLAEEAGLDVRNGIVTDARLRTSAAGVHAAGDVANAYHPRLGRHLRVEHWANALHQPRTAALSMLGQDAVYDRLPYFYTDQYDLGMEYTGYAEPGGYDRVVFRGSREERRFLAFWMSGDRVLAGMSVNLWDVIGTIRALIESGAETDDAALADPSVPLESLLPPHARPTGDQA

SEQ ID NO: 33530 - protein, 382 aa, Vitis vinifera
MSNTAGQVIKCKAAVSWEAGKPLVIEEVELAPPQANEVRIKILFTSLCHTDVYFWEAKGQKPAFPRIFGHEAAGVVESVGEGVTDLKPGDTVLPVFTGECKECRHCKSEESNMCDLLRINTDRTVMLSDGKSRFSAKGKPIYHFLGTSTFSEYTVAHVGSVAKINPAAPLDKVCVLSCGISTGLGAAINVAKPKKGSSVAVFGLGAVGLAAAEGARISGASRIIGVDLNASRFEQAKKFGVTEFVNPKDHDKPVQEVIAEMTDGGVDRSIECTGSVAAMISAFECVHDGWGVAVLVGVPNRDDSFKTHPINLLNERTLKGTFFGNFKPRTDLPRLVEKYVNKELDLQLEKFITHEVSFSDINKAFDYMLKGEGLRCIIRMGA

SEQ ID NO: 33531 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELFKIFRVMGTPNEDTWPGVTTLPDFKSAFPKWPSKDLATIVPNLDGAGLDLLDKMLRLDPSKRITARNALEHEYFKDIGYVP

SEQ ID NO: 33532 - protein, 308 aa, Methanosarcina thermophila
MGRIFSDITWTIGNTPLVRLNRITKGLHADVLAKVESFNPMGSVKDRIGLAMIEEAEREGRIKEGTTIIEATSGNTGIALACVCAARGYNLILVMPETMTVERRKLLKALGAELVLTSGAEGMRGAVNKAEQMAADDSALYFIPQQFQNPANPEIHRRTTAEEIWRDTDGKADVIVAGVGTGGTITGIASAIKKRRPSFKAIAVEPAESPVLSGGSPGPHRIQGIGAGFVPDVLQLELIDEIIKVTGDEAAATARRLAKEEGILAGISSGAATWAALQVASREEMRGKTIVVILPDTGERYLSTDLFD

SEQ ID NO: 33533 - protein, 204 aa, Yarrowia lipolytica
MPQPTDLRRKLVIVGDGACGKTCLLIVFAKGTFPEVYVPTVFENYVADVEIDGRRVELALWDTAGQEDYDRLRPLSYPDANVIIICFAIDSPDSLDNVQEKWISEVLHFCQGVPILLVGCKVDLRNDPKTIEELRRTSQRPVTTEEGNAVAQKIGAGKYLECSARTHDGVREVFEHATRAALTAHGQKGSKSSSREGKKKCLIL

SEQ ID NO: 33534 - protein, 1803 aa, Euglena gracilis
MKQSVRPIISNVLRKEVALYSTIIGQDKGKEPTGRTYTSGPKPASHIEVPHHVTVPATDRTPNPDAQFFQSVDGSQATSHVAYALSDTAFIYPITPSSVMGELADVWMAQGRKNAFGQVVDVREMQSEAGAAGALHGALAAGAIATTFTASQGLLLMIPNMYKIAGELMPSVIHVAARELAGHALSIFGGHADVMAVRQTGWAMLCSHTVQQSHDMALISHVATLKSSIPFVHFFDGFRTSHEVNKIKMLPYAELKKLVPPGTMEQHWARSLNPMHPTIRGTNQSADIYFQNMESANQYYTDLAEVVQETMDEVAPYIGRHYKIFEYVGAPDAEEVTVLMGSGATTVNEAVDLLVKRGKKVGAVLVHLYRPWSTKAFEKVLPKTVKRIAALDRCKEVTALGEPLYLDVSATLNLFPERQNVKVIGGRYGLGSKDFIPEHALAIYANLASENPIQRFTVGITDDVTGTSVPFVNERVDTLPEGTRQCVFWGIGSDGTVGANRSAVRIIGDNSDLMVQAYFQFDAFKSGGVTSSHLRFGPKPITAQYLVTNADYIACHFQEYVKRFDMLDAIREGGTFVLNSRWTTEDMEKEIPADFRRKLAQKKVRFYNVDARKICDSFGLGKRINMLMQACFFKLSGVLPLAEAQRLLNESIVHEYGKKGGKVVEMNQAVVNAVFAGDLPQEVQVPAAWANAVDTSTRTPTGIEFVDKIMRPLMDFKGDQLPVSVMTPGGTFPVGTTQYAKRAIAAFIPQWIPANCTQCNYCSYVCPHATIRPFVLTDQEVQLAPESFVTRKAKGDYQGMNFRIQVAPEDCTGCQVCVETCPDDALEMTDAFTATPVQRTNWEFAIKVPNRGTMTDRYSLKGSQFQQPLLEFSGACEGCGETPYVKLLTQLFGERTVIANATGCSSIWGGTAGLAPYTTNAKGQGPAWGNSLFEDNAEFGFGIAVANAQKRSRVRDCILQAVEKKVADEGLTTLLAQWLQDWNTGDKTLKYQDQIIAGLAQQRSKDPLLEQIYGMKDMLPNISQWIIGGDGWANDIGFGGLDHVLASGQNLNVLVLDTEMYSNTGGQASKSTHMASVAKFALGGKRTNKKNLTEMAMSYGNVYVATVSHGNMAQCVKAFVEAESYDGPSLIVGYAPCIEHGLRAGMARMVQESEAAIATGYWPLYRFDPRLATEGKNPFQLDSKRIKGNLQEYLDRQNRYVNLKKNNPKGADLLKSQMADNITARFNRYRRMLEGPNTKAAAPSGNHVTILYGSETGNSEGLAKELATDFERREYSVAVQALDDIDVADLENMGFVVIAVSTCGQGQFPRNSQLFWRELQRDKPEGWLKNLKYTVFGLGDSTYYFYCHTAKQIDARLAALGAQRVVPIGFGDDGDEDMFHTGFNNWIPSVWNELKTKTPEEALFTPSIAVQLTPNATPQDFHFAKSTPVLSITGAERITPADHTRNFVTIRWKTDLSYQVGDSLGVFPENTRSVVEEFLQYYGLNPKDVITIENKGSRELPHCMAVGDLFTKVLDILGKPNNRFYKTLSYFAVDKAEKERLLKIAEMGPEYSNILSETYHYADIFHMFPSARPTLQYLIEMIPNIKPRYYSISSAPIHTPGEVHSLVLIDTWITLSGKHRTGLTCTMLEHLQAGQVVDGCIHPTAMEFPDHEKPVVMCAMGSGLAPFVAFLRDGSTLRKQGKKTGNMALYFGNRYEKTEFLMKEELKGHINDGLLTLRCAFSRDDPKKKVYVQDLIKMDEKMMYDYLVVQKGSMYCCGSRSFIKPVQESLKHCFMKAGGLTAEQAENEVIDMFTTGRYNIEAW

SEQ ID NO: 33535 - protein, 468 aa, Bernardia incana
KASVGFKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPVAYVKTFQGPPHGIQVERDKLNKYGRPLLGCTIKPKLGLSAKNYGRACYECLRGGLDFTKDDENVNSQPFMRWRDRFLFCAEAIYKAQAETGEIKGHYLNATAGTCEEMMKRAIFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDYIEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 33536 - protein, 468 aa, Billia hippocastanum
KASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPSAYVKTFQGPPHGIQVERDKLNKYGRPLLGCTIKPKLGLSAKNYGRAVYECLRGGLDFTKDDENVNSQPFMRWRDRFLFCAEAIYKSQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33537 - protein, 468 aa, Ctenolophon englerianus
KASAGFKAGVKDYKLTYYTPDYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYFNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33538 - protein, 475 aa, Cedrela odorata
MSPQTETKASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33539 - protein, 475 aa, Diplopeltis huegelii
MSPQTETKASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIKFEFPAMDTL

SEQ ID NO: 33540 - protein, 467 aa, Endospermum moluccanum
ASVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRVPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAAIDRQKNHGMHFRVLAKALRMSGGDHIHAGTVVGKLEGEREITLGFVDLLRDDFIEKDRTRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33541 - protein, 475 aa, Khaya anthotheca
MSPQTETKASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFPAMDTL

SEQ ID NO: 33542 - protein, 468 aa, Lophopetalum sessilifolium
  misc_feature (342)..(342): Xaa can be any naturally occurring amino acid
KASVGFMAGVTDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQTETGEIKGHYLNATAGTCEEMIKRAVFARELGVPIVMHDYLTGGFTANTSLAHYCRDNGLLLHIHRAMHAVIDRQKNHGMHFRVLAKALRMSGGDHVHAGTVVGKLEGERDITLGFVDLXRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33543 - protein, 469 aa, Micrandra minor
KASVGFKAGVKDYKLTYYTPDYQTKDTDILAAFRVTPQPGVPPEEAGAAVAAESSTGTWTTVWTDGLTSLDRYKGRCYGLEPVPGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVIPVASGGIHVWHMPALTEIFGDDSVLQFGGGTLGHPWGNAPGAVANRVALEACVQARNEGRDLAREGNDIIREASKWSPELAAACEVWKEIKFEFEAMDTLD

SEQ ID NO: 33544 - protein, 466 aa, Poliothyrsis sinensis
SVGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFQAMDTL

SEQ ID NO: 33545 - protein, 465 aa, Populus euphratica
VGFKAGVKDYKLTYYTPDYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEITFEFQAMDTL

SEQ ID NO: 33546 - protein, 468 aa, Scyphostegia borneensis
ASVGFKAGVKDYKLTYYTPEYETKDTDILAAFRVTPQPGVPPEEAGAAVAAESSTGTWTTVWTDGLTSLDRYKGRCYDIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMNKRAVFARELGVPIVMHDYLTGGFTANTSLAHYCRDNGLLLHIHRAMHAVIDRQKNHGMHFRVLAKALRLSGGDHVHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACQVWKEIKFEFPAVDTLD

SEQ ID NO: 33547 - protein, 475 aa, Strasburgeria robusta
MLPQTETKASAGFKAGVKDYKLTYYTPEYDTKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTTLAHYCRDNGLLLHIHRAMHAVIDRQKNHGMHFRVLAKALRMSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33548 - protein, 475 aa, Ungnadia speciosa
MSPQTETKASVGFKAGVKDYKLTYYTPDYVTKDTDILAAFRVTPQPGVPPEEAGAAVAAESSTGTWTTVWTDGLTSLDRYKGRCYNIEPVAGEENQYICYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVFARELGVPIIMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELSAACEVWKEIKFEFPAMDTL

SEQ ID NO: 33549 - protein, 265 aa, Methanothermobacter thermautotrophicus
MNYAEMFSRVEGCAFVPFVVAGDPDMETSVEIIRTLVDAGADALEIGFPFSDPIADGTSVQEADLRALNSGMTTDDCFRLIERIREFTSVPVGLLVYYNLIYRMGADEFYRRAAEAGVTGILAADLPPEEAGDALRAAERYGIDQIFIVAPTTDNQRLKMISEVSSGFHYLVSVMGVTGARSRVEESTLELIERVKGAGSLPVMVGFGVSQPEHVRMLADAGADGVIVGSAIIDLISKNLDDRERMLQEIYEMVRKMKTAAGGSR

SEQ ID NO: 33550 - protein, 277 aa, Haloferax volcanii
MSLEDAFSDGPAFVPYLAAGDPDYESSLEYVEALERGGADVIELGLPFSEPIAEGPTIQNAVVRSLEGGMTPTRFFEFVEDLDVSVPLVCMRYYNLIYRYGDEPGPRPFVEKAAEVGIEGFVVPDLPAEEAGPLREACDEFGLDLVFIVAPTTRGERLDRIMEQVSGYVYVQARLGTTGAQSSVSDQTDSSLERLTDYDVPKAVGFGISDGDHAERIVASGADGIIVGSALVDIVAEGHENGDDAETVADRLETLARELEDGAVAGASQRPPHPERT

SEQ ID NO: 33551 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 33552 - protein, 283 aa, Solanum chacoense
MSKDVIEEGQAHHHGKDYVDPPPAPLLDMAELTKWSFYRAVIAEFIATLLFLYVTVATVIGHKKLNALDQCDGVGILGIAWAFGGMIFVLVYCTAGISGGHINPAVTFGLFLARKVSLIRAVAYIIAQSLGAICGVGFVKLFMKHYYNAEGGGANFVQPGYSKGTALGAEIIGTFVLVYTVFSATDPKRSARDSHVPVLAPLPIGFAVFMVHLATIPITGTGINPARSFGAAVIYGHEKIWDDQWIFWVGPMVGAMAAAIYHQFVLRAGAVKALGSFRSNQTN

SEQ ID NO: 33553 - protein, 170 aa, Saccharomyces cerevisiae
ETVQVNLPVSLEDLFVGKKKSFKIGRKGPHGASEKTQIDIQLKPGWKAGTKITYKNQGDYNPQTGRRKTLQFVIQEKSHPNFKRDGDDLIYTLPLSFKESLLGFSKTIQTIDGRTLPLSRVQPVQPSQTSTYPGQGMPTPKNPSQRGNLIVKYKVDYPISLNDAQKRAID

SEQ ID NO: 33554 - protein, 470 aa, Pisum sativum
ASGSDENDVVIIGGGPGGYVAAIKAAQLGFKTTCIEKRGALGGTCLNVGCIPSKALLHSSHMYHEAKHSFANHGVKVSNVEIDLAAMMGQKDKAVSNLTRGIEGLFKKNKVTYVKGYGKFVSPSEISVDTIEGENTVVKGKHIIIATGSDVKSLPGVTIDEKKIVSSTGALALSEIPKKLVVIGAGYIGLEMGSVWGRIGSEVTVVEFASEIVPTMDAEIRKQFQRSLEKQGMKFKLKTKVVGVDTSGDGVKLTVEPSAGGEQTIIEADVVLVSAGRTPFTSGLNLDKIGVETDKLGRILVNERFSTNVSGVYAIGDVIPGPMLAHKAEEDGVACVEYLAGKVGHVDYDKVPGVVYTNPEVASVGKTEEQVKETGVEYRVGKFPFMANSRAKAIDNAEGLVKIIAEKETDKILGVHIMAPNAGELIHEAAIALQYDASSEDIARVCHAHPTMSEAIKEAAMATYDKPIHI

SEQ ID NO: 33555 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTDAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 33556 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRALKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 33557 - protein, 3487 aa, Microcystis aeruginosa
MVESIDYKKLMATTLSKMEVMQARINELETRQSESIAVVGMACRFPGGINSPEKYWSFCQAGLDAIVEVPKSRWDISKLYSQEPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDAACASSLAAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALVDARIVPEDVSYIEAHGTGTSLGDPIELNAIASVYGKRSDPLYVASVKTNIGHLEAAAGMAGIIKTILILQQGEIPSHLHFQTPNPLINWEDHPIKIPTQNIPWPNNNKVPIAGVSSFGFSGTNAHVIVQQAPVSKISEIQQQLPSHLLTLSAHNKTALKELAKRFHTLLESRPEIGDICYSAAVGRIDLPERLAIVGDTCPELQQRLAAFAEEKPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPSLLIGHSVGEYVAACIAGVFSLEAGLALVVKRGQLMQTTTSGKMASIFADEETVSSLIKNYTQTVSIAAINHPQQIVIAGESASIEEVISTCKKQKIPAQYLPVTQAFHSPLMEPILKEFEKEARQIYYQRPQILLLSGLDGELLENAPDAAYWSKQCREPVRFLSSLITAFNKGYNLFLEVGPRPILAEQGRRYKDEVIWLSSLNRGLDNWHTILSALAQLYLNGAPFNPEQFNRNYGYKKVRLPNYPFQRKPFQFQPNPRTENQSIDKIFLDAQTSNLTDTETTVFNMQKHQQEIRNQLKSILALLLKEDENDLPEDETLLNLGADSIILTDFSRKVEEKFQVKVKIDQLFTDLQTLADIAEYLCQFVNEKPLENASEITTKVINDETELSNYLQVIEQLQPIATAYIIRALESLGKKLNQGEQWTIETLRQTLPVARKYHILLNRYLQDLEQANVLHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDRPYQILEIGGGTGATSEAILHHLNLDHVTYSFSEVSPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPAIPKFTVSGESSGKEALMMAQLQSLKDLKDLHEKTIIKQLEVLQTAPVFPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIKAVQEQMNRGIGLGMQSNLAAETAALISEMGRVERVAFSNTGTEAIMAAVRIARSRTKRQKIVMFAGSYHGTFDGILARVGEDKTTAQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNKDIDKVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKPDHYLLSLKTHHIVADGWSLGLILQEIGQLYSSQNNTTKEVLTPPMQFRQYLTLRAQETQSPQMLEHRDFWLKTYQEDLPTFELPTDFPRPAVKTYTGGQESQVIPSEVGQNLQKVGRKNKATLFMTMFAAYTAFLRRISGHRDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFVAQVKLTPNAPALIAGKINLSYQELNEKVNRLTHYLQQEYQLGVGKVIGVMLQRDHNLIIGILATFKTGATYVPIDSQYPHSRIEFILKDSGCHVCLTESNFISKLPEKMQKICLDKIDPIVEKYDKDEPKIFRNSSQTAYIFYTSGSTGNPKGVMGCHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIVSNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNHLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQGQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLIIDLFKNWLEQVLKFAHEPLINLSLASSENLTQEGQELFTEDFNF

SEQ ID NO: 33558 - protein, 337 aa, Microcystis aeruginosa
MTTTSPKTLTMDIQKPRVLLIGKMYDEAGQKLLEESTNIEILSNPTLEEINEAIQEVSGVFVRYPNKLEASSIRLAKQLKVISTSGFGTDSIDIMAATEQGVIVVNNPGMSTTSVAEHTLSMILALAKKLPFLDHCVKKGNYLIRNQMQPIQLENKTLGIVGLGRIGTLVAHKCNLALGMRVLAYDPYVPASKAETVGATWVKDLDVLLAESDFVSLHTELTSETREMFNISVFKKMKPTAFLINTSRGKVVCEKDLGIALNQKLIAGCALDVFEPEPPALDNPLYNFENVILSPHLAGVTPEASLAAAVSAANQILQVLQGEKPPYMINPEVWNLF

SEQ ID NO: 33559 - protein, 507 aa, Juniperus ashei
MSMKFMAALAFLALQLIVMAAGEDQSAQIMLDSDTKQYHRSSRNLRKRVHHARHDVAIVFNVEHYGAVGDGKHDSTDAFEKTWNAACNKLSAVFLVPANKKFVVNNLVFYGPCQPHFSFKVDGTIAAYPDPAKWKNSKIWMHFARLTDFNLMGTGVIDGQGNRWWSDQCKTINGRTVCNDKGRPTAIKIDFSKSVTVKELTLTNSPEFHLVFGECDGVKIQGIKIKAPRDSPNTDGIDIFASKRFEIEKCTIGTGDDCVAVGTGSSNITIKDLTCGPGHGMSIGSLGKGNSRSEVSFVHLDGAKFIDTQNGLRIKTWQGGSGLASHITYENVEMINAENPILINQFYCTSAAACKNQRSAVKIQDVTFKNIHGTSATTAAIQLMCSDSVPCSNIKLSNVFLKLTSGKVATCVNKNANGYYTNPLNPSCKSLHPGRTPKELELHQKPTTLLMDEKMGASLNSSPPNCKNKCKGCQPCKPKLIIVHPNQPEDYYPQRWVCSCHNKIYNP

SEQ ID NO: 33560 - protein, 232 aa, Streptomyces antibioticus
IESPSNPGLDVCDIRRLADAAHARGALVAVDNTLATPLGQRPLELGADFSVASGTKQLTGHGDVLLGYVAGRDAEAMAAVGRWRKIVGAISGPMEAWLAHRSIATLQLRVDRQNATALAVAEALRQRPEVSGLRYPGLSDDPSHPVAARQMRRYGCVVSFTLPTRARAERFLAALRLVEDATSFGGVRSTAERRRRWGGDDVPEGFIRMSVGAEDPEDLVADVLRALDESAE

SEQ ID NO: 33561 - protein, 466 aa, Vitis vinifera
MALATRRFFNTICRGTRSFGALPEGIPSSSQHLINLEYEYSAHNYHPIPIVFSQAKGSTIWDPEGKKYLDFLSAYSAVNQGHCHPKVLKALVEQAERLTLSSRAFYNDRFPIFAERLMNMFGYDMVLPMNTGAEGVETALKLARKWGYEKKKIPKDQAIIVSCCGLLHGRTLAVISMSCDNEATRGFGPLLPGHLKVDFGDEVALEKIFEENGDRIAGFLFEPIQGEAGVIIPPDGYLKAVRELCSKFNILMIADEIQSGLGRSGRMLACDWAEVRPDVVILGKALGGGVIAVSAVLADKDVMLSIQPGEHGSTFGVNPLASAVAVASLDVITEEGLSERSDQMGQELRNQLMKIHQLFPNLIKEVRGKGLFNAVELNSKALFPVSAYDICLKLKERGVLAKPTHDTIIRLTPPLSISLDELQEGSNALRDVMEFDVPKMQKAKHKRVPQTTTNICDRCGRNMDDS

SEQ ID NO: 33562 - protein, 130 aa, Arabidopsis thaliana
GLLSLYEASYLSTRIDTKLKETIYYTTKRLRKFVEVNKNETKSYTLRRMVIHALEMPYHRRVGRLEARWYIEVYGERHDMNPILLELAKLDFNFVQAIHQDELKSLSSWWSKTGLTKHLDFVRDRITESY

SEQ ID NO: 33563 - protein, 120 aa, Capsella bursa-pastoris
MASKTLILLGLFAILLVVSEVSAARESGMVKPESEETVQPEGYGGHGGHGGHGGHGGHGGHGHGGGGHGLDGYHGGHGGHGGGYNGGGGHGGHGGGYNGGGHHGGGGHGLNEPVQTQPGV

SEQ ID NO: 33564 - protein, 355 aa, Erwinia chrysanthemi
AVETDAATTGWATQNGGTTGGAKAAKAVEVKNISDFKKALNGTDSSAKIIKVTGPIDISGGKAYTSFDDQKARSQISIPSNTTIIGVGSNGKFTNGSLVIKGVKNVILRNLYIETPVDVAPHYESGDGWNAEWDAAVIDNSTNVWVDHVTISDGSFTDDKYTTKDGEKYVQHDGALDIKKGSDYVTISYSRFELHDKTILIGHSDSNGSQDSGKLRVTFHNNVFDRVTERAPRVRFGSIHAYNNVYLGDVKHSVYPYLYSFGLGTSGSILSESNSFTLSNLKSIDGKNPECSIVKQFNSKVFSDKGSLVNGSTTTKLDTCGLTAYKPTLPYKYSAQTMTSSLATSINNNAGYGKL

SEQ ID NO: 33565 - protein, 467 aa, Cedrus atlantica
ASVGFKAGVKDYRLTYYTPEYQTKDTDILAAFRVTPQPGVPPEEAGAAVAAESSTGTWTTVWTDGLTSLDRYKGRCYDIEPVPGEETQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIIMHDYLTGGFTANTSLAHYCRDNGLLLHIHRAMHAVIDRQRIHGMHFRVLAKALRMSGGDHIHAGTVVGKLEGERDVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEVWKEIKFEFEAIDVL

SEQ ID NO: 33566 - protein, 467 aa, Picea smithiana
ASVGFKAGVKDYRLTYYTPEYQTKDTDILAAFRVTPQPGVPPEEAGAAVAAESSTGTWTTVWTDGLTSLDRYKGRCYDIEPVPGEETQFIAFVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAIYKAQAETGEIKGHYLNATAGTCEEMMKRAVFARELGVPIVMHDYLTGGFTANTSLAHYCRDNGLLLHIHRAMHAVIDRQKNHGMHFRVLAKALRMSGGDHIHGGTVVGKLEGERDITLGFVDLLRDDFIEKDRSRGIYFTQDWVSMPGVLPVASGGIHVWHMPALTEIFGDDSVLQFGGGTLGHPWGNAPGAVANRVALEACVQARNEGRDLAREGNEVIREASKWSPELAAACEIWKEIKFEFEAVDTI

SEQ ID NO: 33567 - protein, 467 aa, Tsuga mertensiana
ASVGFKAGVKDYRLTYYTPEYQTKDTDILAAFRVTPQPGVPPEEAGAAVAAESSTGTWTTVWTDGLTSLDRYKGRCYDIEPVPGEESQFIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFVFCAEAINKAQAETGEIKGHYLNATAGTCEEMMKRAVFARELGVPIVMHDYLTGGFTANTSLAHYCRDNGLLLHIHRAMHAVIDRQRNHGMHFRVLAKALRMSGGDHIHAGTVVGKLEGEREVTLGFVDLLRDDFIEKDRSRGIYFTQDWVSMPGVLPVASGGIHVWHMPALTEIFGDDSVLQFGGGTLGHPWGNAPGAVANRVALEACVQARNEGRDLARQGNEVIREACKWSPELAAACEVWKEIKFEFDTIDYL

SEQ ID NO: 33568 - protein, 344 aa, Lolium perenne
MTVVNTVAQQLPGHGQTVCVTGAAGYIASWLVKLLLERGYTVKGTVRNPDDPKNAHLKALDGAVERLILCKADLLDYDAICAAAEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEAARKRGIDLVVVNPVLVVGPLLQPTVNASAAHILKYLDGSAKKYANAVQSYVDVRDVADAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKNIPEGLNGVTA

SEQ ID NO: 33569 - protein, 277 aa, Bacillus pumilus
MNLEEQIKIAASLRQPSEGSLASQSELKPVNPPEVNKMEYDIPTSAGETKVWVFKPVNTQKQLLPVFVNLHGGGFIMGSAEMDNPWCPVIADRAQCIVVNVEYQLAPEHPFPAALHECYDVLKWLYEHPEELQIDRNALAIGGHSAGGNLATAACLLNIQRGNTLPIAYQVLDYPPLDLATDPAQKPAFEEAIPVELARLFNSFYLQGQDPHNPLVSPVFADRSSLAQMPPALVITAERDSLAQEADQYAKKLKEAGVDVTYSSLKEFLTASHTPEI

SEQ ID NO: 33570 - protein, 417 aa, Azospirillum brasilense
MERILGGMSLPDLGTFALVNERLERLSDYPFTRLAALLSGVTPRANAEPIMMSVGEPQHQPPAIIDETLRANAHLWGKYPPVGGTPEFREAVGAWLARRYALPDGLFDAEKSVLPVSGTREALFLLALLAVPPSKAGRQPAVLMPNPFYAPYEGAALLAGAEPVFLPSTRETGFLPDLDALTPELLERTALFYLCTPANPQGAAADAAYLERAIGLARRYGFILAVDECYAEIYLDKPPVGALQLASGLHHGGKPWTNILVFHSLSKRSSAAGLRSGFVAGDPELMSRFTRLRSYSNAGMPLPVLAASAALWRDEAHVEENRALYRAKFDAAEAALNGRYGYYRPDGGFFLWLEVGDGEEATRRLWAEGGIRVLPGAYLTRCNPGEANPGAPFIRIALVNDAETVAHACSTIARILG

SEQ ID NO: 33571 - protein, 498 aa, Acinetobacter sp. SE19
MGGIPHIPFCLTSVICQGCLIMNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 33572 - protein, 505 aa, Gossypium arboreum
MDLLFLEKALLGLFVAVVLAITISKLRGKRFKLPPGPLPVPVFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRFGWEDEAARVVEDVRKNPEAATNGIVLRRRLQLMMYNNMYRIMFDTRFESEDDPLFVRLKALNGERSRLAQSFEYNYGDFIPILRPFLRGYLKICKEVKDRRLQLFKDHFVEERKKLGSTKSMNNDGLKCAIDHILDAQQKGEINEDNVLYIVENINVAAIETTLWSIEWGIAELVNHPEIQKKLRHELDTVLGPGNQITEPDTHKLPYLQAVIKETLRLRMAIPLLVPHMNLHDAKLGGYDIPAESKILVNAWWLANNPANWKNPEEFRPERFFEEEAKVEANGNDFRYLPFGVGRRSCPGIILALPILGITLGRLVQNFELLPPPGQSQIDTTEKGGQFSLHILKHSTIVAKPRQF

SEQ ID NO: 33573 - protein, 505 aa, Gossypium arboreum
MDLLFLEKVLISLFFTIIFAILVSKLRGKRFKLPPGPLPIPVFGNWLQVGDDLNHRNLTDLAKKFGDIFLLRMGQRNLVVISSPELAKEVLHTQGVEFGSRTRNVVFDIFTGKGQDMVFTVYGEHWRKMRRIMTVPFFTNKVVQQYRHGWEDEAASVVEDVKKNPEAATNGIVLRRKLQLMMYNNMYRIMFDRRFESEDDPLFVKLKALNGERSRLAQSFEYNYGDFIPILRPFLRGYLKLCKEVKEIRLQLFRDQFLEERKKLATTKRIDNNALKCAIDHILDAQRKGEINEDNVLYIVENINVAAIETTLWSIEWGIAELVNHPEIQQKLRNEIDTVLGPGVQVTEPDTHKLPYLQAVIKETLRLRMAIPLLVPHMNLHDAKLGGYDIPAESKILVNAWWLANNPAHWKNPEEFRPERFFEEESKVEANGNDFRYLPFGVGRRSCPGIILALPILGITLGRLVQNFELLPPKGQSKLDTSEKGGQFSLHILKHSTIVAKPRVF

SEQ ID NO: 33574 - protein, 340 aa, Acinetobacter sp. M-1
MSNHQIRAYAAMQAGEQVVPYQFDAGELKAHQVEVKVEYCGLCHSDLSVINNEWQSSVYPAVAGHEIIGTIIALGSEAKGLKLGQRVGIGWTAETCQACDPCIGGNQVLCTGEKKATIIGHAGGFADKVRAGWQWVIPLPDDLDPESAGPLLCGGITVLDPLLKHKIQATHHVGVIGIGGLGHIAIKLLKAWGCEITAFSSNPDKTEELKANGADQVVNSRDAQAIKGTRWKLIILSTANGTLNVKAYLNTLAPKGSLHFLGVTLEPIPVSVGAIMGGAKSVTSSPTGSPLALRQLLQFAARKNIAPQVELFPMSQLNEAIERLHSGQARYRIVLKADFD

SEQ ID NO: 33575 - protein, 475 aa, Brotherella complanata
MSPQTETKAGVGFKAGVKDYRLTYYTPDYQTKDTDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTSEEMLKRAQFARELGMPIIMHDYLTGGFTANTSLAHYARDNGLLLHIHRAMHAVIDRQKNHGMHFRVLAKALRLSGGDHIHAGTVVGKLEGERQVTLGFVDPLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 33576 - protein, 475 aa, Rhytidiadelphus japonicus
MSPQMETKAGVGFKAGVKDYRLTYYTPNYQTKETDILAAFRMTPQPGVPAEEAGAAVAAESSTGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTTLAHYCRDNGLLLHIHRAMHAVIDRQKNHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGYEVIREATKWSPELAAACEVWKEIKFEFETIDTI

SEQ ID NO: 33577 - protein, 475 aa, Pylaisiadelpha tenuirostris
MSPQTETKAGVGFKAGVKDYRLTYYTPDYQTKDTDILAAFRMTPQPGVPAEEAGAAVAAESSSGTWTTVWTDGLTSLDRYKGRCYDLEAVPGEENQYIAYVAYPLDLFEEGSVTNLFTSIVGNVFGFKALRALRLEDLRIPPAYSKTFQGPPHGIQVERDKLNKYGRPLLGCTIKPKLGLSAKYYGRAVYECLRGGLDFTKDDENVNSQPFMRWRDRFLFVAEAIYKSQAETGEIKGHYLNATAGTSEEMLKRAQCARELGMPIIMHDYLTGGFTANTSLAHYARDNGLLLHIHRAMHAVIDRQKNHGMHFRVLAKALRLSGGDHIHAGTVVGKLEGERQVTLGFVDSLRDDYIEKDRSRGIYFTQDWVSLPGVLPVASGGIHVWHMPALTEIFGDDSVLQFGGGTLGHPWGNAPGAVANRVALEACVQARNEGRDLAREGNEVIREATKWSPELAAACEVWKEIKFEFDTIDTI

SEQ ID NO: 33578 - protein, 467 aa, Ampelozizyphus amazonicus
ASVGFKAGVKDYKLTYYTPDYETKDTDILAAFRVTPQPGVPPEEAGAAVAAESSTGTWTTVWTDGLTSLDRYKGRCYHIEPVAGEENQYIVYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDYVEKDRSRGIYFTQDWVSLPGVIPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33579 - protein, 467 aa, Emmenosperma alphitonioides
ASVGFKAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSAELAAACEVWKEIKFEFEAMDTL

SEQ ID NO: 33580 - protein, 468 aa, Dorstenia psilurus
KASVGFKAGVKDYKLTYYTPDYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSIPGVIPVASGGIHVWHMPALTEIFGDDAVLQFGGGTLGHPWGNAPGAVANRVALEACVQARNEGRDLAAEGNEIIREASKWSPELAAACEVWKEIKFEFQAMDTL

SEQ ID NO: 33581 - protein, 252 aa, Schedonorus pratensis
MASCNALLLFFSAAFCFLARLAAGDYGSWQSAHATFYGEADASGAMGGACGYGNLYSTGYGTNTAALSTALFNDGAACGSCYELKCDAAVGTYCRAGSITITATNLCPPNYALPNDAGGWCNPPRAHFDMAEPAYLQIGVYRAGIVPVNYRRVPCVKKGEIRFTINGHSYFNLVLVTNVAGAGDVQSVSIKGSSTGWQAMSRNWGQNWQSNADLDGQSLSFKVTISDGRTIVSNNAAPAGWQFGQTFEGGQF

SEQ ID NO: 33582 - protein, 464 aa, Gouania mauritiana
GFKAGVKDYKLTYYTPQYETKDTDILAAFRVTPQPGVPPEEAGAAVAAESSTGTWTTVWTDGLTSLDRYKGRCYGLEPVAGEENQYIAYVAYPLDLFEEGSVTNMFTSIVGNVFGFKALRALRLEDLRIPTAYIKTFQGPPHGIQVERDKLNKYGRPLLGCTIKPKLGLSAKNYGRAVYECLRGGLDFTKDDENVNSQPFMRWRDRFLFCAEAIYKAQAETGEIKGHYLNATAGTCEEMIKRAVCARELGVPIVMHDYLTGGFTANTTLAHYCRDNGLLLHIHRAMHAVIDRQKNHGMHFRVLAKALRLSGGDHIHAGTVVGKLEGERDITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNDIIREASKWSPELAAACEVWKEIKFEFEAMDTL

SEQ ID NO: 33583 - protein, 468 aa, Lasiodiscus mildbraedii
KASVGFKAGVKEYRLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEVKGHYFNATAGTCEEMIKRAVFARELGVPIVMHDYLTGGFTANTSLAHYCRDNGLLLHIHRAMHAVIDRQKNHGMHFRVLAKALRLSGGDHIHAGTVVGKLEGEREITLGFVDLLRDDFVEKDRSRGIYFTQDWVSIPGVIPVASGGIHVWHMPALTEIFGDDSVLQFGGGTLGHPWGNAPGAVANRVALEACVQARNEGRDLAREGNEIIREASKWSPELAAACEVWKEIRFEFQAMDTL

SEQ ID NO: 33584 - protein, 464 aa, Noltea africana
GFKAGVKDYKLTYYTPDYETKDTDILAAFPVTPQPGVPLEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33585 - protein, 467 aa, Paliurus spina-christi
  misc_feature (5)..(5): Xaa can be any naturally occurring amino acid
  misc_feature (225)..(225): Xaa can be any naturally occurring amino acid
ASVGXKAGVKDYKLTYYTPEYETKDTDILAAFRVTPQPGVPPEEAGAAVAAESSTGTWTTVWTDGLTSLDRYKGRCYGIEPVAGEENQYIAYVAYPLDLFEEGSVTNMFTSIVGNVFGFKALRALRLEDLRIPTAYSKTFQGPPHGIQVERDKLNKYGRPLLGCTIKPKLGLSAKNYGRAVYECLRGGLDFTKDDENVNSQPFMRWRDRFLFCAEALYKAQAETXEIKGHYLNATAGTCEEMMKRAVFARELGVPIVMHDYLTGGFTANTSLAHYCRDNGLLLHIHRAMHAVIDRQKNHGMHFRVLAKALRLSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33586 - protein, 475 aa, Phylica nitida
MSPQTETKASVGFIAGVKDYKLTYYTPDYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALFKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHAGTVVGKLEGERDITLGFVDLLRDDFIEKDRSRGIYFTQDWVSLPGVLPVASGGIHVWHMPALTEIFGDDSVLQFGGGTLGHPWGNAPGAVANRVALEACVKARNEGRDLAREGNEIIREASKWSAELAAACEVWKEIKFEFEAMDTL

SEQ ID NO: 33587 - protein, 465 aa, Pomaderris rugosa
VGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPPAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33588 - protein, 253 aa, Streptomyces coelicolor A3(2)
MTAMVKAEGVHKSFGAVEVLKGIDLEVKQGEVFCLIGPSGSGKSTFLRCINHLEKINAGRLYVDGELVGYRQKGDKLYELKDSEVALKRRDIGMVFQRFNLFPHMTAVENVMEAPVQVKGMSRAQARERARGLLERVGLADKAGNYPSQLSGGQQQRVAIARALAMDPKLMLFDEPTSALDPELVGDVLDVMRDLAESGMTMVVVTHEMGFAREVGDSLVFMDNGVVVESGNPRDVLTDPQHDRTKAFLSKVL

SEQ ID NO: 33589 - protein, 185 aa, Schizosaccharomyces pombe
DPYGKRVGIIGMGAIGKSFAQKILPLGCEIVYHNRNRLEAEEEKRLGASFVSFDELLSSSDVISINCPLTPATHDLISTKEFEKMKDGVYIINTARGAIINEDAFIKAIKSGKVARAGLDVFLNEPTPNKFWLECDKVTIQPHCGVYTNFTVAKTEECVLASIETFLDTGIPTNPVNGPFGMNGC

SEQ ID NO: 33590 - protein, 467 aa, Spyridium forrestianum
  misc_feature (5)..(5): Xaa can be any naturally occurring amino acid
ASVGXKAGVKDYKLTYYTPEYETKDTDILAAFRVTPQPGVPPEEAGAAVAAESSTGTWTTVWTDGLTSLDRYKGRCYHIEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33591 - protein, 467 aa, Spyridium globulosum
ASVGFKAGVKDYKLTYYTPEYETKDTDILAAFRVTPQPGVPPEEAGAAVAAESSTGTWTTVWTDGLTSLDRYKGRCYHIEPVAGEESQFIAYVAYPLDLFEEGSVTNMFTSIVGNVFGFKALRALRLEDLRIPTAYTKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMMKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIEFEFEAMDTL

SEQ ID NO: 33592 - protein, 466 aa, Siegfriedia darwinioides
SVGFKAGVKDYKLTYYTPEYETKDTDILAAFRVTPQPGVPPEEAGAAVAAESSTGTWTTVWTDGLTSLDRYKGRCYHLEPVAGEENQYIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRLSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33593 - protein, 467 aa, Trymalium floribundum
ASVGFKAGVKDYKLTYYTPDYETKDTDILAAFRVTPQPGVPPEEAGAAVAAESSTGTWTTVWTDGLTSLDRYKGRCYHIEPVAGEETQFIAYVAYPLDLFEEGSVTNMFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFCAEALYKAQAETGEIKGHYLNATAGTCEEMIKRAVFARELGVPIVMHDYLTGGFTANTSLAHYCRDNGLLLHIHRAMHAVIDRQKNHGIHFRVLAKALRMSGGDHIHSGTVVGKLEGEREITLGFVDLLRDDFVEKDRSRGIYFTQDWVSLPGVLPVASGGIHVWHMPALTEIFGDDSVLQFGGGTLGHPWGNAPGAVANRVALEACVQARNEGRDLAREGNEIIREASKWSPELAAACEVWKEIKFEFEAMDTL

SEQ ID NO: 33594 - protein, 488 aa, Coptis japonica
MEVLSIAIVSFSFLLFLFFILRDSRPKNLPPGPRPSPIVGNLLQLGDKPHAEFAKLAQKYGELFSLKLGSQTVVVASSPAAAAEILKTHDKILSGRYVFQSFRVKEHVENSIVWSECNDNWKLLRKVCRTELFTPKMIESQSEIREAKAREMVKFLRGKEGEVVKIVEVVFGTLVNIFGNLIFSKDVFDLEDPTGGSVELKEHLWKLLDMGNSTNPADYFPIMGKLDLFGQRRAVAEVLQQIYDVWGVMLKERRGTKGSESKNDFVDVLLNAGLDDQKINALLMELFGAGTETSASTIEWAITELTKKPLVVSKIRLELVNVVGDNTVKESDLPHLPYLQAFVKETLRLHPPTPLLLPRRALETCTVMNYTIPKECQIMVNAWAIGRDPKTWDDPLNFKPERFLSSDVDYKGNDFELIPFGGGRRICPGLPLASQFSNLIVATLVQNFEWSLPQGMSTSELSMDEKFGLTLQKDPPLLIVLKARASNI

SEQ ID NO: 33595 - protein, 282 aa, Adiantum capillus-veneris
MSSVRVDSPRSSVDPSCSNGEVAVRHHKGCLAMETPSWMPPSITNAGILQKVGAELISTYILVFAGCGAAMVDEKSGGAITHFGVSAAFGLVVMIMIYSVGHISGAHMNPAVTLAFATVRHFPWAQVPAYIGAQVVAAISAAFSLRLILGGAAKIGATLPVGSDVQSLALEVITSYILMFVVSAVATDTRAIGELAGLAVGSAVALDAIFAGPICGASMNPARSIGPAVASYDFKSLWVYIVGPILGCLLGAWSYTMIKLPEQPQDLAMISQSKSFKSSRRG

SEQ ID NO: 33596 - protein, 475 aa, Hypnum cupressiforme
MSPQTETKAGVGFKAGVKDYRLTYYTPDYQTKETDILAAFRMTPQPGVPAEEAGAAVAAESSTGTWTTVWTDGLTSLDRYKGRCYDLEAVPGEENPYIAYVAYPLDLFEEGSVTNLFTSIVGNVFGFKALRALRLEDLRIPPAYSKTFQGPPHGIQVERDKLNKYGRPLLGCTIKPKLGLSAKNYGRAVYECLRGGLDFTKDDENVNSQPFMRWRDRFLFVAEAIYKSQAETGEIKGHYLNATAGTCEEMMKRAQFARELGMPIVMHDYLTGGFTANTSLAHYCRDNGLLLHIHRAMHAVIDRQKIHGMHFRVLAKALRLSGGDHIHAGTVVGKLEGERQVTLGFVDLLRDDYIEKDRSRGIYFTQDWVSLPGVLPVASGGIHVWHMPALTEIFGDDSVLQFGGGTLGHPWGNAPGAVANRVALEACVQARNEGRDLAREGNEIIREATKWSPELAAACEVWKEIKFEFDTIDTI

SEQ ID NO: 33597 - protein, 285 aa, uncultured marine gamma proteobacterium EBAC31A08
MSILQSFTFQELKNLLPNRAKDSHKGNFGKVLICAGSPGMGGAGILASEASLFCGSGLVTLVTDTSNVSPSLLRNPEVMAIGVDMVEGVDIDLKIKDHSVILYGPGIANTAFAKTILGKILKSANNSKIILDAGALHIVASSKSLIKKSNKTILMTPHPGEAAILLNISIEEVQRDRISAAKQIADTYGASIVILKGMGTVVFDSTNNKSFICACGGPELASGGTGDVLAGVLTALLAQGLDIRNASIIAVAVHSEAGLKFKVDIGEIGLNASSLIPIIRQLINR

SEQ ID NO: 33598 - protein, 422 aa, uncultured marine gamma proteobacterium EBAC31A08
MVLKILEIFGHLIFELKPRYNIFMKEIIKEYTNYMVPFYAPADFVVKKASGSHVWDLNNKKYIDFTAGIAVTNLGHSNKDLIKILKKQSEELWHLSNLYINEPSVTLARKLCKNSFADKVFFCNSGAESIEAAVKIARKFCSSTVNKNKNEVISFSTSFHGRTMLGIALAKAKHLTDGFAPLPRGIKNHPYNDITNLEKVFSDKTAAVILELVQWQSGITKADKKFIAKIKKLAKKHKALVIIDEVQSGIGRTGTLFAYEQFNITPDILCFAKGISNGFPLGGILTSDKVSKHMSAGSHGTTFGGGPIACAIGNEVIDTISKKSFLNKVLKKEVRFINLLNKINEKHKCFEKITSAGLWVGVEVSKDSKIQIDDLIKKSHHNGLMILKANASTVRFSPSLIIENELVDEGLKIFEKSIISLL

SEQ ID NO: 33599 - protein, 252 aa, Pyrus communis
MPIRNIAVGRPEETYHPDALRAALAEFISTLIFVFAGEGSGMAFAKLTDDAANTPAGLVAAALAHAFGLFVAVSISANISGGHVNPAVTFGAFIGGNISLLRGILYWIAQLLGATVACGLLKFVTNGQTTAAFSLSSGVGVWNAFVFEIVMTFGLVYTVYATAIDPKNGSVGTIAPIAIGFIVGANILAGGAFDGASMNPAVSFGPALVSWSWENHWVYWAGPLIGAGLAGLIYEFVFIGNSGHEQLPSTDY

SEQ ID NO: 33600 - protein, 460 aa, Lycopersicon esculentum
MDSSWEASVTDSINAIYLLFSAYLVFVMQLGFAMLCAGSVRAKNAMNIMLTNVVDAVVGSLSYYLFGFAFAFGDSNPFIGASYFALKDIPSSSYDYSFFLYQWAFAIAVAGITSGSIAERTQFTAYLVFSFFLTGFVYPVVAHWLWSSNGWLSPNSTYLLFGSGAIDFAGSGVVHLVGGIAGFWGSIVEGPRVGRFDAFGNPVKMRGHNATLVVLGTLLLWFGWFGFNPGSFNKILVAYPHMADQGNWTSVGRTAVTTTLAGSTAGIVTLFGRRLLVGHWDAMDVCNGVLGGFVAITSGCSVVEPWAAILCGFCAAWVLIGLNILALKFKFDDPLEAAQLHGGCGAWGLIFTGLFAKEEFVLQAYNSGKTQIIRPSGLILGGGWGLFGAQIVELLSIVVWVSLTMGPLFYLLQKLGILRISSDEEVAGLDISSHGGYAYDASQEESNARFYGEYLRMQQQ

SEQ ID NO: 33601 - protein, 393 aa, Pseudomonas sp. 101
AKVLCVLYDDPVDGYPKTYARDDLPKIDHYPGGQTLPTPKAIDFTPGQLLGSVSGELGLRKYLESNGHTLVVTSDKDGPDSVFERELVDADVVISQPFWPAYLTPERIAKAKNLKLALTAGIGSDHVDLQSAIDRNVTVAEVTYCNSISVAEHVVMMILSLVRNYLPSHEWARKGGWNIADCVSHAYDLEAMHVGTVAAGRIGLAVLRRLAPFDVHLHYTDRHRLPESVEKELNLTWHATREDMYPVCDVVTLNCPLHPETEHMINDETLKLFKRGAYIVNTARGKLCDRDAVARALESGRLAGYAGDVWFPQPAPKDHPWRTMPYNGMTPHISGTTLTAQARYAAGTREILECFFEGRPIRDEYLIVQGGALAGTGAHSYSKGNATGGSEEA

SEQ ID NO: 33602 - protein, 447 aa, Enterococcus faecalis
MKVIVLGSSHGGYEAVEELLNLHPDAEIQWYEKGDFISFLSAGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 33603 - protein, 447 aa, Enterococcus faecalis
MKVIVLGSSHGGYEAVEELLNLHPDAEIQWYEKGDFISFLSSGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 33604 - protein, 447 aa, Enterococcus faecalis
MKVIVLGSSHGGYEAVEELLNLHPDAEIQWYEKGDFISFCSCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 33605 - protein, 447 aa, Enterococcus faecalis
MKVIVLGSSHGGYEAVEELLNLHPDAEIQWYEKGDFISFLCCGMQLYLEGKVKDVNSVRYMTGEKMESRGVNVFSNTEITAIQPKEHQVTVKDLVSGEERVENYDKLIISPGAVPFELDIPGKDLDNIYLMRGRQWAIKLKQKTVDPEVNNVVVIGSGYIGIEAAEAFAKAGKKVTVIDILDRPLGVYLDKEFTDVLTEEMEANNITIATGETVERYEGDGRVQKVVTDKNAYDADLVVVAVGVRPNTAWLKGTLELHPNGLIKTDEYMRTSEPDVFAVGDATLIKYNPADTEVNIALATNARKQGRFAVKNLEEPVKPFPGVQGSSGLAVFDYKFASTGINEVMAQKLGKETKAVTVVEDYLMDFNPDKQKAWFKLVYDPETTQILGAQLMSKADLTANINAISLAIQAKMTIEDLAYADFFFQPAFDKPWNIINTAALEAVKQER

SEQ ID NO: 33606 - protein, 357 aa, Populus balsamifera subsp. trichocarpa
MGSLETERKIVGWAATDSTGHLAPYTYSLRDTGPEDVFIKVISCGVCHTDIHQIKNDLGMSHYPMVPGHEVVGEVVEVGSDVTKFKVGDVVGVGVIVGSCKNCHPCKSEIEQYCNKKIWSYNDVYTDGKPTQGGFAESMVVDQKFVVRIPDGMSPEQAAPLLCAGLTVYSPLKHFGLKQSGLRGGILGLGGVGHMGVKIAKAMGHHVTVISSSDKKREEAMEHLGADEYLVSSDVESMQKAADQLDYIIDTVPVVHPLEPYLSLLKLDGKLILMGVINAPLQFVTPMVMLGRKSITGSFIGSMKETEEMLEFCKEKGLASMIEVIKMDYINTAFERLEKNDVRYRFVVDVAGSKLIP

SEQ ID NO: 33607 - protein, 338 aa, Populus balsamifera subsp. trichocarpa
MPVDASSLSGQGQTICVTGAGGFIASWMVKLLLDKGYTVRGTARNPADPKNSHLRELEGAEERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 33608 - protein, 534 aa, Arabidopsis thaliana
MLILFETPGGFAIFKVLNEGKLSNVEDLGNEFSTAKLARKMVKLVAFDKFDNTAEALEAVAKLLEGTPSKGLRKFLKANCVGETLAVADSKLGNIIKEKLKIVCVHNNAVMELLRGIRSQLTELISGLGDQDLGPMSLGLSHSLARYKLKFSSDKVVDTMIIQAIGLLDDLDKELNTYAMRVREWFGWHFPELAKIVQDNILYAKAVKLMGNRINAAKLDFSEILADEIEAELKEAAVISMGTEVSDLDLLHIRELCDQVLSLAEYRAQLYDYLKSRMNTIAPNLTALVGELVGARLISHGGSLLNLAKQPGSTVQILGAEKALFRALKTKHATPKYGLIFHASVVGQAAPKNKGKISRSLAAKSVLAIRCDALGDSQDNTMGVENRLKLEARLRTLEGKDLGRLSGSAKGKPKIEVYDKDKKKGSGGLITPAKTYNTAADSLLQTPTVDSENGVKEKKDKKKKKKADDEEEAKTEEPSKKKSNKKKTEAEPETAEEPAKKEKKKKRKHEEEETEMPAKKKEKSEKKKKKKTEV

SEQ ID NO: 33609 - protein, 457 aa, Arabidopsis thaliana; identical to SEQ ID NO: 32843

SEQ ID NO: 33610 - protein, 500 aa, Saccharomyces cerevisiae; identical to SEQ ID NO: 32117

SEQ ID NO: 33611 - protein, 331 aa, Glycine max; identical to SEQ ID NO: 4013

SEQ ID NO: 33612 - protein, 668 aa, Arabidopsis thaliana
MASEKSTSKGQAWFCTTGLPSDIEIEVDDMTFHLHKFPLMSKSRKLHRLITEQETRSSSSMALITVIDPKVEETDKKGKGHEIEDDKEEEEVEEQEIEENGYPHIKLEDFPGSSESFEMVAKFCYGVKMDLSASTVVPLRCAAEHLEMTEEYSPDNLISKTERFLSHSVYKSLRESIKALKACESVSPLAGSLGITEQCIDSIVSRASSADPSLFGWPVNDGGGRGNISATDLQLIPGGAAKSRKKPSRDSNMELWFEDLTQLSLPIFKTVILSMRSGDLSSDIIESCLICYAKKHIPGILRSNRKPPSSSSTAVSENEQRELLETITSNLPLDKSSISSTTRFLFGLLRTAIILNAAEICRDLLERKIGSQLERATLDDLLVPSYSYLNETLYDVDLVERILGHFLDTLEQSNTAIVEVDGKSPSLMLVGKLIDGFLAEIASDANLKSDKFYNLAISLPDQARLYDDGLYRAVDVYLKAHPWVSEAEREKICGVMDCQKLTLEACTHAAQNERLPLRAVVQVLFFEQLQLRHAIAGTLLAAQSPSTSQSTEPRPSAAIRNLTITEEDGDEAEGERQVDAGKWKKTVRENQVLRLDMDTMRTRVHRLERECSNMKKVIAKIDKEGSSPATTTDRPRSWSITKKFGCKFKTQVCDSHEATMVDHRSRRS

SEQ ID NO: 33613 - protein, 370 aa, Pseudomonas fluorescens PfO-1
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECGQCKFCKSGKTNLCQAIRATQGKGLMPDGTSRFSYKGQTIFHYMGTSTFSEYTVLPEISVAKISKDAPLEKVCLLGCGVTTGIGAVINTAKVKPGDTVAIFGLGGIGLSAVIGAVKAKASRIIAIDINPAKFEIAKQLGATDCVNPKDFDRPIQEVIVDMTDGGVDFSFECIGNVQLMRAALECCHKGWGESVIIGVAGAGQEISTRPFQLVTGRVWRGSAFGGVRGRTELPSYVDMAQSGEIPLDTFITHTMGLEDINKAFDLMHEGKSIRTVIHF

SEQ ID NO: 33614 - protein, 490 aa, Sinorhizobium meliloti; identical to SEQ ID NO: 13030

SEQ ID NO: 33615 - protein, 481 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMKHLLNPKAREIEISGIRKFSNLVAQHEDVISLTIGQPDFFTPHHVKAAAKKAIDENVTSYTPNAGYLELRQAVQLYMKKKADFNYDAESEIIITTGASQAIDAAFRTILSPGDEVIMPGPIYPGYEPIINLCGAKPVIVDTTSHGFKLTARLIEDALTPNTKCVVLPYPSNPTGVTLSEEELKSIAALLKGRNVFVLSDEIYSELTYDRPHYSIATYLRDQTIVINGLSKSHSMTGWRIGFLFAPKDIAKHILKVHQYNVSCASSISQKAALEAVTNGFDDALIMREQYKKRLDYVYDRLVSMGLDVVKPSGAFYIFPSIKSFGMTSFDFSMALLEDAGVALVPGSSFSTYGEGYVRLSFACSMDTLREGLDRLELFVLKKREAMQTINNGV

SEQ ID NO: 33616 - protein, 471 aa, Acidithiobacillus ferrooxidans
MGYSPSDVVKLIQEKDIKFVDFRFTDTKGKEQHVSVPGHVIEEDTFTEGKAFDGSSIAGWKGINESDMILLPDPDSAVLDPFMDETTLLLRCDVIEPATGQGYERDPRSVAKRAEIYLKSTGIADTSFFGPENEFFVFDSVTWNIDMSGCAYKVDAEEAAWNSGKEYESGNMGHRPGVKGGYFPVPPVDSAQDLRSAMCLAMEEMGLKVEVHHHEVATAGQHEIGVGFNTLTRKADEVQILKYVVHNVAAAYGQTATFMPKPIVGDNGSGMHVHQSLGKDGKNIFAGDLYGGLSEIALYYIGGIIKHAKAINALTNPSTNSYKRLVPHFEAPVLLAYSAKNRSASIRIPFVNSPKARRIEVRFPDSTANPYLAFSAMLMAGLDGIQNKIHPGDAMDKNLYDLPAEEQANIPGVAASLEEALRALEADHDFLMKGGVFSESWLEGYLDVKWAEVQALRMTTHPVEFQMYYSL

SEQ ID NO: 33617 - protein, 428 aa, Pseudomonas syringae pv. tomato str. DC3000 [sequence omitted]

SEQ ID NO: 33618 - protein, 473 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMSSLFQTYGRWDIDIKKAKGTYVEDQNGKTYLDFIQGIAVSNLGHCHEAVTEAVKKQLDSVWHVSNLFQNSLQEQAAQKLAAHSAGDLVFFCNSGAEANEGAIKLARKATGKTKIITFLQSFHGRTYAGMAATGQDKIKTGFGPMLGGFHYLPYNDPSAFKALGEEGDIAAVMLETVQGEGGVNPASAEFLSAVQSFCKEKQALLIIDEIQTGIGRTGKGFAYEHFGLSPDIITVAKGLGNGFPVGAVIGKKQLGEAFTPGSHGTTFGGNMLAMAAVNATLQIVFQPDFLQEAADKGAFLKEQLEAELKSPFVKQIRGKGLMLGIECDGPVADIIAELQTLGLLVLPAGPNVIRLLPPLTVTKDEIAEAVSKLKQAIAHHSAVNQ

SEQ ID NO: 33619 - protein, 430 aa, Synechocystis sp. PCC 6803
MASSMLSSATMVASPAQATMVAPFNGLKSSAAFPATRKANNDITSITSNGGRVNCMQVWPPIGKKKFETLSYLPDLTDSGGRVNCMQAMVSERILPELNTAEISLDRETALVLYEDMVLGRFFEDKCAEMYYRGKMFGFVHLYNGQEAVSSGIIKAMRQDEDYVCSTYRDHVHALSAGVPAREVMAELFGKETGCSRGRGGSMHLFSSAHNLLGGFAFIGEGIPVALGAAFQTKYRREVLKDDGYDQVTACFFGDGTSNNGQFFECLNMAALWKLPILFVVENNKWAIGMAHERATSQPEIYKKASVFNMVGVEVDGMDVVAMHKVATEAVARARAGEGPTLIEALTYRFRGHSLADPDELRSAEEKQFWAARDPIKKFAAFMTEHELASNEELKAIDKRIQEVIDDALAFAESSPEPNPEDLRKYIFAD

SEQ ID NO: 33620 - protein, 445 aa, Agrobacterium tumefaciens
MASSMLSSATMVASPAQATMVAPFNGLKSSAAFPATRKANNDITSITSNGGRVNCMQVWPPIGKKKFETLSYLPDLTDSGGRVNCMQAMSALRFHAAKDLRIEDIAEPKRPGPGQVLVRNRFVGICGTDLHEYSYGPIFIPTEPHPFTGAHGPQILGHEFGGVVEAIGDGVTSVNVGDRVSIQPLIMPRSGDYFADRGLFHLSTQLALVGLSWDGGGMAEAALVNEYNVQKIPDEMTDEEAALVEPSAVAVYACDRGGVTAGNSVLVTGAGPIGMLTLLAARAAGATQLFVSDLNDARLELARNVIRDVITINPKRDNVGDVVRSATEGKVGCDVAIECVGNEHALKACVDAVRKQGVVVQTGLHPHENPIDWFQVTFRDLEIKGSWAYPTHYWPRVIRLIASGLLPATKIVTKRITLDTAVTEGFDALLDPAGTHLKILIDLSK

SEQ ID NO: 33621 - protein, 192 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMGFFDSDIIQQEAKQLFEDYQSLTKLGGDYGKFDRDGKVIFIEQMEALMERYKIFMKRFELSDDFMAKMTVEQMKTQLGQFGISPQQMFDQMNLTLERMKAEIK

SEQ ID NO: 33622 - protein, 502 aa, Bacillus halodurans
MASSMLSSATMVASPAQATMVAPFNGLKSSAAFPATRKANNDITSITSNGGRVNCMQVWPPIGKKKFETLSYLPDLTDSGGRVNCMQAMVEFRLPDVGEGMHEGEIISWFVQEGDHVKQDEPVVEVQTDKMNAELTAPVSGKIKRVYYKVGEVAEVGSLLFTIDENLSTFKSETHERTKRENSTEQTRPISNISLTSQQKAPVRKGLATPYVRQLAREMNINLEDVVGTGPGGRVLEQDLQNDTNLQKVKTVPSGVANVQESIERTGSSAEKRIPLKGIRKAIAEKMIKSVATIPHVTHVDEIEMDALKELREQLKHYSEQKGIKLTFLPFFIKAIVSALKEFEYFNASIDEETNEIVLKKDYHIGIATDTEKGLIVPVIQNADQKSLLELAGEITQLSTQARKGTLNVQQMTGSTFTISNVGPIGGLHATPIINYPEVAILALHKMEPRNVVREWESVIKLMMNMSLSFDHRLVDGATAVRFTNRMKELIENPNLLLMELR

SEQ ID NO: 33623 - protein, 486 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMAVKVVMPKLGMAMKQGEVSIWNKKVGDPVEKGESIASIQSEKIEMEIEAPEKGTLIDIKVKEGEEVPPGTAICYIGDANESVQEEAGAPVAEDNMPQAVQPVKQENKPAASKKDRMKISPVARKIAEKAGLDLKQLKGTGPGGRIVKDDVTKALAEQKKDQAKPVSEQKAQEIPVTGMRKVIAARMQESLANSAQLTITMKADITKLATLQKQLSPTAEERYGTKLTITHFVSRAAVLALQAHPVLNSFYQNERIITHPHVHLGMAVALENGLVVPVIRHAEKLSLIELAQSISENAKKAREGRAGSEELQGSTFSITNLGAFGVEHFTPILNPPETGILGIGASYDTPVYQGEEIVRSTILPLSLTFDHRACDGAPAAAFLKAMKTYLEEPAALIL

SEQ ID NO: 33624 - protein, 576 aa, Bacillus subtilis subsp. subtilis str. 168
MASSMLSSATMVASPAQATMVAPFNGLKSSAAFPATRKANNDITSITSNGGRVNCMQVWPPIGKKKFETLSYLPDLTDSGGRVNCMQAMVTMFQYEELNKQFIGGKWQEGSSPNVLENKNPYTQKTFTTFRKATADDVDEAYRAAALAKKKWDAVNPFEKRTILEKAVTYIEENEEAIIYLIMEELGGTRLKAAFEIGLVKNIIKEAATFPIRMEGKILPSTIDGKENRLYRVPAGVVGVISPFNFPFFLSMKSVAPALGAGNGVVLKPHEETPICGGTLIAKIFENAGIPAGLLNVVVTDIAEIGDSFVEHPVPRIISFTGSTKVGSYIGQLAMKHFKKPLLELGGNSAFIVLEDADIEYAVNAAVFSRFTHQGQICMSANRVLVHSSIYDKFLELYQAKVESLKVGDPMDPDTIIGPLINSRQTDGLMKTVEQAIEEGAVPVKLGGFNGTIVEPTILKDVKPFMSIAKEELFGPVVSFMKFDSEDEAVDIANETPFGLSGAVHTSNLERGVAFAKRIETGMIHVNDTTINDEPNVAFGGEKQSGLGRLNGEWSLEEFTTLKWISVQHEKRSFPY

SEQ ID NO: 33625 - protein, 571 aa, Pseudomonas syringae pv. tomato str. DC3000
MASSMLSSATMVASPAQATMVAPFNGLKSSAAFPATRKANNDITSITSNGGRVNCMQVWPPIGKKKFETLSYLPDLTDSGGRVNCMQAMTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 33626 - protein, 385 aa, Arabidopsis thaliana
LSSASYTRLTANSDLQTNTCHASLPDPSLFFTDFTRANSHVRVLHHKFLGKGVYGSVDLIRYTKTDGSSLQAAVKTSYAEDLEEYDALKREIQILSELKGYPNIVICYGDDLEEDFNEHGHKVYKLLLEYANEGSLSSFMENYPDRKLPDPMIRDFTRMILEGLVSMHSHGYVHCDLKSDNLLIFSRKDSASCELKIFDFGNCRQVGEVPDHWKSDYPYVGTPESFFDGVAKKTLDLWSLGCLVLKIYTGEQPWERVTSVDFVNFLSDGEAPNIPEYVPCDAREFIETCFAREHEKRGTASELLLHPFLCQKQPLLVKLKLRIKQASKITMGIREKPLTLKMFLSKPPQLKKLLSKLLRLKKMIHPKPLELDSSFVSYSSDLCLL

SEQ ID NO: 33627 - protein, 372 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMVSKILYADSGTSQTQEMLKAMMDFPAVQKASITILHVVPPQITTEAFTEKWAEGGKILADLLEDVAIEPSKVSTVLRQGDPKGVVCDVANEIDADLIIMGSRGLKRLEAILENSVSQYVFQLTNHPMLLVKDDIYVKRIKRVMVALDKSAAAEYALELALELLRDYPEGELILARVNPDLKPDLLPLSRQEIEENPVLAPAIAKAKRLGIAYRCTVTGGKPGEKLCELAEDYNADLMLLGSPDRRPSIAKSLPDLDRLLGTSLSDYIRVNAPCPVLLTRKEGI

SEQ ID NO: 33628 - protein, 214 aa, Synechocystis sp.
MASSMLSSATMVASPAQATMVAPFNGLKSSAAFPATRKANNDITSITSNGGRVNCMQVWPPIGKKKFETLSYLPDLTDSGGRVNCMQAMALTLVMGAIASPWVSVGTKLCYSRLNESFYPSNPLTAPNPMNIFGIGLPELGLIFVIALLVFGPKKLPEVGRSLGKALRGFQEASKEFETELKREAQNLEKSVQIKAELEESKTPESSSSSEKAS

SEQ ID NO: 33629 - protein, 498 aa, Arabidopsis thaliana; identical to SEQ ID NO: 10047

SEQ ID NO: 33630 - protein, 446 aa, Xenorhabdus nematophila
MASSMLSSATMVASPAQATMVAPFNGLKSSAAFPATRKANNDITSITSNGGRVNCMQVWPPIGKKKFETLSYLPDLTDSGGRVNCMQAMAKIFDFVKPGVITGDDVQKVFAVAKENNFALPAVNCVGTDSINAVLETAAKVRAPVIIQFSNGGAAFVAGKGLKAEGQQAAILGSISGAHHVHQMAEYYGVPVILHTDHCARKLLPWIDGLLDAGEKHYVQTGKPLFSSHMIDLSEESLEENIEICGQYLARMAKIDMTLEIELGCTGGEEDGVDNSHLDSSSLYTQPEDVAYAYEKLNAISPRFTIAASFGNVHGVYKPGNVKLTPKILRNSQDYVSEKFNLPHNSLDFVFHGGSGSTAEEIQEAVSYGVVKMNIDTDTQWATWEGILNYYKKNEGYLQGQLGNPEGADKPNKKFYDPRVWLRAAQVSMIVRLEQAFKELNAVDVL

SEQ ID NO: 33631 - protein, 490 aa, Chlorobaculum tepidum; identical to SEQ ID NO: 15533

SEQ ID NO: 33632 - protein, 429 aa, Nostoc sp. PCC 7120 [sequence omitted]

SEQ ID NO: 33633 - protein, 532 aa, Synechocystis sp. PCC 6803
MAEAPIAPVVLVILDGWGYRPDTRANAIAQANTPIMDSLIAAYPNTLVNTSGKDVGLPKGQMGNSEVGHLNLGAGRVVPQELVRISDAIEDGTFFDNQALIEVCQRVRDRRGKLHLIGLCSDGGVHSHIDHLLGLIDLAKLQGISQLCIHAITDGRDTPTNEGAHFVQQIQAHLEKIGLGRIVSVSGRYYALDRDRRWDRVEKAYRVMTEDGVGDGRSAAQVIKDYYASDITDEFIPPTRIGAGAIASGDGVIFYNFRPDRARQLCYALVNPSFDGFPRERIQPLDFVTFTQYDPALPVVVAFEPQNLNNILGEIISRQGMKQFRTAETEKYPHVTYFFNGGLEQPFAGEDRELIQSPMVSTYDKAPQMSAKAVTDAVCRAMEKGIYSLVVVNYANPDMVGHTGKLKEAIQAIETVDLNLGRLLASAAKVGGTVLITADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 33634 - protein, 281 aa, Arabidopsis thaliana; identical to SEQ ID NO: 14789

SEQ ID NO: 33635 - protein, 177 aa, Artificial
  Consensus sequence of SEQ ID NO: 601 and its homologs
  Misc_feature (1)..(1): location 1 can be  or Met
  Misc_feature (2)..(2): location 2 can be  or Gln
  Misc_feature (3)..(3): location 3 can be  or Met
  Misc_feature (4)..(4): location 4 can be  or Asp or Met
  Misc_feature (5)..(5): location 5 can be  or Val or Gln
  Misc_feature (6)..(6): location 6 can be  or Tyr or Met
  Misc_feature (7)..(7): location 7 can be  or Asp or Thr
  Misc_feature (8)..(8): location 8 can be Ile or  or His
  Misc_feature (9)..(9): location 9 can be Ile or  or Val or Met
  Misc_feature (10)..(10): location 10 can be  or Tyr or Asp or Ser
  Misc_feature (11)..(11): location 11 can be Ile or  or Leu or Thr
  Misc_feature (12)..(12): location 12 can be  or Pro or Thr
  Misc_feature (13)..(13): location 13 can be  or Val or Ser
  Misc_feature (14)..(14): location 14 can be  or Phe or Arg
  Misc_feature (15)..(15): location 15 can be Ile or
  Misc_feature (16)..(16): location 16 can be  or Ser
  Misc_feature (17)..(17): location 17 can be  or His or Gly
  Misc_feature (18)..(18): location 18 can be  or Leu or Arg
  Misc_feature (19)..(19): location 19 can be  or Lys or Phe
  Misc_feature (20)..(20): location 20 can be  or Ser
  Misc_feature (21)..(21): location 21 can be  or Ser or Met
  Misc_feature (22)..(22): location 22 can be Asn or  or Asp or Ser or Gly
  Misc_feature (23)..(23): location 23 can be Ile or  or Val or Leu or Arg or Thr
  Misc_feature (24)..(24): location 24 can be Ile or  or Leu or Phe or His
  Misc_feature (25)..(25): location 25 can be  or Gln or Leu or Arg
  Misc_feature (26)..(26): location 26 can be Ile or  or Val or Cys or Gly
  Misc_feature (27)..(27): location 27 can be  or Pro or Ser or Thr
  Misc_feature (28)..(28): location 28 can be  or Pro or Ser or Gly
  Misc_feature (29)..(29): location 29 can be  or Leu or Arg
  Misc_feature (30)..(30): location 30 can be  or Phe or Ser
  Misc_feature (31)..(31): location 31 can be  or Leu or Ser
  Misc_feature (32)..(32): location 32 can be  or Ala or Ser
  Misc_feature (33)..(33): location 33 can be  or Tyr or Arg
  Misc_feature (34)..(34): location 34 can be  or Ser or Arg
  Misc_feature (35)..(35): location 35 can be  or Leu or Pro or Ser or Thr
  Misc_feature (36)..(36): location 36 can be  or Pro or Phe or Ser
  Misc_feature (37)..(37): location 37 can be  or Lys or Pro or Arg
  Misc_feature (38)..(38): location 38 can be  or Leu or Phe
  Misc_feature (39)..(39): location 39 can be  or Val or Ala or Phe or Met or Arg
  Misc_feature (40)..(40): location 40 can be  or Leu or Cys
  Misc_feature (41)..(41): location 41 can be  or Val or Ala or Ser
  Misc_feature (42)..(42): location 42 can be Asn or  or Pro
  Misc_feature (43)..(43): location 43 can be Asn or  or Arg
  Misc_feature (44)..(44): location 44 can be  or Asp or Glu or Cys
  Misc_feature (45)..(45): location 45 can be  or Pro or Phe or Ser
  Misc_feature (46)..(46): location 46 can be  or Lys or Pro or Arg
  Misc_feature (47)..(47): location 47 can be  or Glu or Arg or Gly
  Misc_feature (48)..(48): location 48 can be  or Lys or Ser
  Misc_feature (49)..(49): location 49 can be  or Gln or Pro or Arg or Gly
  Misc_feature (50)..(50): location 50 can be Asn or  or Asp or Glu or Arg
  Misc_feature (51)..(51): location 51 can be Asn or  or Lys or Glu or Arg
  Misc_feature (52)..(52): location 52 can be  or Asp or Arg or Ser or Gly
  Misc_feature (53)..(53): location 53 can be Asn or  or Asp or Gly
  Misc_feature (54)..(54): location 54 can be Asn or  or Ala or Gly
  Misc_feature (55)..(55): location 55 can be  or Asn or Arg or Ser or Met or Gly
  Misc_feature (56)..(56): location 56 can be  or Asn or Ile or Asp or Gly
  Misc_feature (57)..(57): location 57 can be  or Lys or Glu or Ser or Gly
  Misc_feature (58)..(58): location 58 can be  or Ser or Gly
  Misc_feature (59)..(59): location 59 can be  or Asp or Glu
  Misc_feature (60)..(60): location 60 can be  or Lys or Thr
  Misc_feature (61)..(61): location 61 can be  or Ala or Ser
  Misc_feature (62)..(62): location 62 can be  or Ser
  Misc_feature (63)..(63): location 63 can be  or Ala or Thr
  Misc_feature (64)..(64): location 64 can be  or Asp or Glu
  Misc_feature (65)..(65): location 65 can be  or Trp
  Misc_feature (66)..(66): location 66 can be  or Asp
  Misc_feature (67)..(67): location 67 can be  or Lys
  Misc_feature (68)..(68): location 68 can be  or Ala
  Misc_feature (69)..(69): location 69 can be  or Trp
  Misc_feature (70)..(70): location 70 can be  or Lys or Ala or Ser
  Misc_feature (71)..(71): location 71 can be Asn or Lys or Ala or Phe or Ser or Thr
  Misc_feature (72)..(72): location 72 can be Leu or Phe or His
  Misc_feature (73)..(73): location 73 can be Lys or Arg or Thr
  Misc_feature (74)..(74): location 74 can be Asn or Lys or Thr
  Misc_feature (75)..(75): location 75 can be Lys or Gln
  Misc_feature (76)..(76): location 76 can be Leu or Ser or Gly
  Misc_feature (77)..(77): location 77 can be Lys or Thr or Gly
  Misc_feature (78)..(78): location 78 can be Lys or Ser or Arg
  Misc_feature (79)..(79): location 79 can be Lys or Ser or Thr
  Misc_feature (80)..(80): location 80 can be Pro or Leu
  Misc_feature (82)..(82): location 82 can be His or Ser
  Misc_feature (83)..(83): location 83 can be Lys or Asp or Glu or Gln
  Misc_feature (85)..(85): location 85 can be Asn or  or Ser
  Misc_feature (86)..(86): location 86 can be Val or Pro or Arg or Ser
  Misc_feature (87)..(87): location 87 can be Ile or Asn or Asp
  Misc_feature (89)..(89): location 89 can be Tyr or Leu
  Misc_feature (91)..(91): location 91 can be Ile or Ser or Thr
  Misc_feature (92)..(92): location 92 can be Trp or Cys
  Misc_feature (95)..(95): location 95 can be Trp or Lys or Pro or Arg
  Misc_feature (96)..(96): location 96 can be Pro or Arg
  Misc_feature (97)..(97): location 97 can be Ile or Ser or Thr
  Misc_feature (98)..(98): location 98 can be Glu or Gln
  Misc_feature (99)..(99): location 99 can be Asn or Tyr or Phe
  Misc_feature (100)..(100): location 100 can be Asp or Pro
  Misc_feature (102)..(102): location 102 can be Pro or Ser
  Misc_feature (103)..(103): location 103 can be Glu or Gln or Gly
  Misc_feature (104)..(104): location 104 can be Glu or Gln or Arg
  Misc_feature (105)..(105): location 105 can be Val or Ser
  Misc_feature (106)..(106): location 106 can be Asp or Arg
  Misc_feature (107)..(107): location 107 can be Pro or Ser
  Misc_feature (109)..(109): location 109 can be Lys or Xaa or Arg
  Misc_feature (110)..(110): location 110 can be Ser or Arg
  Misc_feature (111)..(111): location 111 can be Gln or Ala or Ser or Thr
  Misc_feature (112)..(112): location 112 can be  or Glu or Xaa or Leu
  Misc_feature (113)..(113): location 113 can be Lys or Glu or Gln or Arg
  Misc_feature (114)..(114): location 114 can be Asp or Arg or Ser or Thr
  Misc_feature (115)..(115): location 115 can be Asn or Leu or Ser
  Misc_feature (116)..(116): location 116 can be  or Asn or Gln or Leu
  Misc_feature (117)..(117): location 117 can be Leu or Met
  Misc_feature (118)..(118): location 118 can be Xaa or Leu or Ser or Met
  Misc_feature (119)..(119): location 119 can be  or Leu or Phe or Arg
  Misc_feature (120)..(120): location 120 can be  or Trp or Cys
  Misc_feature (121)..(121): location 121 can be Asn or  or Thr
  Misc_feature (122)..(122): location 122 can be  or Ser
  Misc_feature (123)..(123): location 123 can be  or Pro
  Misc_feature (124)..(124): location 124 can be  or Lys or Gln or Arg or Thr
  Misc_feature (125)..(125): location 125 can be  or Phe
  Misc_feature (126)..(126): location 126 can be  or Pro or Arg or Thr
  Misc_feature (127)..(127): location 127 can be  or Trp or Leu
  Misc_feature (128)..(128): location 128 can be  or Val or Asp or Gly
  Misc_feature (129)..(129): location 129 can be  or Arg or Met or Gly
  Misc_feature (130)..(130): location 130 can be  or Ala or Arg
  Misc_feature (131)..(131): location 131 can be Ile or  or Ser
  Misc_feature (132)..(132): location 132 can be Ile or  or Val or Ser
  Misc_feature (133)..(133): location 133 can be Ile or  or Ser
  Misc_feature (134)..(134): location 134 can be  or Val or Ser
  Misc_feature (135)..(135): location 135 can be  or Leu or Ser or Cys or Thr
  Misc_feature (136)..(136): location 136 can be  or Ala or Pro or Phe or His or Thr
  Misc_feature (137)..(137): location 137 can be Asn or  or Pro or Leu
  Misc_feature (138)..(138): location 138 can be  or Leu
  Misc_feature (139)..(139): location 139 can be Ile or  or Leu
  Misc_feature (140)..(140): location 140 can be Asn or  or Tyr
  Misc_feature (141)..(141): location 141 can be  or Thr
  Misc_feature (142)..(142): location 142 can be Ile or  or Gln or Leu
  Misc_feature (143)..(143): location 143 can be  or Val or Leu
  Misc_feature (144)..(144): location 144 can be  or Val or Ala
  Misc_feature (145)..(145): location 145 can be  or Pro
  Misc_feature (146)..(146): location 146 can be Ile or  or Val or Pro
  Misc_feature (147)..(147): location 147 can be  or Lys or Pro
  Misc_feature (148)..(148): location 148 can be  or Lys
  Misc_feature (149)..(149): location 149 can be  or Lys
  Misc_feature (150)..(150): location 150 can be  or Leu
  Misc_feature (151)..(151): location 151 can be  or His
  Misc_feature (152)..(152): location 152 can be  or Arg
  Misc_feature (153)..(153): location 153 can be  or Ser
  Misc_feature (154)..(154): location 154 can be  or Gln
  Misc_feature (155)..(155): location 155 can be  or Pro
  Misc_feature (156)..(156): location 156 can be  or Pro
  Misc_feature (157)..(157): location 157 can be  or Pro
  Misc_feature (158)..(158): location 158 can be  or Pro
  Misc_feature (159)..(159): location 159 can be  or Leu
  Misc_feature (160)..(160): location 160 can be  or Thr
  Misc_feature (161)..(161): location 161 can be  or Cys
  Misc_feature (162)..(162): location 162 can be Asn or
  Misc_feature (163)..(163): location 163 can be  or Leu
  Misc_feature (164)..(164): location 164 can be  or Ala
  Misc_feature (165)..(165): location 165 can be  or Glu
  Misc_feature (166)..(166): location 166 can be  or Lys
  Misc_feature (167)..(167): location 167 can be  or Lys
  Misc_feature (168)..(168): location 168 can be  or Lys
  Misc_feature (169)..(169): location 169 can be  or Ser
  Misc_feature (170)..(170): location 170 can be  or Ser
  Misc_feature (171)..(171): location 171 can be  or Leu
  Misc_feature (172)..(172): location 172 can be  or His
  Misc_feature (173)..(173): location 173 can be  or Cys
  Misc_feature (174)..(174): location 174 can be  or Thr
  Misc_feature (175)..(175): location 175 can be  or Phe
  Misc_feature (176)..(176): location 176 can be  or Ser
  Misc_feature (177)..(177): location 177 can be  or Thr
XXXXXXXXXXXXXXXXXXXXXXXXXXXXRFXXXXXXXLXXXXRXXXXSXXXXXXXXXGXXSXXDWDKAWXXFKKKGKXXLFSXFSXXKYVTWNPRRSEXPLSEEVDPIKRXXERSNLMLWTSPXFTLVGAIXIVXXLLXYTXXXPXXXXXXXXXXXXXXXXXXXXXXXXXXXXXXXX

SEQ ID NO: 33636 - DNA, 10289 bp, Artificial
  pMON82060
cgcgccttaattaagcggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctggcgcgcctgcggccgcctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttaaaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgttttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccatgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaccgcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaagaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatatcgcgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgaccgctgatcgatcgcggccgctgg

SEQ ID NO: 33637 - DNA, 9769 bp, Artificial
  pMON82053
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca
